United States Patent 10,279,031 (COMPOSITION COMPRISING ANTIGENS AND A MUCOSAL ADJUVANT AND A METHOD FOR USING) - sequence listing, part 7

SEQ ID NO: 7 - DNA, 2501598 bp, Actinobacillus suis (residues 1-1,250,799 of 2,501,598)
ttgacagttcattttaactttaattccttggagcaaatcgtgtcttccctttggtctgattgtcttaatcacttacaaacgaaagtatcgccgactgattacagcacttggctacgccctttgcaggcaagttttgcaaacggggagctcactctttatgctcaaaatcaatttgttgaaaattgggtaaaagataaatttttggcggagatcgtcgatcttgcccgctttttatctaaaaatgacaatttagcggtttcaattcgtgttggtattaagccggcggaacacaaaccgacttcagccagtacgacaagcaacgattcaaaagaagaagtacaagaaaccaataagagtttcagaacaggtttaaacgaatcactgactttcgaaaatttcgtacaaggtaaatcaaaccaattagccaaagcggttgcccaacaagtggcggataatccgggtgaaagccactgtaatccgttttcactttacggcggtaccggtttgggtaaaacccacttattacatgcggtcggtaatgaaattctaaaacgtaacccgcaagcgagagtggtctatattcactcagagcgttttgtgcaggatatggtaaaagcattgaagggcaatacgattgagaattttaagaaattctatcgttcacttgacgtgttgatgattgacgatattcaattctttgctaataaagaagcctcgcaagaagagtttttccacacgtttaattcattattcgagcgtaataaacagattattttggcttcggataacttcccgaaaaatattgagaatatcgaagaacgcatcaaatctcgactcagttggggggtaagtaccgcgattgaaccacctgaattggaaacccgagtggcgattctgatgaaaaaagcggaagaacgtggggtagagttgccggaagaagtggcatttttcatcggacaaaaattgcgtaccaatgtacgagaattagaaggtgcgctaaaccgagtgattgcgtggcgtaactttactaagcgtcaaatcacaattgatgcggtgcgtgaagcgttaaaagatctgattgcttcttacgatcacttaattacgattgaaaatattcaaaaaacggttgccgaatattacaacattaaaatgtctgacttaaagtcaaagagtcgtacccgttcggttgctcgtcctcgtcaaatggcgatggcattggcaaaagaattaaccaatcacagcttaccggaaattggtcgagaatttggcggacgtgatcacactaccgtgatgcacgcttgtaaaacgattaatgaattacgtgataccgatagcggtattcaagaagattataccaacttaaccagaaaattatcgtcataggcgataagggattattatgcaatttacgattaccagagaacagttacttaagcctttacaacaggtctgtggcgtattaagcagccgcccgactttgcctgtgattaataatattctgcttgaaattgaaggcgatcgcttatcactaaccggaacggacttagaagtggaattaaccacggtggcaacccttgaacaagcggtcgattttgccggaaaatttaccattcctgcgaaaaaatttctcgatatttgccgtagtttgccggaagatagcagcatttcggtacaattcgaagaagatcgtgcgttagttagagcggctcgcagtaaattcaatttagccacattaccggcaagtgattatccgaatttaatggattggaagccggaagtggatttttcgattgaacagtccacccttgctcgtttgattgatgcgacgcaattctcaatggcgaaccaagatgcgcgttatttcttaaacggtatgaagttcgaaaccgaaggcaatttattgcgtaccgtagcaacggacggacaccgtctagcggtttgtaccatggcattaaatcaagagttattaactcattcggtcattgtgcctcgcaaagcggtattagaattatcgcgccttgtcgcagtgagtgatgaaacggtacgtttagaaatcggtaccagcaatttacgtgtatcaatgaacggtgtggtgtttacctctaaactaattgacgggcgtttccctgactatcgccgagtattaccacgcaatgcagatcgcattttagaagcggaaaccgaggtgttaaaacgtgcattaatgcgtgcggcaattttatcgaatgaaaaattccgtggcgtgcgtttagcgttaagcgaaaacttactcaaaattaccgccaataacccggaacaagaagaagcggaagagatcattgacgtggcatatcaaagcccggaaatggaagtcggctttaacgtgagttatttgttagacgtgctgaacaccttaaaatgtgaacgtgtgcgtttcaatttggtggatgcaagttcaagctgcttaattgaagattgtgataacagcactgccgaatacgttattatgccaatgcgtctttaatcctatttgcggagctacaattatttctgtgtagctccgtgttttccgtggttatttttatgcccttatccagattaatcatcaataatttccgtaatctccaatctctcgatcttgaactcagtccgaattttaattttatcgtagggcataacggcagcggtaaaaccagtctgctggaagcgattttttacttagggcacggtcggtcatttaaaagccatatcagtaatcgaatcataaactatcaagctgaagattttgtgttacacggtcgtattgatgaagggcaacatcaatggtcggtcgggattcagaaaaaacgttcgggtgataccctgttaaaaattaacggcgaagacggtaataaaatttctgatttggcgcacctactgccgatgcaagtaattacgccagaagggctaaccttattaaatggtgggccgactttccgtcgagcgtttttagactgggggctattccaccaatataccgaattttatagctgttgggcgaatttaaaacgtttactcaagcaacggaatgccgcattgcatcaagttcgtagttatgccgaattaaagccgtgggatactgaattggcgaaattagcggagattgtcagccaaatgcgtgcgaactatgcggaagcgttacgaccggaaattgagaaaacctgtcagtttttcttacctgaattggaaataggcgtgagtttccatcaaggctgggagaaaggtgccgattatgctgagattcttgctcaaggttttgagcgagataaagcgatgggttataccatgattggcccgcaaaaggcggattttcgctttcgggcgaacggtttaccggtggaagatgtgctttctcgtgggcagcttaaattactgatgtgtgcgttgcgtttggctcaaggagaatatttagtggcgcaaaaagaacgtcagtgtttattcctgattgatgattttgcttccgagttagatccgactaaacgagaactgttagcgcatcgtttacgagaaagcggttcacaggtgtttgtgacagcgattaccaaagaccagctaaaccaaatgcaatggcaagaaagcgagcaagatagactgttccagattcaacaagggatgttaaccaaataacaaaaggggatgtgttaaacatcccctttttcatacatttaaatttaattatgttatttaattacgctatttaattacgccacacgccatacgaggaccaccaccgcctaatgctgctgggtgatcagagtgattatcaccgcctgcgtggatcattaatgaatgaccttttacttcctcaagttttgttaaacgtggtgcaagtacagggttgttagccgaaccgtcttgcattacagataatgccggtaaatcgcctaagtgagcattatcagaccatgggaagccgtgttgtttggtacctttaggatcccagtgaccgccggcgcctaagcctgctactaatttgccgtctttttcttttgcttcacagcttggattttcatgaatatggaaaccgtgtaagccttgtgtaagaccggttaagtttggtgtaaatactaaaccgtatgccgattcggtaatttcaactgtaccgacatctttatttccgttaaccggatcaagttgctgaacttgtactacgagtttctctgcattcggattatcagtagcatggtggcctggatgtgcagcagcaaaagccgatgcgctgaataatgctacagagagcgcgagttttgtgaatttcattgtaatttccttttagttttagtgtgaaaggggagaatattttaggtcggtaagccccatttaacatatattacctgaatgacctaaaatcgattgcatttttgcataaaatcttgtatttatcacatctatttccaaaataaattcaaacacaactttgtacttttcaatttaggagcaacacaatgcaaaatgtaggttttatcggttggcgtggtatggtcggttcagttttaatggatcgtatggttcaagaaaacgactttgcaaacattaacccaatttttttcactacctcacaagcgggtcaaaaagcaccggtttttgcgggtaaagatgccggtgatttaaaggacgctttcgatattgaagaacttaaaaagttagacattatcgtgacttgccaaggtggcgattacactaccgaagtgtatcctaaattacgtgctgcaggttggaacggctattggattgatgccgcatcaaccttacgtatggaaaaagacgcaattatcgtattagaccctgttaaccagcatgttattacagatggtttgaaaaatggtgtaaaaacatttgttggcggtaactgtaccgtaagtttaatgttaatggcgatcggcggcttattcgaaaaagatttagtagagtgggtttctgtcgcaacttaccaagcggcttcaggcgcaggtgcaaaaaatatgcgtgagttactctcacaaatgggtgaattagaagattctgtaaaagcggaattagcaaaccctgcctcatcaattttagatattgagcgcaaagtaacagcgaaaatgcgtgaagacagcttcccaaccgataacttcggtgcgccgcttgctggtagcttaattccttggatcgataaattattagaaagcggtcaaaccaaagaagaatggaaaggttatgcggaaactaacaaaattttaggtttaagcgataacccgattccagttgacggtttatgtgtgcgtatcggtgcattacgttgccacagccaagcatttactattaaactgaaaaaagacctaccgttagcggaaatcgagcaaattattgcggcgcataacgaatgggtgaaagtgattccaaacgacaaagaaactactttacgtgaattaacaccggcgaaagtgaccggtacattaagcgttccggttggtcgtttacgtaaattagcaatggggcctgaatatcttgcggcatttaccgtaggtgaccaattattatggggtgcggcagagccggtacgtcgtatcttagttcaattaaccaaataattcggattaattagagacggacaagcggtcggattttgcaaaaaaattgcaaattttgaccgcttatttattgcaataaaaagcccaagcaactctgcttgggctttagctttcgatgattctctgaaattaccaataagcacggaaaccaacaactgttgtatagtcacgtgatttatttacaccacgtgctactttagcttctggatgtttagtgcgagtagcttgccattctacgaaaagtttggtttttaactgatcaaccacttttggtaagtagtattcggtacccaccataaattggtgttttctttcgttattgtctcgaccaatcgcacgttcaagcttattggttttgtaagcatacataccgtatgcacgccagtcatcagttaaacgatgataaacaagggtacgcacttctttctctgtacgttcattgccttgtaccgattggttttcggttttacgacgttctaagtcgacaccgaatgtagttttatcgtaagtatatgccgcaccgaccgaataagcattacggttataagccggtgccgaaccgataccttcaaaacgctcacgtgagaaaccggtcgccacttgtacgctttgtacgtcatcaaatttataattataaattgaaccgaagccccatacatttttgcgatcttggcttaaatccatattcgtatttgaacgttggctatgaccgccatagtacgcaccaacttttaagccttcaatacctttgtaaacatactgaactgaacgacgagcgccagaaactaataaaccgtctgataagcttaaggtatttggaatatcggtttgttttacttcatcggtgatcacggtttggttaccataagtcacttcaccatattgcttatgacctaaacctgcgtaaagttgatgagcataaatatgatcaaaatcgtgttgagaactagatacaccacgttcgtccgcaccacgtaaacgccattctacacggcctaaagcatagaagccgctaccaagttgttgggttaaacggaggccgaaacgtgagccgttattttgtaccggtttatttacgtggttacgaactgccgaaccgttttggtaagtgtctttggctgaggtacttgtccattttaaacgagcagaaccgataaattccgctttagtaccagttgagtctaagttaaataattcaaccgctgatgccgagcttgccataaaagcagaagcgaaaagggctaatgctgtttttttcatattcactccaaatgaaatataaatcaaaggctatagtttacttggagtgaaaaattcaatcaatgtgattttgttagtttatattgtgattggttataatcagcctataataaaagtaattaaatgaataattaatgagagtgaaattatgatgacaaaagaagcgcctcttattgctctagttgccggtgagatttctggtgatattcttggtgccgggttgattaacgcccttaaattacattatccgaatgcccgttttattggagttgctggcccgcgaatgatacaagccggttgtgaaaccttattcgatatggaagagctggcggtgatggggttagcagaagtggtaaaacatttgcctcgtttgctcaaacgtcgtaagcaagtgattgaaacaatgctggcggaaaaaccggatatttttattggtattgatgcccctgattttaatttaacggttgaagaaaaactcaaagcgagtggaattaagactattcattatgttagcccatcggtttgggcatggcgtcagagccgtgtacataaaattgcacgagcgaccaacttagtattggcatttttaccgtttgagaaagcgttctatgatcgttttaatgtgccttgccgttttatcggtcatacaatggcggatgcgattgcgctaaagccgaaccgttctgaagcttgtgcagctttggaattagatgaaacaaaacgttatcttgcaattttagtgggtagccgagcaagcgaagttggctttttaacagagccgtttttaaaagccgcacagattcttaaacagagatatccggaattagaatttttagtgccgttagttaatgataagcgcattgcccaatttgaacagattaaagcgcaaattacgccggatctgggggtgaaaattcttaaaggcaatgctcgccaagcgatgattgcggcagaagccaccttgcttgcttccggtactgcggcgttagaaggaatgttgtgcaaatcaccgatggtagtgggttacaaaatgaaagctagcacttactggctggctaaacgtttagtgaaaactaaatatatttccttacctaatctattagcggacgaaatgttagtgcctgaattaattcaagacgaatgtaatccggaaaatttagcatggtatttgggtaattatttggcggatgatgcagaccataaaaaacagcgaaacgaattaaaacaacgttttactgaattacataaactgattcaatgtgatgcggatacacaggcggcacaagcggtggtcgatgtgttagaagcggaaacaagcggtcaaaattaattctatttttacaaaaggaatctcacagaatgtggaaagaaattttacttaattacggtattttcttattggaattacttacgatattcggcattgttgcggttgttgttatgttgattttagaagcgaaaaaacaacctgaaaatggcgtaatttccatgacgaatttaaccgaaaaatataaagaacagcaaaaagctttagcgagttttttcctcagcgaagaagagcagaaacagcaggaaaaagatgagaaaaaagccgctaaagaaaaagcgaaagcagagaaaaaacgccttaaagaaggcggagagaaaaccgaagcggaaaaatctcgcctattcgttttgaaatttaacggtgacgtacaagccagtgcggttaatgcattagctaaagagattagtgcggtactatcactagctaaagcggaagatgaagtgttgcttaaattggaaagcccgggtggtgtagttcacggctatggcttagcggcgtcacagttacagcgtttacgtgatcacaatattccactcacggttgcagtagataaagtagcggcgagcggcggctatatgatggcgtgtgtggcgaataaaattgtttcggcaccttttgcgattatcggttcagttggtgtggtggcacaagtgccgaatatccatcgtttactgaaaaaacacgatattgatgtagatgtaatgactgccggtgagtataaacgcacagtcactttagtcggtgaaaatactgagaaaggcaaacaaaaattccagcaagaattggaagaaactcatgaattattcaaacaatttgtggtacaaaatcgtccgcaattagagattgaaaaaattgctaccggcgaacattggttcggtaaacaagcattggcgcttaatttagtcgatgaaatttcaacaagtgatgatttattgttgaatgcggtaaaagaaaaagaggtgattgagctaagtttcaaagagaagaaaaatctgactcagcgtttaggcgtacaaatggagcaatcagtagaaaatattattgcgaagttactacataaaaaccgtacaccaatgatgtaaggtttagcttgataaaaaagcggtcgaatttgaccgcttttttacgattactatgagctaacgaggtagcttttggcagtgaggacagaaataactgttacgctgcccgataattttggcttcaatcgctgtgccgcagtcattacaagcttcgcctttgcggccgtaaacttgcaacacttgggtgaaataacccggtttcccgtccggttgaataaaatctttcagtgtcgttccgccttgaataatcgctttagtcagcacttctttaatcactttcactaagcgctcgcattgcttttccgtcagattttgcgtagcaagctccggatgaattcctgctataaacagtgattcacaagcgtagatattacctacacccaccacgatatcgttattcataataaagtttttgactgccacggttttgttacggcttcgagtaaataaatactcggctgtaaatgcttcggaaagtggttccggtcctaagcgagtaataagctcgtgttgttcggcattttgagtccacagccaacaaccgaatttacgtggatcgttataacgtagaatggtgccgtcttgtgtgatgagatcaacatgatcatgtgtgcctgccgtttgttgattttccggcaaaatacttagtgagccggacattcccaagtgaatcaaaatatcgccttgtgtagtatgtaaaattaaatatttggcacggcgagagagtgaaacgatttttgcaccttgcatttgttgtaattcattggaaatcgcccaacgcaatttattggttcgaatcacaatttgtttaatcgttttaccttgtaaataaggttccacgcctcgtaagctggtttcaacttccggtaattcaggcatatattttctccaaagatttgagataaacaaagggcaaggataaccttgcccaagataattatttcgctcttacgaaacgactaaggattgcaccaatcaataatccgccaactgcaaacggtagccactccattgagtatgctttaagcggtaagttttcggtaaaacttacaccagcaacagagagaatcgatatgatggttaccagaatcaacgaagtacgtaatgctaataatggaagctgtacaaacagattcaataacagtaagaaaataactgacattgcaattgggtaaagtaccagtaaaaccggaattgatttactgattaccgcacttaatccttggtttgctaaaccaaaaccaattaaggtacagataattgcataagtcttataagagattttcgggaaaatttcattgaagtattcgcttaccgaaacaatcagtccaattgctgtggttaaacaggcaagtgaaacaatcgcacctaaaagtgttctacctaaatcaccgaatgcttgggttgccgcaacgttcaagatataagtacctaaatcttgcttcttcgtagctaaatctgccacaacttcagcagaaatgggtaatttattaccaatccagccgatagataagtaaattaacgctaataaaattgctgcaattacccccgccatcgcagtttgtttgctcaatgctttttcgttagaaaaacctttgtttttaattgcattgatcacaatcaccgagaaggcaacagaagctagggcatccatggtgttataaccggctaagatgccgtttaccattggtgcttccatcacattggcgcttgacggattatttgagagtaaagcgataccactgataactagcgcaagaatcgcaattaatagtaaaggcgttaaaatcgaaccgattctttccaccatttttgacggatttaaaccaatccaaattgctaatgcaaaatagattaaagtaaaaagcaatagagaaatcggcgtttgttcgcctaaaaacggtaaaattgccatttcgtaagcggttgccgctgtacgcggaatcgcaaagaaaggtccgatagttaagtaaatcgctactaagaataatagagaaaaccaaggatgaatacgttgtaaggctgctttataaccacctttataagacgcacttacaataataccgagtaacggtaaaccaacgccggtaatgacgaatccaatagttgcaatccagaaatccgcaccgctttcaaaacctaatttcggcggaaaaattaaattgcccgccccaaagaaaatggcaaacagcataaagccgaccacaaatgtatttttagtcatatacataccacacttttaatttgtttataaacaaatattaaacacgaaaggaaaaacagaaacccgaaaaatagcaaaaccgaactttaccgaaaaagtaaagttcggctaaaaatagaccgcttgtagcggttagttcatatataaaccaccatttacatggatagtttcgccagtgatatatttcgcatcatcacttgctaagaatgcgaccgctttcgcaatatcttgcgccgaacctaattgacctgctggaatttgacttaagatcgcttgtttttgatcttcgtttaattcatcagtcatatcggttgcgataaagcctggagcaacaacgtttaccgtaatgccacgagaagcgacttctttcgctaatgatttcgagaaaccgactaaaccggcttttgccgcacagtagttggtttgacctgggttgcccattgagccgacaactgaaccgatagtaatgattcgaccgccttttttcatcattggacgtaatactgctttagataagcgataaacagaagttaaattggtttggataatgtcgaaccaatcatcttctttcatacgcatcaataaaccatcacgagtgatacctgcattgtttactaaaatatcaacatcaccgaaatccgctttgatttgtgccaatacagcttcaatagagtccgcatctgttacgtttaacactaaacctttacctttatcacctaagtatgcagaaatactttccgcacctttttccgatgttgccgtaccaatcacggttgcaccttttgcagctaattcttctgcgatagctttaccaataccacgagttgcacccgttactaatgcgattttaccttgcatttttttctcctataaaaagttcccctctttagtaaaggggaggaggggagataagtgtgatgttgaagatcctaaaaatctcccccagcccctcttttcaaagaggggtgttaatcattatgctgaaacagcctctaatgaagctacatcattgactgctttggcatttaactcttttacgatacgaccagctaaaccggttaagactttacctgggccgatttcataaagcgttgtaacaccttcattcgccattttttctaccgtttcagtccaacgaactgggctataaagttggcgaactaatgcattacgaattgcttcagcatcggtctctacactaacatcaacattgttaataactggtacaaccggtacgtttaacgtgatattttgtaatgcttcggttaatttatctgcagctggtttcattaatgcacagtgagaaggcacgcttaccgctaatggtaatgcacgttttgcacctgccgctttacataattcccctgctttttctgcagccgcttttgtacctgcaatcactacttgccctgggctattgaagtttactgctgaaacgatttcaccgacttccgcttgagcttgttcacaagcattaataatcgcttggttatctaagccgataatcgcatacattgcacctgtaccagccggtacagcttgttgcattgcattgccgcgtaattccactaatttgattgcatcttggaaatttaatacgcctgcacaaactaatgctgagtattcacctaagctatgacctgccattacagacggttttaattcagggtatttttgttgccacacacgataaatcgcaaccgatgatgctaaaagtgccggttgggtacgttgtgtttgacctaaatcttctgcggtaccgttttggactaaatcccaaagatcataacctaaaacatcagaagcttgtttgaaggtttcttcaacaattgggtatgcagttgcaagatccgctaacattccgaccgcttgtgagccttgacctggaaataccattgcaaaatttgacatattttttcctcttatttataaatttggtactgaggacacacggcgtgcgtccgttatgaataatgcttaatctggtgaataataaagtttaccgatttcaatacgctgacgaccggtttctaaacgccatttatttgaatcacgtaaagaataggcgcaaccgcagtattcttgctgatagaaacgttcacgtttactgatttcgatcatacgctgcgaaccgccgtttttacgccagttgtaatcccaataaaccacatcatcaaatttagcggcggcacgatgcccgcagtcgttgatttggttcatatctttccagcgtgaaatgcctaagcagctggtataaaccggaaaaccgttgttatgtgcgtattccgccgctttctcaaaacgcatatcaaagcacatcgtacagcggataccacgctccggctcccactccattccttccgcttttttaaaccattcacggcggtcattttcgtaatcatcatcgaaatcaatgaacggaataccccatttctcggcaaagcgaatattttcctctttacgaatcagatattctttcatcggatgaatgttcggattgtagaaatagatagtaaattcgatacctgatgcgtggattgcttccatcacttcaccggaacaaggcgcacagcaagagtgcagcaataatttgttatgtccgcccggaagcgttaatttttcacgcacaaaaggtgcgttcggatctttgcctttacgcgttagctttttcttttgttgcaacgcttgtttatgctctaaaggttgttgattttgttctgtcataaaagttgtaaaaaattctcaaaatttgaccgcttattaatacgaacgatcgaccgataaataagcaagagaaattaacgcttgtttgtattcgctttccggtaaaactgtaagcgcatcaactgctttttgtgcttcttgcttagcgcgcgtcattgcataatcaagtgattggtgttccgccataatttctaatacagctggaatttgttcacgttccccgccattttcaattgctgaacgaatcatatccacttgagcttggttacctttcgcttgtgcggcgtgcatagcgtgtagcaatggtaaagtcggtttaccttcaacgaaatcatcaccgacatttttaccgaagctttccgcttttgctgagtaatctaaaatatcatcaattaattggaatgcggtaccgagataacaaccgtaatctttcaacgccgtttcaaccgatttttctaccccagccacaatggcaacacattgcgttgccgcttcaaataggcgtgcggttttattgtagataacacgcatataattcgcttcggtagtattcggatcattcacattcatcagctgctggacttcaccttcggcaagcgcattggtggcagcagacatcacttttaacacttcaagcgaatcaacactggtcatcatttggaatgagcgtgtgtaaatgaaatcgccaaccaatacgcttgctgcatttccgaaggttgcgttggcagtagctcggcctcgacgcatatccgactcatcaaccacatcatcatgcaataaagtggcggtatggacaaattcaataaaagccgcacaagtaacgtgtttattgccacggtaacctaaagcgttagcggcaagtaccgcaattaatgggcgaatacgtttgccaccaccggcaataatataatggcctaattggttgattaaaacgacttcggagttaagctgagcgagaatctcagcatctaccgcttgcatatcttgcttcgcaagcgcttgaatttgctcgagtgttaatagcgttgtcatttcgttctcatattaaatgtgaaaatttggcggcaattctaccttaaatctgacaagcttcaaaaaagaatcgaaaaaagcggtcaatttcatcaatttttttacaaaacggcggataagtctcttgatgttttaacgatatattcttttctgaagtttggtaaaatctgaaaattgcttagattgtttactcagagtaaatagtctatcaactttgatctatctaaacataaggaaaattattttgtagaatggtattcgaaaatttcattcatctttagaatctaggacattaattatggcaaaacaaatcgcagttttagttggtagtggtagtaaaacatcaatcagtcagttagttgcaaatcacttaaaaagtgttgcaccggcaagtattcaattaaatttcgttaatattgcggatcttcctttatatgatcgtgatttagatgagaacagccctgatgcatacactcgtttgcgtaatgcaattgaacaagctgatggtgtattactgattacaccagaacataatggcggtatgtcagcaatgattaaaaatgcaatcgatgtgggttcacgtccgatgggtcaaagcaaatggcttggcaaacctgccggtatcgtttctgttgcagcgggaatgtctggcggtgtaagagcagcggatcaattacgtgttattgcttccggtgcttttattaatatgccggttgcgccatttgcagcgaatgttggcggaattttcaatggtgtatttaacgaaaatggtgaggttgtttctgaagctgtagcagggatgttaaaaggctttattgacggctatgctgattttgtcgctaaattctaatcaattcatataagacttctatattacaactacttaatcaagcggtttaatttttgcaaaattttgcggaaatttaaccgcttttttgttgtttatactattgttaattgtttcaaaattggaaatagtctatcaacaaaaaggttatttatcttctatttttcaatagataaaatacctacctctttattgttcagtcttattatttaaaggaaagcaaaatatgaactcaaacttagaaaaatttacgccatacgcattagcattattacgtattgttgcagcttatatgttcttactacacggtacggcaaaattctttgaatttcccgtatcgatgacaggcggtaacggtgcagtaccattaatgtcaatgtacggtatcggcggtattttagaaatcggtggtggtattttattacttttaggcttattcactcgcccagttgcctttttactttcaggtatgatggcatatgcatatttctttatgcacgcaacggcggagaatattgccctccctctagtaaaccagggtgaattagcgctgttatactcggtggtattcttcttattagtgtttgtcggtgcaggcgcatttgcattagataataaacgtcaaaacctcaacaaataaggcttttagccgataaaaaagtgaagcggtcattttttgcaaaaaatttgcagaatttggccgcttttttgttataatagctttatctaaaaatcgagagggtagaagctgcggttttgtcgtctatttcatagaattaaaacgaaaaaacacgtggttttttaggttaataacaggcaaaaataatgcttatgactttctttaatgcctaaaatcggacataagaaaagataacgcagaaattttttcatttttctgaaaatggttcttgctctttgcatagtttttgcgtagaattgaccacctattttatatgaatttaagagtgcctaagcaaaagcgattggcacaaattagcggagtaaatatgtacgcagttttccaaagtggcggcaaacaacaccgagtaagtgaaggtcaagtagttcgtttagagaaacttgaaatcgcaactggtgagaaagttgaatttgactcagtgttaatggtcgttaacggtgaagatgttaaaattggtgcaccagtagttgctggtgcaaaagtagtggctgaagttgtagcgcaaggtcgtggcgataaagttaaaatcgttaagttccgtcgtcgtaaacacagccgtaaacaacaaggtcatcgtcagtggttcacagaagtgaaaatcactgggattcaagcataatttcagaggagatcaagtagatggcaactaaaaaagctggtggttcaactcgtaacggtcgtgattctgaagctaaacgccttggtgttaaacgttttggtggcgaatctgtattagcaggtagcatcatcgttcgtcaacgtggtactaaattccacgctggtagcaatgttggtatgggtaaagaccacactttattcgcaactgctgacggtaaagttaaatttgaagtgaaaggcgagaaaaatcgcaaatacgtaagcatcgttgctgagtaattcatttcaatatagatttgaaataaaaccccacgaatgtggggttttttcttaccttttttccaaccttataaaaaatccatgaaacaacaacccttgcttggctttttattttctttgatagccattctgatgtggggaatgctaccgcttgcgattaaacaagttctaaaatcactcgattctcaaacgattgtttggtttcgattcttagtcgcaacgcttggtgttttcgccatgcttgctttggcaaaaaaattaccaaatttgaccgctttctttcgccaatatcacaggttgtggttaatcggggtcattggattgtcttgcaatttcttcctatttaatctcgccttaaattatattccggctgcaaccagtcaagttcttagtccgctttcttcttttgtgatgattgcattgggggttgtattgtttaaagaaacaatcggtatccatcaaaaaattggttttgtattggtggttagcggtttggtgatgttttttaataaccgttttgccgacttaatcgcgatgaacagttatgcatacggtgtattacttggtatttgtgcaagtttgatttggattggctatagtttgtcgcaaaaaatcatgttggcgcattttagttcgcaacaaattttgttattgatttattttggttgtaccttagtctttacgccttttgcacatatgggagaattagctaaattagatttagctgcttggggctggttaggattctgtggcattaacaccgttattgcttatggctgttatgctgaagcattaaatcgctgggaagtttctaaggtaagtttaatgatgacgcaaattccgatcctgactattatgctgactgcattaagttatgcaatttcgccagagctatttgaagcgccagacttgaatggattaagctatattggggcgattacggtagtttccggtgctatgctttctgctgttggacataaattattttatcgtaatcaactccgcaaaaaataataggaataagaatgcaacaaagacccttactcggattttcacttgcattgctcgcaacagcaacatggggatcgttaccgatgatggcacagcaagttttaaaatatgttgatgcacaaacattggtgtggagtcgcttcgtggttgcagcggcagtgctagggttactcttacttgcgacataccgcttaccaaaattagcaaaacttacgctaaaagatgggggggggtgtttaggtgttattggattatcgattaactttgtattatttgctgatgcacttaactatatttcaccaactacagatcaagtactatggcaattagcgccgtttactatgattttatgtggtgttttattttttaaagagcaattaaaatttttccaaaaaataggctttgcattgttagttattggtctgattgcattctttaatgatcattttgatgagattctgcaatttgatacttacgcttggggaattttgctggggtcaggtgcaagtacgatttgggttatatatggtattgcacagaaattattgcttagaaagctaagttcgcaacaagttttaatgattatttatattggttgtagcttattacttgcgccgcttgcgacaccaaccgaattagaacaattaagaggcttccctttaatctgctttatttattgttgttgtaatactttagttggttatggtgcttatggtgaggcgttaaaccattgggatacttccaaggtgagtgtagttactacaatgattccagttttcacgatgatttttgcttttatcgggcattattttttcccaaatacgtttgataatccggatatgaatttagttagctatattggtgcattcattgtggtaattggagcgatgttagccgcagtaggggataagctattggtaaaaaaatcagaaaaatagaccgcttgttagggtaatattcttcaatatatcagccaagaaaaaagtgatgagtatctgactactcatcacttttttcttattgtgcgagggactacagctcaatatattcgacatctaagcgaagtagtgtttgggacaactcttcggtcatacgtctatggctgaggattgcctgtttttctgccatcacaatacgagtaaccggtttatccagtaagccatttaagcgacgatagtttaatgcactttgtaaaggcaagaagctagggttaaacgcagcattttcagcataacgaccggtaataatctgttcatcaacttgtaacgcaataccactcatcgcttggctgtatggtgcataagattgctgtgcggcaataatagcggcttgagagagcgggtcgccaaccagttcaaaagtatgatgttgagcatcaaaaagaacttgttcaatattcaaatcttttggtccaaatgaatccggcagatagttttgtaataaattattttggctatgaggtaagtgaatttttagcgttttagctgagtttaattcattcataaattgacggcagtgaccacaaggtgtgtagtttactaccatatcgtgaatagatttttcacctgccagccacgcatgggaaactgcactttgctcggcatgtacggtttgctgcattgagattgatgaaaattcttgattagcaccgaaatagaagttaccggattcaccgatagcaatcgccccaacataaaatttagatacgggaacaagtgcataacaagcagcaagaggtaaacaatgtaatgctagttcgatgggtgaaagctcaaattgctggcaccattgttgaatttgagtaccagaaaaacttgctttatattgttgagcttttaattgatctgcaattgcggttgtaatcggattgttttgttccaagacagctttttcaagtcgtgcttggagtgcaaataaagtagccatcttattctcctttgtttgacggggaattattatacccgcaaatcaacacgccggctgtgatcaagatcgcactaatgacatgaaatgaatggattgcttcatttaacaacaaaatgctgaataatgcagcaaacaaaggcgtgaaattagtcatgactgcagctttggctgagccgataatcgcaatgccataattccaaaatgcataagaaagtatagacggacctagcaccaaataagcaacccccagccattggtaagcggttaaattttgtagtgtttttgcagaagtttgccaaaattcatagagaaagaaaggcgttaagctaagtacggctaggccgactagtgcggtcaagaatgcagtattattaataccgctggggcgtaagcggataatacagcaataaattgcccaactaacggcggatgcaatcgtccataaatcgccttgattaatttctaattgtgccagacgagttaaatccccttgactcaagagccaaataacaccgatcaaacttaatagcgccccactaaaaataacaggtttaattttttctctaaaaaagaataaatttaaaaacagcactaaaactggtacaacggcaagatagaggcttgcatttaaggctgaagtagatttcaagccttgatacaacgttgctggaaatagcacaacgcctaatatcccaaggctccacatgagcatttttgacgttttgattattggaaacgcttttattgtagggcgataaaataagcaagctaaaatgattaaagcaggaaaccagcgcagataagtcagagtaatcggttctatcacgttactgagtacttttcctaacacaaaattcccgccccagaaggctgttgctagaattaaactggcatagccgatacgaatattagtttgcatgacgacctcgttctacgataacgcctacactgcttgcttgtgcgaccgctttgggcttatgtaattcgattctaagtgcttgaataccataggtttgttgtaagagatcggcaatttgatgcgcaacggtttcgactaatttaaaaggcttggattctacaaaatgtaatatcttttctgaaacttccgcataatttaagcagtattgcacatcatcagtcgctgctgcttgtgtgaaatcccattccatttcaatattaaataccaaacgctgcttaattgtatgctcccaatcataagctccaatggaagcaaaagcggtaagttcatggataaaaactttatcggccattttagttttccttatttgtttatgataacattgacgaaaatatagcatacaagcgaagtagcccctagaaattaaaggaaaaattatgagtaccactgcttatttattaattgttgtggcctatatactaggctctatttctagcgccattattttctgtcgtttggccgggctaccggatcctagagaacaaggttctcataatcccggagcaacgaatgtgctgcgtattgggggaagaatttcggcgctaggagtactactctttgatattttgaaaggcagcttaccggtgttatgtgcttttcagctaggattggaaccttcagaaataggttttattgctttagcggcttgtttaggacatatttttccggtgttttttcagtttcgaggtggtaaaggcgtagcgactgcatttggagcactattgccaatgagtacggttgtcgctggtgctgctttatgtagctggttaattgtatttttactatttggtttttcttcgttaagtgcagtggttacggcattagttgtaccattttatatctggtggtttagaccagaatttactttccctgttgcattagtatgttgtttgttggtatatcgtcatcacgataatattcagcgtttatggcgagggcaagaagaaagaatatgggataagctgaaagtcggtaaagagtagctaagtcaagcggtcgaattttttaaatttttaacaaatactttgttgaagaggaatttgaccgcttgttttattgaacagttttaattaacttgtttaagtttacattactactgcttcatattgtggcgcttcaaggtttgcagcaaagcccgcatcaagagcagtttcatagctaaattcactatcatttgcagcgaagttagctgcttctaagctatcatcagtctcacttaattcgcttggcaagctaagttcttctgcttcaagtggttgttcaagctctgttgtgaataaacttgattcgaccgcttcgctttctattgccattggtgcggcaaaatcaacttctcgatattcagccattaatgccataggctgttctgtatcaatactatatgtggtgctgttaccatttgtattgagatcaacgatctggataccgttttcagtcagcgttggaataatatttgatgcaagcgcatctgagcctaagtgaatttcaagcccatctgcataaccgtcattatccgtatccgcattattgatatcactgccaatacgtttttccatcacatcggttaagccgtcctgatctctatcatcgtttgaataatgataatccatacgatagccttgagagaattcttcttttagctgatcatctttttcaaagaagctagataaggcgtgtagtccggataactgaccttttttaaagtcaaaagaggttgttccgtcataacgaccgaggaatttatctacaaattcgccactgatgatataagaatccgttttatgtttggtgacaatatttgatttatcactatcatcaatcatatccgttttggtaaatttgttggctaaatccgccgcttgtttgagtgtttggcttgaaagaccgtgatgttttaaaaccgcagggttaaataatgcgctacgctcgaacatatcatcccaacctgcacggctttgaatggtatgtgccacgaaatattccgctaaataaccacctagcgagtgaccggtcgaataaacatttttcggtttatatgcttcaatatattgcgcagcttgatctaagtaagcggtttgcattggcgtatcaccgaaggctaggcgtaaatctgcagttaaatccgcaaattcgcttgtaccacggaaagcgataacgacattatcatagctgccatcggcattttttccgttaccgaagatcacgtaatccaaaccgcttcccgggctttcggtacgtaaaacttcccagttatcaacaacttccttaatttgttgggcgtagggtgagtctgaatatttaccgttaaagtaggtactgagtttggttttgtcttgataggagagagaagagaaaattctcagatcacgatctgaaacattccacatatttggatttttatcatgtaaatcaatgatgccatctttatccgtatcgggtttataagcagacttaacgttatcaaaagattgctgctgatgttgtgcagcataatcttctaaagctttaataacattggctggaatggacggtttggaggatgcggataaggcggaagggtgtaattctaaattcggttcgaatgtcgtttcagctcgagaggctgacatcaatttcgaaatattagggtatatgtgtgcatattttgctaaaacattatcaacgatatgtgttgatgcggtgtgtttagtaaatgtgttgatcatagtgatctccttataattatagactgggataattcccaccgagattctatgttagtcaaattttagccgcaataatgtttacaaaaaagcggttaaatttgtaaaaaaatctttaaattcaaccgcttattgttatagattttgatctataaatttaactttgtcaatttgtccgcttcttctttaaattccataatggcatttttatcaaagaaatattgagtaccgcagcactcacattgcatatcaattacgccatttttttcggcaagcatttcatcaatttcttccattggcaacaatagaatcgcattgcctgaacgctcgcgagaacagccgcaatggaattttgtctcttgtggcggataaacttcaacttgttcttcgtgatataaacggaataaaagttcttccgcttctaagccgaataattcttcgtctttaaccgtttcggcaagcgtcattaaatgctcgaagtcttccggtgtaccggtaccgtctggcataatttgtaataatagaccgccagctaccgctttgccttcatattcgccggtacgaattactaaatgggtttgaagctgctctgaacgaataaaataatcttctaaacattcacgaatggttggtttatctaaggcaatcacaccttggtaacgttcgccgtcattcggcataatagaaataactaacacgccgttactaatcatttcgcttaaggttgcattgtcagcaatttccgcttgcgtgcgagctaatgcgcgtaattgttgctgttcattaccgtttaccaccgctaatttgagtgggccgtcaccttgaatttgcacggtaattgtcccttcaaatttcataattgcggtgagtaggctagttgcgactaacatttcacctaataaattttgtactgctttcggatattggtgggtattcagcgtttcggtaaaggtatcgtttaaacgaacccattcgccacgtacagcgcggttttggaataaatagcgataaagtttgtcgttgtcttttgtatagctcatggtttttcctagtaaaagcggtaggatttgcaaaaaaatttgcaaatttgaccgcttgttaaaataaaagaaggcacacgtaaaacgtgcgccataaacttgtcgttaatatggggatcaatttataaattacaatatttgatctttaaattttactagatcacggcgctcttttttatttgggcggcgatctggatgtggcatcgaaagcgcatttgctttgcgagcaaaagcaatcgcttcacgttgtttaatgcttttttcagtttcttgataaagtaattgcgcttccggtgcatctcgacgttggtcactgagtgcggtaacaatcacttctttttcatcattaccttggcgcagtttaattattgcgccgacttctaccgttttactggttttcgcccgttgcccgttataatgcacttttccaccttcaatcattgctttagcaatcgaacgtgttttataaaaacgtgccgcccataaccatttatcaaggcgaacttcattatcttcttttgatgttggttgtttcatttgacttctcgttaagtgcattttttataggtaattcgtggataatttcccgtaaacacacattcaaattcagaatgtattatgataacaatgtcataaaaaagaacaaataattttcggtaaatgtggtatcttaatgacatcattttgatgtgggagcaaagcatgcagactcaacaacttcctaaaattttgaacgttgaaacaattgcgaaaactcgaatttttgaggttcaggcggttgatttgcgtttttcaaatggtgaagaacgcacttttgagcgtctcacgccgcaacgccgttcttccgtaatggtgattccgattcaaaaccaagaactgatgtttgttaaagaatatgcggttgcttccgagcgctatgaattagggtttccgaaagggattgttgatcagggcgaagaacccatcataagtgcaaatagagaattacaagaagagatcggtttcggtgcaaaacgaattgaatttttacgctcgctttataccggcccgagtcatatgtttgggctgatgcacgtatttattgcacaagatctctatccgtccaaattagaaggtgatgagccggaaccgttagaagtggtaagagtgcctttggcaaaaatagatgagttacttgctgatccaaattttgcggaatcacgaaatctagccgccctttttatgttaagagagtatctgacaagcggtcaaaaatagggaaattttagcatgcagtcattaaattcaacgcttttacaatcagtcaaacaaatagcgcagcaagccggagaacacctgaaaggtttttatcagcgctcggtcgaaattaagattaaagcggatcataccccggtgaccgaagcggatctgtttattagccaatttatcacggaaaaattgcgccaactcacgccgaacgtgccaattttatcggaagaaaattgcaatattccattggaagagcgcctatcgtggcaagaatattggattattgatccgctagacggtacacaacaatttattgatcgaactgatcaattttctgtggtgatcggcttggtgcaacataatcgcccggtgttaggtgtgattcatgcaccaattctagcaaaaacatattttgccatggcaggaaacggtgcatttttgcaagaaaatgatgaaattcgaccgcttgttgggcatcaaggtttactctgcagcaactgcttaaagattgcaatgggggcatcggcacaaagtaaagtattaaattctgtcaattcatcttatcaagcggaaattttgcagtatggctcaagcagcttaaaagccggtttgattgccgaaggaaaagtagattgttatgcacgatttggtgataccggcgaatgggatactgccgtagcagaagttttattggcagaggttggcggtaaaatttttgatttgaattttgagccgttaacttataatcaacgtccaacttttgtaaaccctcattttgtgatggtggcggataaacagttgaattgggaaaaaatctttcaatttaattcgtaatagctatttgcaacatcagtaaaaatgttacatattagttaaatgactcacgaattcgggaataatataaaaatgaatatcgaaaatagttgtattgttatttttggcgcatcaggcgatttaactttccgtaaattgatcccagcgctttataacttatttaaaattggtcgactcggggagcatttctcggtattaggtgtcgctcgatcggagcttacggacgattctttccgcagcaaaatgcgtgatgccttaatcaaatttgaaaaagcagaagggcaatcattagacgatttctgtactcacctttattatcaagcggttaacacttctgatgcggtagattatgcgaagttattacctcgtttagatgagctacacgataaatacggtagctgcggtaacacgctttattacctttctacaccgccaagtttatatggcgttattccggaatgtttagctgctcacggcttgaccaccgaagaattcggctggaagcgtatcattgtggaaaaaccgttcggttatgacattaaaactgccaaagaattagatgaaaaaatccatcactattttgaagaacatcaaatctatcgtattgaccactatttaggtaaagaaacggttcaaaatttacttgtacttcgtttttcaaacggtttattcgagcctttatggaaccgtaatttcattgattacgtagaaattaccggtgcggaagcaattggcgtggaagagcgtggcggttattacgacggttcgggcgcaatgcgtgatatgttccaaaaccacttgttacaagtattagccatggttgcgatggagccgccggcaattattaatgccgattcaatgcgtgatgaagtggcgaaagtgttgcattgtttacatccgttaactgctgaagatgtgaaaaataacgtggtgttgggtcagtacgtgaaaggcgaagtggatgatcaaatggttgccggctacttagaagagaaaggcgtaccggcagattcaaatactgaaacttatatggcgcttaaatgtgagatcgataactggcgttgggcgggcgttcctttttatgtgcgaacaggcaaacgtttgccagtgcgtgtcacggaagtggtgattcattttaaaacgacaccacatccggtattcagccaaaatgcaccggagaataaactaattattcgtgtgcagcctgatgaaggcatctcaatgcgcttcggcttgaaaaaaccgggtgcaggttttgatgcgaaagaagtttcaatggacttccgttactcggatttaagttcggcatcaagcttattaaccgcttatgaacgtttattattagatgcgttaaaaggcgatgcaactttattcgctcgtactgatgcggtacacgcttgttggaaatttgtgcagccgattttagattataaagcggagagaggcagaatttatgagtacgaagcgggtacttgggggccgaccgaagcggataaacttatcgcgaaacacggtaaagtatggcgtaaaccatcaggtatgatgaagaaaaaagtataaatttagctaacaaatctcccttcccctctttactaaagaggggagtagatcgagcataattcgtgtgcggtgtaaatattcaactaagccgccccctctttagaaaagaggggctgggggagatttgagtatgaattaaaaggaaatgttaatgaactacatcaccttcccatccgctcagcaagcggtggaaaaaattgcacaagaatttgtgttatacagccaattaaaccgtccggtacatatttcattatcaggcggttcaaccccgaaattattgtttaaaacattagcgcaagcgccatttagtacggcaatccaatggcaaaatctgcatttttggtggggtgatgatcgcatggtgttaccaacggatcctgaaagtaattatggtgaagtgcaaaagttactcttcgatcatattcaaattcctcaacaaaatattcaccgtattcgtggcgaagaaccggtagaacaagaacttgcaagattttcacaagaattgaccgcttgtgtgcctgatttagcttttgattggatcattctcggcatggggaatgacggtcataccgcttcacttttccctcatcaaaccgattttaatgacccgaatgttgcagtgatagccaaacatcctgaaagcggtcaaattcgtatttcaaaaaccgctaaattgcttgagcaagcaaaacgtattacttacttagtcacaggtgcagcaaaagcggaagtcttaaaagaaatttacgaaactgaagcagaaaaactaccgtatccggcggctcgtattaaagcgaaaaacggtgtgaccgaatggtatttagaccaagaggcggcaaaattattatagcttatagattatgaatgaaattcataataaagcttaatatttttcaatgcgggtattgcatatttgcattgttctttgtgattgtttcatttaggattccaattaaatgaaaatctttaataaggaattcctatgacgattcaaacacaacaacatacaaataatttaaggcacgcaattgataacagccctatgggcgtatatcaatgggcaatcgtaatcatggctgccgtgatgaattttttagatggcttcgatgtattagcgattgcatttacagcgacgaatatttctaaagagttcggtttatctaaaaccgaatttggtgtgttagtcagcgccggtttagccggtatgacgattggttcgcttttccttgcgccacttgccgataaattcggtcgccgtccgttattattactttcagtggcattatcggcgattggcttgttgatttcaggtttagcgaccacgccatttatacttggtttttcacgtgtgatcaccggtttaggggtcggcggtattttagtcggcaccaatgtgattactagtgaatattcttcaaagaaatggcgtagttttgccattagcgtttatgcggcgggtttcggtattggtgcgatgatcggcggtatgatggcaaaagaattacaagcggcttatagctggcatgcggtttattttgccggcgctgcaatgactgcggtagtgtgggtggtgttatttatttggttaccggagtcgatcgactttttaaccaccaagcaaccggcaaatgcgaaagcgcgtttaaatcaaattgcagcaaaaatcggttttgggtttaatggtgaatgggatttaccggtaaaagtagaagcggtaaaaactaaactaccgatttcacaactatttagtgataaatatcgccgctcgacattactattatggctttcattctttgccattatgttcagtttctactttattagctcgtggacccctgcattgctcaaagaagcgggaatgacggtggaagatagtatcaacgtggggatggcaatttcgatcggcggtgccggcggttcattaatctacggtttaattgccagccgttggcaggcaagagcagtattaatgctatttaccgtgttatcagcaattgcgattgtggtgtttattctttcatcttcagcgctcggtgtggcgatggcaatgggagttgttgtcggtgcgttagtgaacggttgtatcagtggtttgtacaccatcaatccggcaacttatgatgcggatatccgtaatactggtgtgggctgggcgattggtgcagggcgtgcaggttcgattcttgcaccgacagtggcgggaatgttgctcgacggcggcttggcgaaacaagatttatacatcgctgtagctggtgtaatgttactatcaactgtggcgctagcattcaagaagtcacacgtataaactcattatttaaggtgggaaactcccacctttaggcatttccaagtaggtcgaatttgcaaacttttctgcaaattcgaccgcttgcgtaaggagaaagtatgaaaacacttggcatcttaggtggaatgagcccggaaagtacggtttcttattatctgaatatcaaccgagcagtcaatcaggcattaggcggtaatgccagtgctaagatccttatgtcgagtgtcgattttgctgaaatagtccaatgccaaaaaagtggtgattggcaaaaagcaggtgaaattcttgcgcaacaagctaaattacttgaacaagcaggggcggaaggtattttacttgccactaacacaatgcacaaagtggcctctccgattgttgaagcgatttcagtgccgtttttacatattttggatgcggttgcagatagtataaaagcgaaaggtttaaccactgttgccttgctaggcacagcttttacgatgagtgataatttttatgtggacgggttacgtcaacgtgggatcacgccgttagtccctgatgaacaaactcagcaagaaattcatcgcattatttttgaagaactatgcgtagggcaatttttaccgcagtcgaaagcgttttatcttaaaacaattgaaaagctaacagctctcggtgctcaaggcgttattttaggttgtacggaaatcggtttattaatcaatcaatcggattcagccctaccgttttttgatacagcggaattgcatagtgaaatggctgtggggtttgtgttgagtggatataaacagtcattgtagtaaactagctaggatcattgtttatagctaaaaggaattatatgaattgggatatgaatgtatttaatctttctaatattgccgatattttatctattttaggagcttttttatctctgtttaacttattatttataaaaagaataaaagaaagtcttttattgcgaattaatataaaaagatataaaaaggaacttaaagatagagttcaactcttagcaaattatttaaatgaatatagagataataagaataatataaaagaattgataaatataattgatattaaggcacaacatataaaatcacgtaataaaaatatatctaaacatataaaagaattacatagaatgattaaggaatataatagaaatatgaaaaaaggacatgatgaatcaataattgaagatcaagttagagaaatcaaaacacagcttacaattatagtggaagaattgaatgaacaagaacaatcatataaattaggtgggaattagtatgatgctaagaagtgaaattattttttttatagataagctaataaaaatgactcagcatgggaaattaagttggaataaggttaagcctgttatgagaatgaattccagtgttgagtatgttgatgttgtatatgaagcttatcttgaaaatatgattgtctggatttatcagaaaaattataaatattattatgatgaaattgattttagttgggataaggaaatagtgatagaattaatagatccagagactcatcttgttatgcaagaattgaaagctagtaatgctggagaactattaaatgcgattaattataaatctatacatagcttttattcacgagtattagaaaaataacttatcgattcataaatatctttgatagatctgacttatgttcaatatagtttaaagatatccatcatgagatagatattagcgacaacctagcacttacgtactaggttatatataagtattgccaccctgtggcaaaggacagattacttggttgcagagcaaccatacaatttattagccccatacgttagtgtggggaacagcaagcggtcaattttgcaaaaaattttacaaattcgaccgcttgtaacgaatcaaaaccaacaggagaaaacaatgtcagtaaaaggcgatattggcgttatcggtttagcggtaatgggtcaaaacttaattttaaatatgaacgacaacggttttaaagtggttgcgtataaccgcacgacttcaaaagtggatgagttcttagcaggtgcggcgaaaggcacaaatattatcggtgcttattcgttagaagatttagcggcgaaattagaaaaaccgcgtaaagtgatgttaatggtgcgtgccggtgaagtggtagatcaatttattgaggcacttcttccgcatttagaagaaggcgacatcattattgacggcggtaactcaaattaccctgactcaaaccgtcgtgttaaagatttagcggcgaaaggtattcgttttatcggtaccggtgtttcggggggggaagaaggggcgcgtcacggaccttcaattatgcctggtggtaacattgaagcgtgggaacacgttaaaccgattttacaagcaatttcagcgaaaaccgataaaggcgagccttgctgtgactgggtgggcaaagaaggtgcgggtcatttcgtgaagatggttcacaacggtattgaatacggcgatatgcaattaatttgcgaagcttaccaattcttaaaagacggtttaggtttaagctacgatgagatgcaagcaattttccaagagtggaagaaaaccgaattagatagctacttaatcgacatcactactgatatcttaggctacaaagacgaagacggcacaccgttagttgagaaaatcttagatactgcaggtcaaaaaggtacaggtaaatggaccggtatcaatgcgttagatttcggtattccattaaccttaatcactgaatcggtatttgctcgttgtgtatcttcatttaaagatcaacgtgttgcagcttcgaaattattcaacaaaactattacacctgttgaaggcgataaaaaagtgtggattgaagcggttcgtaaagcattacttgcttcaaaaattatttcttacgcacagggctttatgttaattcgtgaagcatcagaaaatttcggctgggatatcaactacggcgcaaccgcacttttatggcgtgaaggttgtatcatccgtagccgtttcttaggtaacattcgtgatgcgtatgaagcaaatccagacttagtattcttaggttcagatgattacttcaaaggcattttagaaaatgcaatggcagactggcgtaaagtggtagcaaaatcgattgaagtgggtatcccaatgccatgtatggcatctgcgatcacgttcttagacggttatacttcagagcatgtgccagcaaacttactgcaagcacagcgtgactactttggtgcgcacacttatgaacgtaccgacaaaccacgcggtgagttcttccacactaactggacaggccgtggcggtaatactgcttcaacgacttatgatgtgtaagatatctctgaactaattgcttagagaagcttctaaaaagcgggtaatgactgaattacccgctttttttaactcaaattaggatttcactatgaaaaaattactcggtatttctactttggcagtgttattagcagcgtgttcatcaccaaatgagcctactcaggtctctcaagttacagaagcggattcgctcgcaaaagtagaagaagctttaaaagcttgtcaagaatctgtcggtgaaagcaaagatcaaattaaatttgatgcttgtatgaaagaaaaaggatttgaaagaccggcgcagcaggaacaagctgtacagcaagtgcaagagacggcaaaagaaaacgctacggcggtaaaatcagaagctaaaaaagcagttaaaaaagtgaaaagcactaaaaccaaataactaaaatgcctctcgaatgagaggcttatttttgcaaaatacgggagaaatcagaccgcttaatgaggcttaatatcaccgttacgtacgtcaggatttactgcgccagaacgtgtttccgtactgagttctctgcttggttttgtggtgtagtcagctctgtcaaaatcaccggttctccctaacataaagttacgatattcttcgacccacatggcggttgcaccgcagacggcaaccggcatcacgactaaattcacaaaaggtaaagcggtaaaaatactcacaaatgtgccaaaggtgaaatttaaaatcttgcgttgcccaagagcattgcgcatacgtttaaaactgattttatgattatcgaatgggtagtcacaatattgaatggctaataaccaagcgccaaaaacaaaagttaatacaggcacaatagtttgcccgatgaccggtacaaaacttaataaaaacaatgcaataaaacgagggatgctatacatcatcttttgccattcacgttttagcatacgcggtacgtcttttagcatttccgctaccgtcatattgttaagctgttcacccgtcaattgtaattcaactttttccgccagcagcgcattaaacggtgcggcaataaaattggtaatagtagtaaaggtaaagtaaaacagcataattaaagacagcacagcaagcggtactaaaataatggttaaccaatccaaccatgacggcataaagctgacgatccaatccgcccaacctacaatattgccaataaaaaaccatagcagtgcaatcatcagtacactgttaatagcgatgggaattaatacaaatggtaggagcttgcgttgcagcataagcctccagccatagataaagtaatgaaaccctaagcctaaatcgctttgcggttcgttaaatgcagatgacatatagattcgatccttaatttgttcaaaatttggaaagaaatatgttaagctacgcacattattttcgcaaatagtgaaatttaaattttgtagattatcttaagtgaaagaggaccccagatggagcttcatattcttttctttattttagccggcttattaattgccgtgttaatcggtttcagtatttggtctggacgtcgtgagaaatcacgtattttttctaatacattctccactcgtccgccggcaacaccaattaataatgttgtgtcagatgtgccagcatcgcttaatccacaacaatataatgcgcctgcatcaacttctcatattgaagaagtagaaaatccggtacaaatacagcaagaagtagaaagcagcttacgtgaaattaaaattaatttgccggggcaagaagcgaatatgtatcaaaacgaacctgctgcaccgatttatggcacagcgcctattcagcctgtagtgaagcaacaagcagcttatcaacattcggttgagcctgcatttacccaagcgcctcaatcaccgattgctgaagcaacctcagtattagagcaatctgttgaagagttggaacgtcaagcagcattaggtgaaatagatatttattcggatgcatcggtacgtgttgaattagcgaagaattcagttcaagcagaagcggaacaacagcaagagccggcagttgcagaaaataatatgattacactttacgttgtcgcgccggaaggtcagcagttccgtggtgattatgtggtgcaaagccttgaagcattaggcttccaatatggcgaatatcaaattttccaccgccatcaacatatgggtaacagcgcatcaccggttattttcagcgtggcgaatatggtgcaaccgggcgtgtttgatttaactaaaattgagcagttctcaaccgtcggtttagtgttatttatgcacttaccgtcagaaggtaatgatgcggtgaatctcaaattattactcaaaacgacagagaatctcgcacaagcgctcggtggtttcgtgttaaacgaacatcgagaaatttttgatgagaactcacgccaagcctatttagctcgagtgagctaatttgcaaaacttttagtataaatgaccgcttgttaagcggtcttttttatcgagaattttcccaatgcctttattatcacaaatgcaagctcaagcggatacgactttcgcacaattagaagctttacgccaaaaattacgagaatacgaataccactaccatgtattggataatccattagtgccggatgcggaatatgaccgcttaatgaacgaattaaaaaatttggaatggcaacatccggagtggattactgcagattcaccgacccaacgtgtcggagcgaaaccgctggacggctttgcgcaagtgacgcatgaaattccaatgttatcgttagataatgcgttttctgatgaagatctagacggctttttacgccgtatggaaagttatatttcggaaaatccactttcgctttctttctgctgtgagccgaaattagacggtttggcggtcagtattttgtatgtagatggcgtgttaagccaagcggcaacccgtggtgacggtacaaccggcgaggatattacttcaaatattcgtactattcgcaatattccgttaaaactgaatatggataatccgccggcacgcttagaagtgcgtggcgaggtgtttatgccgcaaaaaggcttcgaagaactgaatgaacgagcgttggaaaaaggcgagaaaacctttgctaatccacgtaatgcagcagcgggttcattacgtcagttagatccgaaaattacccgtcagcgtccgcttgtgttaaatgcctatggaatcggtgtgtatgaatcggatgatgaattaccagcaacgcattttgaacgtttgcaatggctgaaatctattggtattccggtcaataacgaaattcgcttggcaacagggcgtgagcagttacttgcgttttatgcggatattcaagcgaagcgtccgacactcggttatgacattgacggtacggtgttaaaggtgaatgacattggcttacaagagcaactcggttttatttctcgttcgccacgttgggcgattgcttataaattcccggcacaagaagaaatgacggtgctaaatgatgtggaatttcaggtgggcagaaccggggcgattaccccagtcgcaaaattagagccggtattcgttgccggtgtgacggtgagtaatgccactttacataacggtgatgaaattgagcgtttaggcattgtcatcggcgatacggtgattattcgccgtgccggtgatgttattccgcaaattgtcggggtggtgatggatcgccgtccggaaaatgcaaaaaaaatcgaatttccgaccgcttgtccggtctgtgaatcggcggtagtgcgtgttgaaggcgaagctgtggcccgctgtaccggcggtttattctgtggcgcacagcgtaaagaagcgttaaagcattttgtttctcgtaaggcaatggatattgatggtgtcggcgagaaattgatcgaacaattaatggaacgtgagttggtgcatacaccggcggatctgtttaaactcgatcacaccactttaatgcgtttggatcgaatgggtgagaaatcagcgcaaaatgcattaaacagcatcgaacaagcgaaaaataccactttggcacgtttcttatttgcattaggcattcgtgatgtcggtgaagccacggcacaaaacttagcgaatcatttccataatttagaggcaattcgtgcggcaactttcgagcaattacaagcggtacaggatgtcggtgaagtggtggcaaatcgtatcgtgcgtttctggcaagagccgcacaatgtcgcagtggttgaagacttaattgcgcagggcgtacattggcaagacgtggttcaggttgaaattgcggataacccgttaaaaggtaaaaatgtggtgttaaccggtacactgactcaattaacccgagatcaggcaaaagcgttgttacaaagttttggctgtaaggtatccggttcggtttcgagtaaaaccgattatttgattgccggtgaaaaagccggttcaaaattagcgaaagcgcaggagttgggagttaaagtcttaactgaacaagagttggttgatttaatgcccgcctaattggtaaaaaatgggaaaatttaaccgcttgtaagctttaattataagaaagccatccgtgataggatggcttttttgtatcggttatagatagcgattattagcggtcggttttgtgcagtttagtacaaaaccattgagtttcacgcctgttctcgcaaaatgctggagtgtcgcttctaactctggacgagtcgtttcgccaaatctgccgactaggatcgcagtgccagcatagcggccgataattgctgcatcacttgcacttaataccggcggcgtatcaataatgactaagtcatagttggtattcgcccaagataacagctgttggaaacgctcgccgagtaaatattcagagagattttccgtgattttaccttttgagatcacatcaaaatgcgcattagccgcagggttgacgacagattcaaagggtaatgattgagttaaggcttcaccaataccatttttattttcggtatcaaacattttgtctaaatagctataacgtgtatcgacatcaatcagtaaaacttttttgcctgatttcgccacgatattggctaggttggttgcgataaaggtattgccggtgtcatatgaagcacttgaaaccattaacaccttatttttcgcctcttgcattgcgaagtgaatatctgctcgcaagcctcgtaacgcttcaattgctgcatctgtcggtacattttccgataataatttcgcattatttatatttaagcgcccttgcttgaacttatcaaatgagaagttcggctgctttttgctattcggtatgctggtataagcggttagccctaattttttcaccatagccggtgattgaattgtacggttaaatagcgctttaattaacgagatgataagccctaatacgaatcctaaaaatccggatagtaatgttgaaaccgctttgcttaatacgcttggattcggtagcacttgagccgcatctaaaatacgagcatttccgaccgcaccggctctaactacatccagctcctgcaatttattagaaagctgcatatagatttgctgatccacttcaagctcacggtttaagctcaccatatctcgttgggttgccggtaaattttccatttccttcgtgattttagctttttcatcacgtaaggtttttttctggtttaacaaggcaacgtaagtcgggtggcgtttagtaaacttctgagcaatctcgccttctttaatggttaaggcgtttaaatccgcatcaatacgtaccaagcggtctaaataagacttagcttctaaatctaagtcgatagagctattgtcttctttatacttattcagactgttttccgcttcgactaatttttctcttacttccggtaagcgattttgcagtagctctaagctcttagaggcttctgccgcatttttatgggcattttgttgcacataactttcggaaacacttttaatgatatttttgatatcacgctggctttcacctcggatcgcaatttcgatcacaccggtttgtttacctttttcattaatgtgtaaacgttgttgcaatctttcaattgccgccagttcagcgatctttttcaaactaaagcgttgtcctgcattgccgtgcaagatagacactttgaatttaagttggtcgttagcgtaagaacgattgaccaagccttctaaaattagtgtttcgccatctttgtgataaaggcgatattcccccttatttgccccgatttcgagaattaattcttctaggttctcattttcaggtataaattcagcaaccaaaatatccggcgtatagcctgcaagattctcaagtcctttactgataaaaggaattgagcgtatcggttttacttctgttgtcagattgagatcttccacggtttttgccagcaccaagcgagatttaatcacctcgatttcagtatttggcgaagactcttgggtaaaaccgtcggacaattcttttaaaatattacccgacttcttttcatcaacctgcacaaccgcattcgcagtataaacaggtgtagaaagaatactgtaacttaagcctaatgcggcacaaacaacggtgcagaataggagcagatacttattatcaagtaatacattgatgaatcgcattaaatcgatctcatcatttttaacgtctttattattcattccattaccttttcgattgaggtttgattaccaattcttaatacgaagcgtaccttcggttaaatcgttaaagccggtaattgtcggtaatacttgggtgatcacacggttccagcgggtaagtggtgctgttgtaacataaacgacatcgtatggtttcaggaagaactcggtacctaaaatataagaagtcgggttggttacgtctaactggtagatatttgccactttttcaatttggttgccgttattatcttcaaccacttgttttgtacctcgttctccacggataacgaaaatacccgttgcatcggcagcgagcttatcaatgccgccgctagcagaaatcgcttcagtaaggctcatgccattacgtccgatttttaataattgcggcgcttgtacctcaccgataacaaatactttttgtgcgtcattacgtggaatatgaataatatcgccgtctgttagcaagcgattttgcgtaagatcgcctttctgtaacagagcttctactgatacgatttcatcttgtccacgatgagtaattgtgacgttattccaatctgcatcggtagaaagtccgccagccttattaatcgcatcaagcagtgttaaaggcacattgctgataaattgttgccccggattttttacttctccggtgacgtaagcttttttagattggaaagaagctaccgtcacttccacttgcggctccataatataagaggcaaggcggctagtgatgcgatctcgaatttggttcacggttaagccgtttactttaattgtgccgacataaggataaaaaattgtaccgttagcatggacttggttaccgctatccgctgccgaacgataagttcctgccggtgtggttagctcagggtgatcccaaacggtaacatttaatacgtcaccgatcccaacgtgatattgataagccttgatttgctgatccaatgcgggattgttctgtgcgctggccttgaaaggtgcgagttctttcaataattgcggggtaatcagataagcatcaaccgctttatcgacatcaagtacttcaccctttacttctacatttttataacgaatcggagaataactactcggaaaaagagagcaactcgccaatgctaaagaagcggtaagaattgagagtttttttactaatctattcataaatacaatactctttgtaaaaaatagtcgaaaacagaccgcttagcgggcaccgaaaccggttaacatggtttggatcgtcttaaagaaaattaatacgtcaagcgcaaaagagaaatgtctaatatagtagaagtcatgttcaattttcacttgcgtttcatcttcggttgcagcatagccgtgcgttacttgcgcccagccggtaatacccggttttacgatatgacgatagctataaaacggaatattttggtcgaattgttccacaaatgctttttgttccggacgagggccgattaatgccatatcacccttaagtacattgaaaaattgcggtaattcatcaatacgtgttttacgaataaatttaccgacccgagtaactcgcatatcaccaacgcttgccaatttcgcaccgtctttctcagagtctttacacatactgcggaatttataaatactaaattcttcacctttctgaccaatacgtttttgaataaatagtaccggtccttcgctttctaatttaatcagaatagcggtaatcagcattaccggtaagacaattgggaagctaagtaaaaccaatactgaatcaataaactgcttggttcttaaataggctactgaaggttgaagtgaaccaaggtcattttcatacatatgagtaattttagtacgtccggtaagtgattcgcggatctggcgcacgttataagtatcaacacctgctagagtttgttttgagataaaacgttcccactcatcggttaattttggtgagtacaggtctgcaacaagtgtttgtatatttgaaacgacttgattcggatcttcaagttttacccaatttacatttgggatttgttcaagatttttggctttacctaacggaatatagtgaatagtcggatttggaccgctatatttcattcggtttgaccaataatctaaaccaatcactaataggatatgccaaacaaaataagcaacagaataagttacttggaataaagtgatgacaactaaactaaagctataggttacgattacgcttggtaataaaatgagattctcatgtttacctgggtaatttgataatttatgtgaaagtaataagtggaatacatagcacactgcaccgataaaaatactgtgcgaaataaaaccttccggtaaatcggcaaatatatttaatatgaatgcaggtagaaaaatggcaattacgccacaaataataaatctcatcttagctctcctctagaatagaaatcagtttgtcgttgactttggcaatatcaaatttttgttcggccattttgcggctctcaatgcccatattgagaatttcctgtttgtttccaatgaaatagcgcatcgcttgcgcaagctcatccaccgaatataccggtaccagtaaaccgtttttatgatcttcaacagtttctcggcatcccggtacatctgttgtaataacagctcgaccgattgccattgcctcttgagtacttcttggcacgccttctcgataggatggcaatacgaatatcgaactgttagcaatcacttccgggacgttatttacataaccaagatattcgataacaccgtgtttgatataatcgtccaatgcatcttttgatattgcaaaagggttaccttcatcaaagccaccaataatagtgaagcgcgtagttggatgttccgctttgattttttttgctgcttcaagatattcaaaaatccctttttcttttaataggcgagcgataaataagaaagacacttcttttgtgatatctacttcttgataaccaaatcgttccagatccactccaatccctcctagaatggcggtagattttgtcgaaatacgataagtatcgattaaatcttttttatcatccggatttaagaaaataagtttatccaagaaggggagagaaattttataaagcaagacttggattgcttgcacaatcttcgcttttcgtgtttttccttctttataaggcgtaaacgcattacctaagccttcaatcataccgatcactttaggtacttgagcaagttttgcagctaaagaaccaaaaataaccggtttgataaaggtgctgaagacgatatcaggttgaagctgttttaattctttcataagcagataaaccgcttttaaatctttaacagggttcatgccttttggattaataaaatgcgctttaggaattgctccccaaccgctgacttctttttgttccttctccgtatagccataggcataacagtaaactgtatagcctctactcactaattcaatgactaattctttacggaaattagtaatcatggaggcaacattgccgataagtacgatctttttcataataagctacataaatagaacatttctgtaatcgaaacagcacaaagcataaggcgaataatttatccaaatgaaaaacagcattgtattttcaataattagagcaattaaaaataatgcttttaattcaaaggattttaaatattcaaaaaattttccgaagacagcgatgtcgaaaataacaaaataaagattaaaacggtcagcaatggttgaataaacaaagctaacgggtaagaatattagaattaaaatacacattaaatctaataaacgataggtattcgggtagctttccacaaaaatatgccgttgccataaataaacgacaataggtaataagtggagtgctatcctaaataccgcacctgctgaggataattcaccagaggtatatgcactttctccttgtgaaatcatataaatgatataaaacgagaaaagaatgacgaataaagaatataaataaaatattttattcttataaaattccgagttaattaatggtaaaaatgcgaggaaaataattgcagatttatgaaataaataggcaagggcaatccacacgaaaaatttccatttcttcgggtttggtgcaaataaggttgaaaatgcataacatactagacctattgcggcagattgacgggtataccccatacctacggcaataatggtataagaaaatgcaatcagaaatgctaggaacagatgtttgaattggcgtgataattgataaaatcctattatcaaacagaacgcacaaacaaagttaacaaatgaaatcgaataatttaattgatgggctaaccagttaaaaaatccatatccatattctgatgaaccggcgactttaaaaaaattgtctgctttatataagtcaaagatatataggtaactaaaccagtctccaccgacctcaaaacgaccgccaataaaaataaagataaatgcggagaaaattaataagaaaatttctccacctttatttttaggaaggtttatgaggttcatgacaacaatagttgcccaaatataccaataaataaacataaatacttattatttgctttctaaaatgttggtcaaaaattctgtaaaatgacaattgtctagaattgcttcccaagaatacatagacatatctatgcgatgatatttatcgagtgataaatcacattgcttagcatttatgttttcaagccaaattggttcgtagccaatttttttacaaaattcttcaacccagtaataacgatttgaaatcaagcgtaatcctgacgctaaatattccaatgtctttgtgctagtttgaatattaaacggatacacatcaggtgtgtaatttaatccaaaacgtgcattagcataaatttgcggcaagtcagttcggttgactttaccggtcatattgatacctgaggcttttaaaatcgcataggtttcattatcaacttcaccaaccactaccactttgtagtatttggcaagatttaccagactttgtattaagcctattcttccaataattgatccagcgtaaaccacatcatattcgggatgcggattcggactctgaaataaggcggaatcaatccccatatcccgatatatgtaaggaaggctatcgcagaaaccgaactctttttttacaatttcattaagaaatatgcgcccttggggctttgtattagcacattttttaatgaaattttttatgctggaatatttaggcatagaaaggctttgatattcatgcacttctaatgccgattgtggcgcatatcgtttccaaaaagggcgcattcccaagaaatagatattaatatcattatcgggagctaagttttcttcgtaatctaactgaactaaatgattgcgtttagttaaatattctttataagcgaaggcctctggggtataggcctgcctttttaacgtaatgccgattttcaattgttattaccacctaaataatgccaagcttaatattttctcttcgataataattccacactaaggctttaatcatattaacgcctagtgcagtggaaattgctgctccgataatgccgtatagatgagctaagaatacgcataagagagcgctaatacagaaaacaatggcttgatatttcaataatatctttttattttccgtatagctggcgagtgtcattccaaacccccatatttgagaaagtgatattcccagcattaaaatcagtaatgaaacatatccttcgtatgtattttcaacaccgtaaagataaaacaagaaatcaccaattaccgcacttactgcgacaattgagaaactaaataagcataagaaaatcgtgtattttttagtgtagctataaagtttcgtatattcctgttgtttatataaattgacgatatttggtgttactaccgccattaccgaggcggaaaagtaagaaattaatgccataaaactgtaacaaatgacatagatccccacggctttatcatcaacaaagtaagacaaaatgatacggtcaaattgtgcattcagtagcacgaaaagtgccgataatgtaggaattgcaccgtattgcaacaaatctttatagtgataagcggtcgatttcgcgtcattttttacatattttttcgttaagcacgcagcaaataaaaagagtgcgaaagtggcataaaaatataaccagaagaaatctacgtcttctataaaatagctaaataccaagataaaaattagtggtaacaaataacgtaacccgtcatcaatcgaagtattgagatactgcatctggtttacgataaaaatcgaggatttacagtagaaaaaagagtagaacagcactacaaatcctatataccaaagcccgaattcaaactgaaacagccaaacggaaaagacggtaatcaagcatgaagttaatgtccaaaaaccgaggaatttcgggctaatggttcgttggttaaactcaataatgtgaacataattcccccagttggcaattaatgaaaggatcaaaatataggtggttactaacccatattgacctaacacatccaccccgaaatatcgggaaattgccatacctagcagtaatgatgatcccgcaccaatcgcttttagtaaaaggaggaaaaatacttttttcattcttattcaataaatgtcacgttattagagtgggacatactttgttcatatacgcccttgcatttatagtatccattgttataaatgcttaattttttatttagcagataagcaccgactgctacatgtaatctatcggttttaacttcttcgtataaatcaatgagttttaaaaattgtttagcgctatagagtgaagcttgataattgtcagttccaaaactagcaacaagtgataagtcattagccaagcttctttttacatttaaattttggttgctctctttatcggtgcgcatagcattaatttgagaggtaaatagtgcacgtaagcggtggaaattgatcaatattttacgaataatatttttactcgttaatttaattttaaaatgagggttgcttgtcaaaatttgcattggatttatacaaaatgccatatcgtcagccagataaacggctttagcattagatatattttgacaatattcaaaactatatttttctcgacaaaagataatgctatcttccggtaaatttgaaattaattcatcaatgccacgaatagaatgcggtaaaataattaattttaactttaggtttaagttgattaatgcttttaaaaaatttggagttgaattccattcaggaactaaacaaccaccaccgccaattaatacaatgtcgttatcttttaattgactgattttgtcctgagagattaaagaaaacttcaggttaaattgttgtgctaaagtataaaagcccatatctatcaacgcatcacctgcattccctccattaggatagtaaaaaatgtttccttgttgagattcagataatgctttaaaaatagtatgtaaattagacataaagacccctgtaatatttattaattagtagatttactcgctagttgtattaaaaactacaaatgtatttttttatcttctgttgagtattcttttggtgtaaaagccattatttataggctgtttatctaaattggggtaaatgttattcgtctgttttagcgaaatatacaaatatactgctgagttttatggcggcagtaattttttaaaatttgttaacttgtgtaatgcattgtagtgaataaatatagttaaatttattatagagtaatatttatatgctaatcaatagcagtagaggtccaatatgtcatataaaatacaaaaataaatagtggtcttatatgttgttaatatggaacttttttaaaatttcataatacaaaatattatttttttaaataacaagtgaaaagccggacgtaaacctatgtgaagcttgttcactgttatcttaaaacgagtataatagagaactatcgatacttaactgagggggctatatggctattttagtgactggtggtgcgggttatatcggttcgcatacgctcgttgaattattaaatgcaaatcgtgaaattgtcgtgttagataatttatctaattccagcgaagtttctttggaacgtgtaaaacagatcacaggaaaaacggtaactttttatcaaggcgatattttagaccgtgatattttgcgtaaaattttttcagaaaataaaattgaatctgttatccactttgcaggtttaaaagcggtaggtgaaagtgtgcgtgagccactacgttactatcaaaataatgtaacgggttctatcgttttagtcgaagaaatgttagcggcaggtgtgaatacaattgtattcagttcatctgcaacagtttacggtgatccgcaaattattccgattgtagaatcttgtccggttggtggtacgacaaatccatacggtacatcaaaatatatggttgagcgagtattggaagatacagtaaaagcgttcccacaattaagtgcggtagtgttacgttatttcaatccggtaggggcgcatgaaagtggtttaatcggtgaagatccgaacggtatcccaaataacttattgccttatattagccaagttgcagtcggtaaattaaaagaactttcagtattcggtagcgattatgaaacacacgatggcactggtgtacgtgactatatccacgtggtagacctagcattaggacatttaaaagcgttggataaacaccaaggcgatgccggtttccatgtttataatttaggtacaggaacgggttattctgtgctggatatggtaaaagcgtttgaaacggcaaacgacatcaaagtaccttataaattagttgatcgccgtccaggggatattgcggtttgctattctgaaccgtctaaagcgttaaaagaattaggttggaaaaccgaacgtggtttagagcaaatgatgaaagatacttggaattggcaaaaaaataacccgaatggttataaaggctaattatttttaggaatatgaaggcacaagcgtttacgtttgtgccttttttatctttgaagttttctgctatgatgcctgataattaagctaacacaagttggcgaattctcatctatttgtaaaagaaaaggaaaaaatgaccgcttctcattcagcccctcagacctcaatttggcgacaaatttttactaaaaatatgttgctttgtatttataccggtttttgttccggcttacctttatttgtgcttatccaattaatgccggcttggtttacctcagcaaatcttgatattaaaaccatcgccgcctttactttaacctcattgccctatacatggaaattcttgtgggcagcattattggatcgctattttccaccgtttttaggccgccgccgcagttggatttttctttctcaattaggcttattggcaattctagccagttttggcttttttgatccggtagcggatatcggtattattaccgtgctttcagtaattttagcctttctgtctgctacacaagatattgtggtagatgcttatcgccgagaaatcttatcggacaatgaattgggcttaggcaattccattcatgtgaacgcttatcgtatcgccggtctaataccgggcggtttatcgcttttcttggcggatcattatccatggcaaacggtatttcttattaccgccgcctttatgttaccttgcctattggtaacgctctttgcagatgagccgcaaagtaaaccgattgaccgtagtaaaccgttttatacggcgtttgttgatccgtttaaggagtttttcagccgtaaaggtgtatggggtgcagtaggacttatcctatttattttcttatataagctcggtgattcgctagcgacttcattacaaaccaaatttattttagatatgggctttaccaaatcgcatattgcggcggtggtaaaaacaacttcgctttggtgtagtatcggtggtgggattatcggcggaatagcaatgctcaagctgggagtaaatcgtgcgttatggattttcggaacggtacagttaattaccattttgggttttgcctatcttgcaagttttgagtattttccgaccgcttctatcggttcagccgaattatttaaattaggtattgtaatggcgggtgagtatcttggtgtcgggttaggtacagcagcctttgtcgcttttatggcacgagaaaccaatccgatgtataccgcaatgcaattagcgatttttactagcctcgccgcactgccaagtaaatttttaggcgcttataccggacatttggtcgaagccttcggctattatcagtttttctggatttgtttctttgttgccattccgggaatgttgatgttgattaaagttgcaccgtggaaagcacctgaatcgtaaataattatataaatttaaccgcttgtaatgtgcttacataaaattagccccctaattgttaggtattttatccaacttttagggggctaattatttatttacaactttcttataactaagtttagaaagtatagtttacgtttagacggaaatcacgtccaacagccggtaaagttgtaccacgttggctgtgtggataatagaatttattgaatgcattatttaatgccaaattcacatttaagctatcgtttttcaatggtttccagttaacgtagaaatcatggttgatatagctatcacgatgtgtatttgcgatagtttcgtctgcattcgctagtgcatagccatcttcatcttctacataacgacctttccaacctagttctaaattagggttttcaaagcgataagctaaacctgcagtccaagtacgacctacttgtacggcaaattctggatttaaagtagaattaacttttgtatcatttaagtagaatcttggtttgctttctgatacaccgaagcgagcggttaagccttcatagcgataagcagcatttaactcataaccgtggtttttagagtaaccgtcatttactgcttgtgtaataccgttaatgatattgccatttgcatcatgtcttgcttgagggttaacaattaagttatttactttttgccagaagtagctaccttcaaaagtaaagtcgccattattatagttgaaaccgatttcagtattacgcgcacgctctgcttcgatatttggatctactgatacacgtcttaagccaaccattaatgcatcgtataaacgagggctacgtgatgcatagttatggtttgcactcagacttaattcaggtgttgcttgataaattaaaccgacacttggattccatttaccatcagacgctttcacaccgtcattcgctttcatatcgaaataatcgtaacgtaaaccggttgtaaaggtgaaatcgttgataccactaatcatctcaacgtaagcgccagtatcggttttttccggattattagttacaaatgggcgtttagtatgcggttcaatttcctgattacggtaatttataccgtatttaactaagatgtcttcaccaatgaatgaatcaaagtttacattcgcaccttgagttttaattacagttgttgtagggcctttaacgctaccgcaatatccacaaccgctatcatcagcagaatagcgtttattcttcattaaatacgcatttgcagttaattcattaataaaacctaagtttttaccgatatattcaagattggtattgcttaaggttgtttctcgataagatggtgattggcgagcaacactaagacgaggattattggctgcactaaatgtagcgaactcttctcgtactaaacgctcaccacgatgttgatcttgtaaatgacttaatacaaaacgatgatcaccaaaagttgcacccaatttagcaatataattacgtttatctaatccgctgtaaggaactttattgctaccatctaagccgtttacgaagtttctacctgctttgtaattatcttcgtcattgcggttgaaagaaagtaatgcatcaaagttacctgctttaccaaaaactgttgcaccataagagtggccatcattgctagagtaaccgctatttaatttaaatccgtaatcacgctcactatttttcaagagatctaaagcatcaaccgtttttacgataatcgcaccgtttgtggcaccaataccagcacttgctgaaccagcacctttttgtaccgaaacactttttaagagtgatggatcaataataaaacgtccttggtgatataaaatttggctatcagatgatgcgccatccactttaatatctaccgagttttgccccataccacgaatggttaagaattgagatgtaccattacctccggcaaattcaattgaaggttcttttgaaagtaaacctcgtaaatctgtttcagtacgttcatttttttcagctagtgtcacaatattggtttgcactttagcaccttgacgatcggttacaacaatttcagataactccatcgtttcttttgattgttctggatttgcataagcaaatgaactgatagcggctaatactgcaatagtgagttgatttcttttcacaatagatccttatgaatatagagtacaatttaagataacgggaattattatcaataagaattgtattgtcaatgggaaatatagctttacggtaaatttaaatttatttgagcttcaactttttacaagcggccaaatttagtaaaaaatttgcaatttaaggcagtaatcggtaaggttactgccttagcttttttattcattcatcttttattttcaagaggctttacaatgaaaattatcctattaggtgcgccgggtgcaggtaaaggtacacaagcacaatttattatgaacaaatttggtattccgcaaatttcaacaggcgatatgttccgtgcggcaattaaagaaggtacagagcttggtaaacaagcaaaagcgttaatggatgaaggtaaattagtaccggatgaattaaccgttgcattagtaaaagatcgtatcgcgcaaccggattgcgcaaatggcttcttgttagatggtttcccacgtacgcttccgcaagcggatgcattaaaagattcaggcgttaaaattgacttagtattagagtttgatgtagcggatgaagtgattgttgagcgtatgagcggtcgtcgtgtacaccaaccgtcaggccgtacttatcacgtagtttataatccaccgaaagttgaaggtaaagatgatgtaaccggcgaagatttaattattcgtcaagatgataagcctgaaacagtattagaacgtttagctatttatcacaaacaaactaaaccattaattgcttactatacagcagaagctgaagcgggtaatacacgttatgagcgtttagacggcacaaaaccggttgaagaagtaagcgctgaattagcaaaaattttaggttaattataatctataaatataagcggtcatttttaatgaaaactttgcaagatttcattaaaagatggccgcttgtttatttttattactcagaatgataacgagaaataatgtgttttgcgccaccgttgccaacacaagcttcatttaccggtgaagttgaataacttccatctacacagattgcggtgacatttgcgggtaaggcttgttgagtggaatgtggattgcgagccggagtatattccgttttagtagaaggttctttaacgatttgaaccggttgatttgaactacaagccgtaatcgttacagcaagagccattaaagaaaataaatgcgctttcatacataaatccttgtatattatagacggcaattaatacttattgccgtgcttgagtttataaaaaagggttgaattgctcaacccttttataaacatcaagttatgaatttacaaaatttttccctaattcaatatccgctttaagaatcggtttaatttcgtttaattttgtttgttcatattcacttaatttaccgattggcagaatttcttctacacctgttaaaccgaatcttactgggtgcgcaaagaattccggataatctgaaccttctttactttctacataagcataacgtacgcagtcttcacctaataatgctttgaatactgctaccgcaaaacgtgcgcctgattctgccattgaaagtgttgcggaaccaccgccagcttttgcttccactacttccgtaccggcattttggatacgataagttaatgactcaatctcttcttggctaaatgaaaccggaagtccttccgcaagtgcctgagaaagtaacggcagaatagttggaccagagtgaccgccgataacaggtactttaaccgtttcgacatttttatcttttaattcggacgtaaatgtttttgcacgaacaacgtcaagtgttgttacaccgaataatttacgtttgtcatatacgccagctttacgtaatacttcagcagcaattggaacaagtgtgtttactgggtttgtaacaataccgatacaagcattcgggcaaacctcagcgactttttcaaccaagtttttaataatgcccgcattaatattaaagagatccgcacgagtcatacccggtttacgtgcaacacccgcagttaataggacaagattagcgtctttaagtgcttcactcggatcttcacctgaatagccgacagcatttaccgatgttggaatgtgactgatatctaccgcaatacctggagtgaccggcgaaatgtcatataacgcaagatccgttccggcaggtaaacgaagttttagtaagagagcaagagtttgcccgatcccacctgcagcgcctaaaagtgcaactttcataaacaactcctaatcaataatggttataaaataaaactaggctaagtttaacaaacatttgttaagattgatgctaaataaaacgaatctctgggaaaaatttttctaatgtttgatttagattgattttttggtacttgtaagcaaaaattatgcttctaatcgaagcaatattgcataagggagatgagatggaaaagcttgataatttatcagaagcatttaaagcgttgctaaaacaagaaaaattcggttctcaaggcgagattgtgaatgcattgcaagaattaggctttgaaaatattaatcagtctaaagtatcacgtatgctttctaaattcggtgcggtaagaacacgtaataccaagatggaaatggtctatcaattacctgccgaattaggtgtgccgacaacctccagccctttaaagaatttagtcgttgatattgattataatgatgtgctaattgtcgtaaaaactagtccgggcgcagcacaattaattgctcgtttattggattcaatgggaaaaagcgaaggcattttaggcacgattgccggtgatgatacgatttttattactccaacacgctcaacagccatggaagatctaatccaaaatattactgagttatttgagtcatcgctctaatgaaaattttaattaccggcggaacgggttttatcggacagcgtttagtcgaggcgttattagcgcaaggacattcattaacactggttacccgccaatcgaatccaaaggttacttttacgcaagcggtcgaattttgtcaaaatcttgcaagttttacgaatttgaacggatttgatgctgtcattaatttggctggagagccgatttttgagcgagcgtggacttcggcacaaaaacagcggttatcggagagccgcctacaaatcacgtcattattagtaaaactgattcaggcaagtcaaactcccccacatacttttatttcaggttcagcaaccggttattacggcaatgttcgttctgactccttaatggatgaatctgcagcttgtggtacgaattttagtgcagagctttgtcgacaatgggaagcggtagcattacaggcggagagtccaagaacacgagtatgtttaattagaacgggaatggtgcttgctccacagggtggcgcattactaaaaatgttgccgttatatcggttaaatttagccggtaagcttggctttgggcagcaacattgggcgtggattgctttggaagatcacatacaagcggtcttatttttattgaaaaatgcaaattgcagaggtccatttaacctcgttgcacctcatccggttacgaatgcagaatttaacgctcgtttagctgcttatttgaaacgttgtgcgtggtttgccgtgccagcgtttatacttaaattgattttaggcgagcgttcgcaattattattggataatcaaccgcttgttcccacaaaattattggcaaatggctttagattccgacagtccgatttagattttaaacagatctttgagcaataaaaaatcccaccgactggtgggatttttttatgccttattactgaaggattaagtagaagtttgaattaccgcgtagaatatttaatgcgataacagaaggcttcgaatctaacacttcacgtaattgcttgatattgtctactttgacacggtttacaccaacgataatatcgccttccgctagacctcggttttcagcaatcgaacctttagttacttttgcaatttcgataccttttacaccgtctttatcaaggttagcaaattcagcaccttttaacgccggaataatatcttttgtggttgctttggttgtatttttactgtttttcgctgtgctgtcagcgctgtccgattgaagcgttactttcgctttttcttctttaccgtcacgtaagtacgttagctcaatttctgtacctggacctgaggtggcaactttggcacgtaattcgctgaaactattgatttttttaccgtttaactcagtaattacatcgcctgcttttaaaccggctttcgcagcagcagaatcagctaaaacttcactaatgaatgcgcctttttgtgcatcaattttgaattcttttgctaaatcagcgtttaattcaccgcctttaatacctagcataccacgtttaacttcaccaaattcaatgatttgttgcacgaggctgtttgccatattactcggaatcgcaaaagcaataccggcattaccaccgcttggcgaaataatcgcagtattaataccgattaactcaccatttaaattaattaacggaccacccgagttaccttggtttactgctgcatccgtttgaatatagctttcgtaaccttcgtctgaattaccggttgaacgccctaacgctgaaataatacctgaagttacggtttgacctaaaccgaatgggttaccgatagctacactgaaatcaccgacacgtaacttatcagagtcagcaaattttaattcaactaaatttttaggattttcaatttgtactaaagccacatccgatagtggatctgagcctaataatttcgctttaaattctcgaccgtcttctaatttaatcgtaattttgtccgcatttttaatcacgtggttattcgtaattacataacccttttcggcattgatgattgcgcctgaaccttgcccacggaaattacgcggtgcactacgttcaccaaacatatcagggccaaagaaaaattcaaattcttccggaatatcacgacgataacgggctctttcttccgtttttccttctactgaaatactaactaccgccggacgaactttttcaatcatagaagctaaacttggtagaggctgaccttcaacggctgtcggtaatgtcgcttgtgccgttactggaactgaaaataaaccgagacctaatactagtgaagctaagatcgattttttcattactttattcatttatatttatccttttttgtgtcaaaaaattcaacgagcttcaaaggtagctcgtgtccattcagaccacctaatttggtggtggttccttcaaaaagcaagtgtctagctaaaaaataatcaattacttatgcaaaagtttattaaaaatggttattaaattgtacattttctgtcaaaagttaaaaatcctttgactttatgtggcggttaatagagtattgccaaccattttatgttttatataaattactaaagaaaattccaatgcgagataatgaatacttagttgaagtgaaaaacctcacctttagtcggggtgaaagggtgatttatgacaacttaaatctgcgggtgcagaaaggtaaagttaccgcgattatggggccgtcaggaattggtaaaacgactttactccgcttaatcggcgggcagattattcctgaaaaagggcagatattatttgatggcgaagatgtatgtaaagcgtccaataaaaagctttatgaaattcgtcagcgtatgggtatgttatttcaatcaggggcattatttactgatttatctaccttcgataatgttgccttccctattcgtgaacatacaagattaccggaagcattaattagaaaattagtgctaatgaagttagaatcggtcgggttacgcggtgcagcgcaattaatgccggcggaactttcgggcggaatggcgcggcgagcagcgttagcgcgagcaatagcgctggatcctgaattaattatgtatgatgaaccgttcaccggacaagatccgattagtatgggcgtaattgtcgagttaatcagaaaactcaaccaagcattaaatttaacgtcaattgtggtttcacatgatgtaacggaagtgctgagtattgctgattatgcttatattgtagcggataagcgcgtgattgctgaaggtacgccggaagcattgatggcaagtcaagatccgcaagtggttcagttcttagcaggtaaagcggacggtccggttcgtttccattatccggctaaagaatatacggaggagctattcagtgattaattttattagtggcatcggttcttctgtgattagttttatacgagcgtttgggcgagcaacctttatgttgtttggcgcattgatcggcaaaccgcaatttcgtaagcatacaccattattaattaagcaattatatgtgttaggggttcagtctctactcattattatgctgtcaggcttatttatcggtatggtattaggcttgcaaggttatgtggtattagtcgattttgcagccgaaaccagtttaggtacgcttgtttcattatcgttactaagagaattagggcctgtagtaacagcacttctttttgctgggcgtgcaggttcagcgttaactgcagaaatcggtttaatgaaagcaacggaacagctatcaagccttgaaatgatggctgttgatccgctaagacgaattattgcaccacgtttttgggctggtgtgatttctatgcctattttagcggcaatttttaccgcaatcggcatctggggcggttcgctagttggtgtcgattggaaaggtgttgatggtggtagcttttggtcggtaatgcaaaactcggtagattggagcgatttaattaacggctttattaaaagtattatttttgcttttgccgtagtatggattgcattatttaacggttatgactctgttgcaacttcagaaggtattagccaagcaacaacaagaaccgtggtacacgcttcattagttgtgctaggacttgattttattttgaccgctatcatgttcggtggttaattcacaaaggaaaagacaatgcgtcaatcaattaaatatgaattttgggtgggcttatttgtattacttggcttagcggctttagtatttttaggcttgcgtgttgcgaatgtacaaggttttacctcagagaagacttacactctttacgcaacttttgataacatcgggggactaaaagtccgtgcgccgattaaggtcggaggcgtagttgtaggacgtgttgctgaaattaatttagatgcacaaacctatacgcctaaagtcactttagcagtgaatgaagattttaataaaattcctgatactagctcgctttcaattaaaacatctggtcttctaggtgaacaatatatcgctttaaatatcggtttcatgttagaaggtgaaacggagtatatgaaagaaggcagtagctttgctgatacaaattcagcaatggtgttggaagatttaatcggtcagttcttatatggcgataaaaaatcagataaaactgacggagaaaaagcggaaggcgaaacagagcctaaagcacaataattacacagtgattttcactgagtgatattttatttcgggtgggaagaccaccttacatttggagattttaaatgttaaaaaacatcaaaaaagtaatcgtaactggttttgtagcagtcgcaacattattctcagcacaagcatttgctgaaacaagcccatacgttttaatgcaacaaacagcagataaactctttaacgatattaaggcgaatcaaagtaaaattaaggcgaatccggaatatttacgtaccattgttcgcaatgatttaatgcctcgtgtgcatgtgaaatatgcaggccaattagtgttaggtaaatcgctttcttctgcgtcagaagcacaacgtgagcaattctttactgctttcggtcaatttattgaacaatcatacgcacaagtgttaacgcaataccaagaccaacaagtgcaaattgaaagcgagaaaccggtaggtgacaaatctatcgtaagcattcgtgtaaatgtgttatcatcaggcaacgctgcgccaatcaaattagattttaaatggcgtaaaaacagcaaaactggtgaatggcaagcatatgatatggctgcggaaggtgtaagtatggttgcgaccaaacaaaatgagtggagcggcgtcttacgtcaaaaagggattgatgctttaactgcacaagttgcgcaatccgctaaacaaccgattacattaagtaaataattttagttttatgaagccacaaaaaacattacaatggggcgttcagcagaataatgaaagcctatttgtaaaattgtcaggcgaattaactcgagacacgttgcttccgctttggaagcaacgtgcttcttttttatcgccgaaaggtaaccaacatatctattgggatttaaaagatcttgagcgtgttgattccgccggttttacattgcttgctgaattgctcaatcattatcagaaacagacgccgaactggttaatcaatagtcctgaaacagtgaaaacactagcggaattatttgatttatcagaatggctaaatcgatttatagtttgcgataaaagcaaattatgttgtgaaaacgcttaaggaattataagcacatggaaccaaaacaactcgaagaaattttaagaaatgcgttaccgacagcagcggagattcatgcgcagggtgagaattcacattatggcgtaatcgttgtcagtgatgaattagcacaattatcaaaagtaaaacaacaacaagcggtatatgcaccattaggtgaatattttgcaacaaatgctatccacgcattgacgattaaagttttctcgacagagcagtggaaaaaagatcgcttacttaatatggtaagctagcctattcgatgaatagtggataatgatagctaagcggtcgattttgtaaaaaaatttgcaaaaatgaccgcttgagttttgtacatgatccattattatcagttatttatttctaaggattttataatggaaaaatttcgtgttcacggtccttttacattaagtgggacggttgatatttcaggtgctaaaaatgccgcacttccaattttgtttgcagccattttggctaccgaacctgttactttaacgaatgtgccagatcttaaggatgtggacacgacttttaaaatcttacgtaaattaggcgtggtagttgagcgtgatgagaccggagcggtacaaattgatgcaagtcatattgatcactacgttgcgccttatgaattagtaaaaaccatgcgtgcttcaatttgggcgttagcgccacttgtagcacgtttccacgaaggtcaagtctcattaccgggcggttgtacgattggcgcgcgtccagttgacatgcatatttcgggcttagaaaaaatgggtgcggtaattgagctggatgaaggctatgtgaaagcaacgtcaaacggccgcttacaaggcgcacgcatttatatggataaagtgagtgttggtgcaactttatcagtgatgatggcgggtactttagcggaaggcacaacagtgattgaaaatgcggctcgtgagcctgaaattgttgatacagcattattcttaaatgccatgggtgcaaaaatttcaggtgcaggtacggatactattacggttgaaggcgtagaacgtttaaccggctgccaacatcgtgtggttgccgaccgtattgaaaccggtacattcttagtcgcagctgcggtttcaggcggtaaaattacttgtcgaggaactaaggcggatacattagacgctgtaattgaaaaattacgtgaagctggtatggaagttactgtaaccgaagatacgattaccttagattcaaaaggtcagcgtccgaaagcggtaaatattcgtaccatgccgcacccggggttcccaactgatatgcaagcgcaatttactctgttgaatgttgtggcggaaggtacaagccgtattactgaaacgatttttgaaaatcgctttatgcatattcccgaattaaaccgtatgggagctaaaggtgaaatcgaaggtaatactgcaatttgtcacggtgtagaaaaattaaaatcagcagaagtgatggcgacagacttacgagcgtcaattagcttagtattagcaggttgtattgcttcaggtgaaactattgttgatcgtatttatcatatcgaccgtggttatgagcatattgaagagaaattacgtggaattggtgcgaaaatcgaacgtttttctgagccgttcactggcgaataatttgagataaatttaaaagggctgttttagagtatgaatactttaagcagccctttttgattaatattacttattggctagcttttttcatcattttctttttatgtttttttgacatcattttgtcatctttcatcatatcttcatccgacatcattttgtcgtctttcatcatatgtttgtcagacatcattttgtcgtctttcatcatgtgtttatcagacatcattttgtcgtctttcatcatgtgtttatcagacatcattttgtcgtctttcatcatgtgtttgtcagacatcattttgtcatctttcatcatatgatgagaatctttcatttcatttgcatgtgcgttaaccataagcgctaagcccatcataatagctgaaagtgaagcaagttttttcattaaagtctccttttataaattataagaataataagttgtgcataaaataagttgcgcaaattggacgcaataaaagggagcttcttacaaaatatttcctattaaatggccttccttgcttgtaaaaagacaaaagaccgcaatacaagcggtcttttgtgcagtttttttgcaattattttatacctttatgcaataaatcttggtagcctccgtggtttgttacttggcgataacccagcttctgtaattcagttaatgcgatatcagcacgacgccctgaacggcaatataagtgaatcggtgcatctttatcttctgtcagttgatggattttggcaccaatttgttcaaccgggatattgattgcgccttcaatatgtcctgcggcaaattcttctgcagtacgtacgtcaatccagacgccttgtgctttttctactgtgacagattggtttacaacttgctgattactttcatttgcagacgttgtcatgggaaagcttaataaaagtgctgtgataagaggaaaggttttctttagcatagtgatatctccataggtttaattatagtctttagcgtatatttggcgaaatatcttacaacaagcggtcggattttatgaaaaatttgcaaatgtaggaatccctatatttcgcccctgttttcaagtaaaatagataagattttttctatgaggaatacataatgtcaactcaatttgtatatacgatgcatcgtgtcggcaaagttgtgccgccgaagcgtcatattcttaaagatatttctttaagctttttcccgggcgcaaaaatcggggtacttggtttaaacggtgcgggtaaatcaacgctattacgtattatggcgggcgtggataaagagtttgaaggtgaagctcgtccgcaaccgggtattaaaatcggttatttaccgcaagaaccaaaattagatccgcaacaaactgtgcgtgaagcaattgaagaagcggtttcggaagtaaaaaatgcgttaactcgtttagatgaagtttatgcgttatatgccgatccggatgcggatttcgataaattagcggcagagcaagctaacttagaagcgattattcaagcacatgacggtcacaatcttgataaccaattagaacgtgcggcggatgcgttacgcttaccggaatgggatgcgaaaatcgaacatttatcgggtggtgaacgccgtcgtgtggcgctttgccgtttattactcgaaaaaccggatatgttattgttagacgaaccgaccaaccacttggatgcggaatcggtagcgtggttagaacgcttcttacatgactatgaaggtacagtagtagcgattacccacgaccgttacttcttagataacgtagcaggctggatcttagagcttgaccgtggtgaaggtattccttgggaaggcaactattcttcttggttagagcaaaaagagaaacgtttagaacaagaagcggcagctgaatctgcacgtcaaaaatcgattgcgaaagagttggaatgggtacgtcaaaaccctaaaggtcgccaagcgaaaagtaaagcacgtatggcacgttttgatgagcttaattcgggcgaatatcaaaaacgtaacgaaaccaacgaactctttattccacctggtccacgtttaggtgataaagttatcgaagtgagtaacttaaccaaatcttacggcgaccgcacgttgattgatgatttgtcattctcgattccaaaaggtgcgatcgtagggattatcggtgccaacggcgcgggtaaatcgaccttattccgtatgctttcaggtcaagaacagcctgattcaggctcaatcgtaatgggtgaaaccgttacattagcttcggtagatcagttccgtgattcgatggacgataagaaaaccgtatgggaagaagtatcgaacggtcaagatattctgactatcggtaactttgaaattccaagccgtgcttacgccggtcgtttcaactttaaaggtgtagatcagcaaaaacgcgtgggtgagttatccggtggtgaacgcggtcgtttacacttggcgaaacttctgcaacgtggcggtaacgtattgttattagacgaaccgaccaatgacttggacgttgaaactttacgtgcgttagaaaatgcgatcttagaattcccgggctgtgcaatggttatctcgcatgaccgttggttcttagaccgtatcgcaacccatattttagattacggcgatgaaggtaaagtgaccttctacgaaggtaacttctctgattacgaagagtggaagaagaaaactttaggtgatgcggcaacgcaacctcaccgtatcaaatataaacgtattgcgaagtaatacttgaataagcggtcggattttggtgaaaatttgcaaattttctttgaaatccgaccgcttgcatcttttgattaggcaataaaatgagtgaacaaccgatagtaagacaggtggtgctggataccgaaacaaccggtatgagttttagcggaccaccacaaattggacataatattattgaaatcggtgcggttgaagtgattaaccgtcgcttaaccggccgtacttttcacgtctatattaaaccgccacgagaagtagaagaagaggcgattaaagttcacggcattaccaatgagtttttgcaagataagcctgtgtttgccgaagttgcggacgaatttattgaatttattaaaggtgcagagctaatcattcataatgcccccttcgacgtggcatttatggatcaagagttttcttatttggaaaacccaccgccgaagacggctgaaatgtgcagtgtgaccgatagtcttgcggttgctcgaaaaatgtatccgggcaagcgtaataacttagatgcattgtgcgatcgtttaggcattgataacagtaaacgtgtgcttcacggggcgttactggatgcggagattctggctgatgtattcctgataatgacaggcgggcagctggcgttattaggtgaagaggatgccagtgcgaatcatgaaaatattacagatctcggtttaggtacgataacgaagtttgaaacaagcggtttaattgtgttacaactgagtgaagaagagcaggcagcgcatgaagaatatctcaaactgattgataagaaatccaaagggaattgtatttggatgcgcccgaatgaaacggaatcggaacaaattcactaattacttgatttatttgattttaaaataagcaaataaattcgtttcgtgaaaaattatttgacgctttagcgcaaaatccgtattattcgccttaccagttgcggagtggtagttcagctggttagaatacctgcctgtcacgcagggggtcgcgggttcgagtcccgtccattccgcctaattaatttttagttattgaatttaattcgataataccgtgtggagcggtagttcagctggttagaatacctgcctgtcacgcagggggtcgcgggttcgagtcccgtccgttccgccactttttcaagaaaaagcctctgagaaatcagaggcttttttgctatttggcttttgaggcttttctatgtctaaaccctttaatggccgttaccaacttgccgttgtgatagtaacggttgggcgcgaatctttattacgtgcagttcgttctgttttttctcagcaatttagcggaaatattcaaattctgattggcgtggatctcgatttatccggtcagcttccgcattatcgacaaatacttgatcaagaacgtccggctaatgtggatatcgtttggttagatctcggctattcaacctctaaacgtcacggtggtgtacatgattgctattacggcggttcattgcgttcggcattgaccttacttgctgatagtgaattggttacttatctcgatgatgacgattggtttttaccgcaacatatcgacaaaatgtattccgtattctgccagtatccggatgtgaattggggacacgctttgtgttactacgctgacggtaataccggtgaaatactgtgtttagacgaattagaaagcgttggtgttgatcagggtatttttaaggatagtttcggcggctttgtgcgtccatcgggcttaacgctcaataaacttaaaacgctgccttatctccattgctggtcgcaatctttagcccaaggagacggagaagatcgcatactgtttgatcatttaaaacaattgcgtcatttttctttggcagaaggcacggtttgttgtgcgctggatccgaaagattcggggcatgaaattcgccttgcttttatcaagcaaaaaacagggcgagatgtggtgatgcaagacaagcgaggttcaacccgttgaggttaagccgtaagaatcagtttgttaatttgctgtaatccgtttaaacgtgtactcgtcagattttgtgagatttttaattgatcaaacagctgagtcaaatcaacatgagctaattgcgctgaatcggcttcgtttaatagtgttacgacaataaataaaatcccctgcattaaacgggcatcgctgtaggcttgaactttacgtggtgttgcttgaaattcaaaccataagcggctttcacagccgtgaatttcaggtaatttttttaattcttcctcgctaggcttcggtaattggcgactaagttgaattaacaagcggtatctttcttcccaagatttgcaaagttcaaatttttgataaatatcggctaaagtcatatttttttatggattaaggctaagttttgcaaaagattgtaacaatctgaccgcttgttgttaatgattttcttaaagtttgatagaattaacagtatttctcagatttcggataaggaacccaaaatggcagtaattccaatggtggttgaacaaacctcaaaaggcgaaagatcatacgatatttattcacgtttacttaaggaacgtatcatttttttaaacggtgaagttgaagaccatatggcaaacttgatcgtggcacaacttcttttcttagaatcggaagatcctgaaaaagatatttatttatacattaactcaccgggtggtgttgttacggcgggtttagcaatttacgacacaatgaactttattaagcctgatgttgcaacactttgtaccggacaggcttgctcaatgggggctttcttattatccggcggtgcaaaaggcaaacgttttgctttacctcacgcacgtgtgatgattcaccaacctttaggtggtgcaagagggcaggcgactgatattcaaattcaagcgcaagaaattttaaaattaaaagaaatgctgacaagaagaatggcagaacatagcgggcagccgtttgaaaaagtggcggcagataccgaacgtgataattttatgtcagcatttgaagcggctgaatacggtttaattgataaagttttaacacacagagatacaaaataatggcaaattttgagaaagaaccacattgtagtttttgtggaaaaagacgtaccgaagtggatcagcttgttgaaggtacggaaggttatatctgtaatcactgtattgaagaatcttacgcattgttaaacggcgaagaagagccgttaatcgatgaaaaacaagatgaagagaaattctttgaaaatgtaccgactccacacgaaattcatgcgcatttagatgagtatgttatcggtcaagaacatgcaaaaaaagtgttgtccgtagcggtttataaccactataaacgtttacgcaatgcgctttcaggccataaggaaaccaacggtgtagagttaggtaaaagtaatattttattaattggtccgaccggtagcggtaagaccttattggcggaaaccttagcccgccgtctaaacgtaccgtttgccgtggcggatgcaaccacgttgacgcaagccggctatgtgggtgaagacgtagaaaacgtaattcaaaaattactaatgaaatgcgattttgatgcggaacaagcggagcgtggtatcgtctttattgatgagatcgacaaaattacgcgtaaatcggaaagcccgtcaattacccgtgacgtatctggcgaaggtgtacagcaggcgttattaaaattaattgaaggaacggtggcgaatatcaatccgcaaggcagccgtaagcacccgaaaggcgaaacgattccggttgatacctctaaaatcttatttatttgtggtggcgcatttgccggcttagataagcttgttgaagcacgaaccaataaacaaggcggaatcggctttggtgcagaacttaaaaaagataaagaacgtgaagatctcaccgagttattcaaacaagttgagccggaagatttagtcaaattcggcttaattccggaattaatcggtcgattaccggtggtgactccgttacaagaacttgatgaagaggcattaattcaaattttaaccgagccgaaaaatgcgattatcaagcaatatcaagcattattccaaatggaaggtgttgagctgaaatttactaaagatgcgctaattgcgattgcgcagaagtctatttcacgcaaaacgggtgcgcgtggtttacgttcgattgttgagaatctactattggatacgatgtataacctaccgacacttaaagcagagaaaaatgtgaaaaaagtgacgattggcaaaggttgtgttgaaaacggtgataagccgaaagtagagtaagcatagctaaaatggacaatgtttttcattgtccatttgttttatctgtaggcatagccgttacgcaaacgatagtatctttaaagaaattatatgaatatttggcaatctacctcaattattacttggctgcttgcgccgttttcattgctgttttggctgattagccaaatccgcttgtttttgtttcgcaaaaaaatcttaaaatcttaccgctctccggtaccggtgttagtagtcggtaatatttcggtgggtggtaatggaaaaacacctgtagttgtttggttagtggaacagctacaacaacgaggaataaaagttggtgtgatttctcgtggctatggcggtaaaagcaaagactttcctcaattagtcaccaaacagagttcagcggaaatggtaggtgatgaaccggtgttgattatgcaacgaactggtgtgccgttggcaatttcaccaaatcgtcagcaaagtatcgaattgctattgagtcaatttgagctggatttaattatcactgatgacggcttgcaacattacgccttacagcgagatatcgaatgggttgtggttgatggtatacgtcgtttgggtaacggttttgttttgcctgccggcggtctgcgtgagctgccaagccgtttgcaatcggtacaagcgattatctgtaatggcggagaggctcaatcgaatgaacatttaatgacgcttgaacctgaattggcagttaacctcaaaacgggagaacagaagccgataaccgattttatcgggcaagagtgtgtggcgatagccggaatcggacatccgcctcgtttttttaatatgcttgaaaatttaggtattaaattacttaaaacacaaggttttgccgatcaccaagcatttgaagctaaccaacttaaagtgcttgcagccgaacaaattccgttactgatgacagaaaaagatgcggtaaaatgccaaacttttgcccagtcaaattggtggtatatacctgtttctgcaaaattctcgccggaatcgaccgcttgtttacttgaaccgattttaaaacgattaggaaaataatatgaatgaaaaactgattaataatcttgcttgcccggtaacgaataccaaactggaatgggataaagctaataatcgcttaattagccatgaggcaaaattagtgtacccaatccaaaacggcataccggtgttattaccagaagcaggcgaaaagctcgaagactaaatatctcgtagatttataggacaagcggtcggattttacagattttttgcaaaaaatcgctgaaatttaaccgcttgcgataatcgggatcgaactaagtcttttaaaccttggtattcctagaaagttgtgttttgattttttcaaaatgttacttacagtgttactaaaattaaaagtcatctataaattatcctgttttatagacaattatttggatcgtaagaatgattagcggaatgaatcctgaaaaagtagggagttcccgaaataatagggattcatcacaccggtatgatagggggttgtgttatcgcaacggtttagttgtggccatataaccacggttcaccggttaaaagtttgaggataattcactttacctgttttggtaaattatttctccctttttgggtaaggtatggtgatttcccccacacctcaaaaaaagctaatttactcaaatttgagcttagtttatttattaagttgaattacctaagttgaggatagttacacaaccactctctagccgtctaaaaccactgtataagattttcacactttccaccctctctattatataaggaaaaattcgtagtccaatagtccaattagtccaaaaactcacttttctttttatattcaataggttacataaaattttttggactatttttttccattttggactattttaggtggcttttggactaaatgattttgaagattttcatttttttaactttagcatttagtccaaaaagggggtattttagtccaaaaacggtgattttagtccaatgatagtccaataattttacatctaacttattgatatataatgatttcataccttaaaaagggtgttttggactattggactattaaaaatatgcttcctaatagaaagggagaataaatttatacaggttgtataaaaagtgcattttataaacaataaagcataacaaaaaaaccgccaataatggcggtctgaatgtagtttaatgatatggctattcgtcgctattctcattgagaatctctatcagataagctcgggttctctttgggttgatcttgtgtggtattcgttggaggtatgcgtagccgttgccctctcccttatgaagaatgcccgctttaactaataccggaagtgcaacctctttcgtctgcccttgtaaggcttcatcttcaaatacgcttttgaagacaaaataacggtcatcttctaccagtcgataaccggctttattgctgataggcttctgtgtgccgtccggtggaaactcttcaaaacgagtatcagcatttaccaatagccaaccgttcacttgttcaatgatctgtgtatgctttttcgagtgccagccataagcgtttacccattcattgaagttagccgtgatagcgtttgatatatccttttccgtccattgtaagatatccttagccaataataaggcggtttcaatgagggcgaatctatccgccatcacccgcttaatttgaggttctgaattatccggcaagctctttaatcgagattgttttactttgtcgtataacgctctcaatgcgcttttttccgcttggactagataagtgagccaatctacacccaccgcaccaaaatagcgcatgacgtttgcattgagcgcgtcagcgtgcgttttaccgtccgccaagccgtgaaactctgtcgctcgtttcatcgggatattgagtaagcggactaattggccggcattgacctttatcccttgttgcttgaggtagctctctaaaccttcctcaccggtggagagattcgctactagccatttaatcgacttgcgatttccaccttctttcgcaccttgtaacttcccttgtccgttaaacaagctataagcggtctgtgcgacggctttcggactggcttcgctgatttcatctaacggcataaatagcccgttacggctaaaggcttcgttctgtaaggccaacggtgtagcgttccatgctgtacgagtttctcttgggtgtccgtaaattgaggaagcgatatttaaagcggttgttttaccgaatgttgaatcttcgtaaaggtgtacgccgtagccgtccgcctctaaaggtttcaataatggcgcacttaatgccacgccaatcgataacatcatcgacggattacctacgcaataacgcccgatattctccacccagtccgctgttgttccgcttactctatatccttcgatattctgcgttaaattgcggaaaatggtcggggtttgcggttgccctaaggtttccccgtttggcaaggtaaaagcggttaaatcttcattccagccggttttgtcggtaatgtaatactgcttggcggttcggcttttaaattgcaaataatcggctaattccgcccgtagtgcttgcttagtagttaccgtcacatcattacgtttcaaatactgccagccgtcacgctcaccaatatcttttagcggcataacaagcggtcgttcttgcttctctttttgcaaaataatgaaatgttcactttctcctttgcctagtccgatgacctcgacaaaatcggataaccatttttcgctttcgactttctcaccgtccacaatacgagtagtaacatagtacaagccttttaatccgccacgcttacgcatttctacacgtggagcggtatcatcttcggggttaagtgtgcgttgctctaaaagctctgcggtagcgtgctgtccgttcttaatgcgctgatattcgctggttaggttttccgtattaaagccttcatctagccattctacggcggtaagattcgggcaatgttctgcgaggttcatcaatactcgggtgcgaaaatcatctttatctttcgccaaagtggggagttcccccacttggaatattttaatgaatcgttgtgctgccggcgcaagtaacaagcggtctaattggcccaaatctttgctatccaacaagcacggaatcatatcattgcctagcttgaagctatcacgaattaatgcccatctttcgcctttgcctgcttctgaatggttagtctctttattccatcggtaataggctttatgtacgtctcttcctgctagaataatccaatcgttgaaagcgttcgtttttgctaactggtcatcataaaagcggattttgttcatactccacctcttcgatcacttcctgtaagtaagtgtgcgcttcatctaagtattggaaggcttccgccagtatttcatctctgctcatcagcgtaccgttttcacgtcgtaccgcaccgttgccggttaaagcaatctcaaggaatatcttcgccatatctaacggctgcttgattgaatggagggtttctagattactcattctcgcctcccttaaagtttaaattttccatttcagataaggcagatataagaatgccgtgaattccttcgattgctatactaatacttacaccatccatatcttgaagacgtgattttgacatagcatctaatagggtcgccgcttgccaacatttagccattccttcgttaaattgtgcttgttggttactcatctttcgctacctccaccgcttttcgttcacattccgccaatttgtaagcgttcaatgcttcggtctgtgcttcgtgaactttgattaattcataaatctgttgatcacgttggcggtgtgcctgtttaatctgcccaataaggtaatcattaagcgcaagtaagccgtcggcaatatcgctgctataagtaaattcgctttcgccatctacactgatgcactcagaatgatcgacgctaatcgcacttgataaactattcgcataggtaaggagcatatcgaggttgtcggtttgctcacgaatatcttcaatcaatttatttgtgttacgcataaaccacctctttaacggcaaagaaagggcagaccttagctttagcttgttctaagctattggctttaatacgcacggtatagcaagggaatgatgaaatcggttttgacgtgttgcgtaagtctaaacggcttacggctttgaataggtagatcatggctgatagctccacaagtaaatttttagagtctatcgctttgctttccacggcttggcgatagcgtttagcggggtggaaaactgcgacttgtggaacacagccaacgattaaacgttgcccactaaacgctaccatagagagaaatgtaacgaatccatttttggattggtcattttctttaggtgtgtttagtccacgaacaaaaaaagcacggtcattgaaaggcgtgctagtgttcgccacaagtaaattattcgagtttccacgctcggcttccgattttgcgaaagcgagagtagcataaaccttattcgctaaacttgtaaagcaattctttttacaagcggtcgaattttcttcattttttgcaaattccgccgatagtacggaatgaaccatatctaaataaccttgcggattattgtcgattgtgtcgctatttgttgtgatgtactgtaaaatattcatcggttaaataccttttttaaatttttgttcttgccctcttggtgtcgctttgagggcgtttttatttgctaataaagtcaagttttactagtggaacttttgaaaaagtgttccattgtcgtaccgtattcgcaccgtatctttaccgttctgttaccgtttccgtcttcgttttgttgctcgtgctaactgtttcaacattgttttaaaacctctgatttcttgtagaaagactgtcgattgtgatggtgtccgcttgctgcattcactcatttcacttactaaatccgtgcgataagttcgctttctaaatcttggtaagcgctcctcacgttccaccattgcttgcttttcttgctcgattagctccacggtgcgatagtcatttaacagttcgcttgctcttgctcgtagcgttaccgctttcattcgctcggctcgttctgtacctaatacggcttttaaggcgtgtgttgcattgcccttgtgggcgtactcaatagcgaacctttgccggatttgatgaccgtatcccattgcgctaacctccgaacttaaccgctaacattttgattcttccctactgccagtttgcgccagtaatgtaatgcacttgcttgtaaatgatttttacgtactgtgtactccaaacctaacttaatcattgtggcgttttcagtaaccagtaaatggattaaatcaagttgttcaggcgtcagaaattggcggatttcagcatctgccggataaccattctgtgataaccatttctttttactcatgcccaacgctacacaataaacgagggtattttcgcggctgtacgcgtgcggatcttctttttcagaagtctgctgcttgaaatcaatcgcttcattaagtaagtgttgcgtatctcttaagcggtctttgctatcaagttgctttttcattcggttaaattcggcgatatacatctctttaaattgcattgcttttttgccggtaaatcccataactaaaagcgtaaagccgtcttgggtcattaagaacatcttccggctttctcccttttggtcggtgtacttaacgggcttaaaattcagccggttaaattcttctgaacacgctaaattttcaagacgttgcaaaatatttttatgctgttttccgaaatattccgctactttaagggtgtttgtcattgcaacggtttctttacgaaacactttaggaaataccgcttcaatcggtaattgctcatttaatcctttcatctcattttcccctttctaatcgtttccaattgcttaattcttttcgcatatagccatattgaagtctgccggctctcgttctgtcgtatttgttgcttcgcttctaaaatctgaatatgcgtagcaaggcaagtaataagctcctcaagcgggtagggttcttcgtcgttgtacaggctcttaaacgtgaacacgttcttattgccggcagcgtagtaatcaaatgcgtgctgaattaataccgtattcatcttggctatttcacacttcatactgaatcactcctgttacacccctttcaccggtttacgtactttgtgctgtaattgcgcctgtgttggtgctgctaactgattaagtacggattccgccaccgttggcggatagggaatcgctgcgttacgacttaccgcttttccatttaggaaagtgattaatctctccgcctgtgtcttatctgctaagaaatagcgaaaatgcgtacctccgttttggttatgttcttgaatacgaataaattcagtctgtgtaatagcttctagctcgttgatctcgtttcgaccgctggtgatgcctaattccctcattccgtccagttcagaaaagccgttacggcttgttaataaataacttcctagcttttccttgcgtgtagtatttgcgttcataagctagccccttacacttgattaccggctaacttatcaatagccttggtactgtttgccgataacgtgctaagccctctttcgttgttgattaaatcattaagccattgttctacgtccgatgatttccaacgtgaagcacgccctatcttgataggcggggaaagtttgcccgcttgaatttgcttgtagataaaagcacgactaaatccgcttacggcttgaatatgtttgatggttttgagttccattgaatattcctcctatgccgcttcaattcggttatttgctaatgctttgataaatgtgtttacttcgctttcgagataaccgactgaattagcccctaatttgattttcttcgggcaatcagggcgataacgttttgatttagggttttcccagtctgtcagggtagatttacttacgcctaagcgtgataggtactccggcttgcggataatacgttcagaaatgtttttatcttggtgggtcattgataatcctctccataaagttaaataacttgccgtaaaccttggtaggtcttggcggtatgaagtggattttggctgagtattgataaaggttaaataacgctaacagctaactagattcctttactgttaattcatttctttaactgttaaggaaacaaaaaagccgatcacttttctgtaatcaactttttaaatattatttatttttgcggtttgggttatatggagctatccatttttttatttgagcatgagacttatcagaaatctttatttggcggatatgttcagctatttcatctagggatagttttggagtacgtttccacatcgttttagcttcatctattgctttttgtttatttggatctgttctattctgttttcttctgttttgtttagctgtaatcattttaagattgttagctattgcctcactagccaagagcataaagccaatatggtttaaagctttttgtaaatgcgcaacagcttcaagagtttcattataatttaaaaatacataacccttttcttcaacaagagtctttattgtatttatattctgtttatgttcattctctattatttctaggctttcatataacttgttccatttattttcgcctattgaacttaaccaactaatagtactatctaaattagcttctaattgattagcaaactcttttaataattccgccctattttcttcactaaacatcttatgctgattggaaatatatttattctgcttatgtatttcctcaagactttcaaaatcatttaattttactttcatgtcttagcctttcaaacggttaattttcaccaaagtttaataattcattttatttggaattcgtaagttaatgatggataaattaaaaatactcattcataaacgtccctacacgctgccctattaagagagtgagcaacaggaaactaataggggtagtttcttttcggctcgggtaattagtccgttcctagttgctcaaattgactgccggttaaatcggctttgattggtctgtattgtatcagataggtggataaaataacagattatcctgctactgtttttaacttccttcgttggggggaagtcttgccctttgtgcgaataattaggcgatagcaggattccgctatcggataattcagccggtaaacggttttaattcctgttcgtttgtttcgttattaatgtttagctgttttagtgtgcggcgtggggatttcccccatgctgccctaatttatgaggcttgtacctaattcgacatcaatcgtcatcttttaagcctttgtgctgaatggaaggtttcttataaaatgaggtaaaagccttgtgccggcttgttcctagatcgtagtagcttattgattcaatgaaaatatttttaaatgatgatgatgcctagaaatcgtaaaatctgccgaagaccgcgcggccccaaccccgtggaaagggtatcccctccggagtacctttttatattcaggttttacgacattaaggcggtagttctcctcaaatttgaggcaaccggctcaatattgagccggttagttatacccctaccattaaatagtcgccaccattgaacaacgctctacataatccccccacatttgcatcacgcctatacgttgttctaagtaggtggatttgttataggcttggctaaccacattccccacactatgcgctaggcaagcttctgccacttcgtgcgttacgtcattatcagctagataggttctggctaaagaccgcataccgtgagcggtcaaaacatctttatagcccattcgcttaagtgccacatttgccgtgctgctattcatatgttccgccggtttactgtaatgcgggaaaacgtgttttaaatgccctgtaatcggtttaagtcgttcaagtactcggattgcttgcgttgatagtggcacaatatgctgtaaacgtcctttcctcgttcctttcattttttccggtgggattgtccacaatcttttttctaaatcaatctctgcccattcaacactaaccgcttcacgggggcgaaccatcgttagtagttgccattgaatcaagtaacgggtttgcggttcaatatgagcatttgcaatctttgccattagttcgggcaatttatcaggcggaatagtagggttgttttccttttgcttcttcgcaaacatttctccaatcgtcgaacaaggattgtattttacgagtccgccatttaccgcaaaattcatgatttcgttgatcatacgaattaagcgatgcaaggtatcattcagattctttttataaagtggttgtaatgcagtaaccacaacaggggcggaaatctcattaagtgataggtgtcctaagtaaggcaaggcataaagctctaatcgacgatactctttattaatcgtactttcctgtacctcatcgcgcttcttttctcgccatttttcagaaaggtttttaaaggtgttggatttctcaaagtttttttgttcttcgagttgttggcggtagattttaggatcaatacctttggctaatagctgattgtattcattgcggatttctcgagcttgcttcaaggaaatttccggatacacgcctaaacctaaattagaccgatttttagcattaggcttaaagtagttaaaaatccaatttttcgccccgtttggtttaattcgtaaatataatccgttgccgtcagataggttgtactctttatcttgcggtttagctttatctacttcggtattagtaaggggctttgtagttcttgccatatgtaacactcattttagtaacactaatttttgctatttgtgccgatgttacttacagtgttactaaaaatcaatgatttcagaagacgtgaattgacaataaaagacaataaaaaagccttaaagcgttgtgctataaggcttgcgtaggcgtttatttacatcagtttattttgaattggtggagataatcgggatcgaaccgacgacctcttgaatgccattcaagcgctctcccaactgagctatatccccaaaaagtggcaacataataaatgccgccactttagctgtcaataggaaattatgcttgtacttgaataaacttaattgctttttggatacgagctaaggtacgatcacgaccgactaattttgcggtaatatccattgacggtgattggcctgagccggttaccgctaaacggaacggcatccccactttacccataccgatttctaaatcagccgcagttgcgttcatcgcatcgtgaatcgcttctacactccaatcagttaaagcggttaatttttccaataattttgcaagtggtgcaactgcttccgctttgaagtttttcgccgcagctttttcatcataaccgtcaaattcttgatagaaataacggcttgcagtcgctaattcttttaatgttttcgcacgttcgcttaataccggaataatttcttctaacgccgggccgtttgaagtatcgattgcttgatcattcatatgccacgctaaatatttcgccacgtgttcagccggtaagctacgcatatagtgttggtttaaccattgtaatttatcggtattgaacgcacttgccgatttacttactgagtgaatgtcgaataattcgatcatttcttcacggctgaaaatttcttggtcaccgtgaccccagcctaaacgtactaaatagtttactaaagcttcaggtaaataaccgtcgtcacgatattgcattacgcttacagcaccgtggcgttttgataatttctggccgtcatcaccgttaatcattgaaacgtgagcataggtcggaatcggtgcgcctaatgcttttaaaatattaatttggcgaggtgtgttgttgatatggtcttcgccacgtacaacatgcgtaatacccatatcccagtcatctaccaccacgcagaagttataagtcggcgaaccgtctgtacggcgaataattaagtcatctaattcactgttgctgatttcgatacgaccacgtaccgcatcgtcaaacactaccgaaccttcttgcgggtttttaaagcgcacaacgtgcggttcatctgccgaatgttcgtgattacctaagcaatggcgatcgtaacgaggtttttctttatttgcttcttgttcgttacgtaagttttctaaacgttcttttgaacagtagcaacggtacgctaaaccttgctcgatcatttgatcgataacttggttgtaacggtcaaaacgtttggtttgataatatggaccgtgttcccaagcgagatttaaccattccataccttcaagaattgctgcggttgcttccggtgttgaacgttccaggtcggtatcttcgatacgtaatacaaattcaccgttgaagtgttttgcatataaccaagaatataaagcggtacgtgcgccgccaacgtgtaaatagccggttgggctaggcgcaaaacgggtgcgcacttttacattcggatctaaagggaaaagagtttcgatattcattattgtcagcctattaagtaatttgccgagaacggcttttttaaacaaaagatttatctattctactacggttaacctagcggttgaaggttaaaaaacgtaaaaaatgaaggttttggacgaaaaattcaacaaacaagccgaaatgttaaaaaaagggtttgacgataggtgaaaaatctctataatgccactccacaacacgggcgattagctcagttgggagagcacctcccttacaaggagggggtcactggttcgagaccggtatcgcccaccactttccaataagtgtttcgtgttgattacaatctaataattgaaaacgggcgattagctcagttgggagagcacctcccttacaaggagggggtcactggttcgagaccggtatcgcccaccacttttcaacaagtgttccgtttttcaattccctttgatgaaatctcaagtgggcgattagctcagttgggagagcacctcccttacaaggagggggtcactggttcgagaccggtatcgcccaccactttagattttcatcataaacttcaagctatagcaaatgctatatcatgagggcgattagctcagttgggagagcacctcccttacaaggagggggtcactggttcgagaccggtatcgcccaccactacttcttatcctattctttaattcatcatcaaataacatttaaaatttgctattttaccctctatctttgcatttcatcacttttttgcgatcttgatcgaaaatttcagattaaaaacttcccatttcgtttaaaaatcactagccttaaaccttatagacgagtaaaatttgcggtctttttattttatcaacctgcaaaactaatccttttgccgtaaaccgtgtaacaacgaggcttttactctcatgtcagaacaaacccaaacttgtgcgagcgaaattcaagcaatgaatgccgcagtacaacaccctaaatcagaaaaaattaacctcatgaacttaactcgccaagagatgcgtgagttatttgccgaaatgggcgaaaaaccgtttcgtgccgaccaattaatgaaatggatttaccattttggtgaagataatttcgataatatgagcaatatcaataaagtattgcgtgaaaaattaaaacaaattgcagaaatcaaagcaccggaagtatctgtcgagcagcgttcaagtgacggcacaatcaaatgggcgatgcaagtaggcgatcagcaaattgaaaccgtgtatattccggaagcggatcgtgcgactttatgtgtttcttcacaagtaggctgtgcgttagcctgtaaattctgttcaaccgctcagcaaggttttaaccgtaacttaaccgtttctgaaattatcggtcaggtatggcgagcttcgaaaatcattggtaacttcggtgtaaccggtgtacgtccgattaccaacgtggtaatgatggggatgggggaaccgttacttaatttaaataacgtgattccggcaatggaaattatgttagatgactttgcatacggtttatcaaaacgccgtgtaacactttcaacggcaggtgttgtgccggcgcttgatattatgcgtgaaaaaattgacgtagcattagcgatttcattgcatgcaccaaatgatgaattgcgtgatgaaattatgccgattaacaaaaagtataatatcaaaatgttgatggattctgtgcataaataccttgaagtatcgaatgcgaaccacggtaaagtgacgattgaatacgtgttattagatcacgttaatgacggcacggaacacgcacatcagttagccgaagtcttaaaaaatacgccgtgtaagatcaatctaattccatggaacccgttcccagaagctccttacggtaagagttcaaatagccgtgtggatcgtttccaaaaaaccttaatggaatacggttttacggttattgtacgtaaaactcgtggtgacgatattgatgccgcttgcggtcagcttgccggtgatgtcatcgaccgaaccaaacgtaccatggaaaaacgtaagtttggcaaaggtattgcggtgcaaaaccattaaccaatttctccctaagcaactcaagcgaagggagtatatcttgaggagaacaatatgaaccttgcaaaatttttgcgaaatttgaccgcttgtatgctgttacctgtgttgttcggttgttcttctctgcttcctcccccccaaaccacttttaatcgttcagaagcagttaaagcgcgtatcaatttagccttagcgtatctcgatcaacatgatttacccaaagcgaaagagaatattgataaagcgttaagccacgatcaaaacgattacctacctcactccgttttagcttattattatcaacaaatcggtgatcaagttcacgccgagcaagcttatcagcaagcattgaagctgagtaataaccgtccggatgtcttaaataattacggtacttttctgtgtaaacaagccaaatttgatcaggcataccaacaatttgagcaagcggtgcaaagcgaacaaccttattatcatcaagccgatagcctagaaaatatcgtgttatgtgccaaacaagagccgaatttagctaaagtaaacgaagcgttaagccaattagaaaagctggataaagcaagagcggcggcactgcgttagctcgaacttttatttttgggcattgtctttttttactgttaaaataaagcgaattttatttgttagggaaacgcaatgtcagagctcaatacacagattagccagattattgccacagaactttctgttggctcacatcaaattctcgctgcaatcaaattactcgatgagggtaataccattccatttatcgctcgttatcgtaaagaagtcaccggtggcttagacgacacccaattacgtcattttgaaacacgtttaatttatttgcgtgagttagacgatcgccgtcaaacgatccttaaatcgattgaagatcaaggtaaattgacggctgaattacgtaccaaaattgaaacgaccgaaagtaaaaccgaattagaagatctttatctgccttataaaccgaaacgccgtactcgtgggcaaattgcgattgaggcagggcttgagccgttggcagatagtttatggaatgatccgagccaatcaccggaagtgttagcggaatcttttattgatgcggaaaaaggtgttgcggatgttaaatctgcgttagacggcgcacgttatattctaatggagcgtttttcagaagatgccgaattacttgcaaaattacgccaatatttgaccgcttacgcaacgctagaatcaagagtgattgaaggtagggaagaagaaggcgagaaattccgagattattttgcccatagtgagccgtttaaaaccgtaccttcgcaccgtgcgttagcaatgttccgaggcagaaacgaaggcgtattatcgctttcgttaaatgcggatcctaaagcggaagaaggcgctcgaacaagtcattgcgaagaaattattcgccagcatttaggcgtgatattcaatcaacaaccggcagacaaatggcgtgaacaagtgattgcttggacttggaaaattaaagctgcacttcatttggaaaccgaattaatgggcgcattgcgcgagaaagcggaagaagaagcgattgacgtatttgctcgcaatctgtctgcgttattaatggcggcaccggcaggcgcaaaaaataccatgggcttagacccgggcttacgaaccggtgtgaaagtggctgtggtggataataccggtaaattattggcgaccgacaccatttatccgcacacaacaggcaaagcagcggcggaagtttcgctgtataaattaattaagcagcataatgttgagctgattgcgatcggtaatggtacggcttctcgtgaaacggaacgttttgccaaggatgtgttaaaacagatcaaagaaagcaaaccggatatgttgattccacaaaccgtggtggttagtgaggcgggggcttcggtttattctgcttccgaattagcggcaaatgaattccctgagttagatgtttcattacgtggtgcggtatcgattgctcgccgtttacaagatcctctagcggaattggtaaaaattgagccgaaagcgattggcgtggggcagtatcagcacgatgttaaccagtcacaactggctcgcaaactggatgcggtggttgaagactgtgtaaatgcggttggggtggatctgaataccgcttccgcaccgttattggctcgtgttgccggtatgagcaaaacactagcgcaaaatatcgtagcgtttcgtgatgaaaacggacgttttaatgcacgttccgacctgaaaaaagtacctcgtttagggccgaaagcctttgaacagtgtgccggttttatgcgaattgtcggcggtaaaaatgcgttagatgcttcgagtgtgcatccggaggcttatccggtggtggaaaaaattctccaagcaaccgattcgactcttgctgaattaatgggcaatgcaactcgtattcaccaactgaatgcaaaagattttgtggacgaacaattcggtttaccgactgtaaacgatattttcaaagagttggaaaaaccggggcgcgatcctcgtggtgaatttaaaacggcaacctttatggacggcgtagaagatattaaggatctgaaagtcggtatgatcttagaggggacggtaaccaatgtagcgaatttcggtgcttttgtggatatcggtgtacatcaagacggtttggtacatatttcaatgttatcgaacagcttcgtggaagatccgcataaagtagtgaaagttggcaatttagtgaaagtgaaagtgttagaagtggatgtacagcgtaaacgtattgcgttaactatgcgtttagaagacaagccgaccgacaaaccggcaagcggtcgaaatccgcaagaaaatcgcaaaaatactgaaaaatccgaccgcttctctggcaataaaccgcaacgtaatcagttcgccaacaatgcgtttgccgatgcgttaaaaggttggaagaagtaattctccccctctctctgcttgttttcgctaaacgcttcaacaagctgtctctctcccacaaggggagagagtaaaatatagcttaaataaaaccacggaacacaccgattacactgaataaatttccgagtggtctgtgtgttccgtggttagtttttgcaaaattttgcggaaatataaccgcttgtaagaggcgaaagtaagatattgctcaaataaaaccacggaatacaccgattacaccggataaaattttcgagtaatctgtgtattctgtggttaattttttgcaaacctttgcagaaaaatgactgcttgtaatgagatgttattggttttgtacttttattgaacagaaaaaggtagtaatatagtgacaattttgatattagggaggcgatatggcggtcatcagttccaaagaatttaaccaacgtgccagtgctgtattaaaaattgcagaaaccgagcctgtgtatattactaaatggggtaaggtggttagtgtgttggcaagctacgctcattatcaagctcaaacgaaatcgcaaagtttggcagatgcttttagcagtacggtaccaactgcaatattgagtaccgaagccgaacagcaatttgagcaaactttgcagcaaatacgtcaacaaagcaaaatgaacgtaccggatttatcggagtgggaataatgtatttattagataccaatattgtttccgaactacgtaaaatggaaagtggaaaagctgatgttaatgtggttgcctggtttcaacaagtcaatttaaccgatgcttatttaagtgttatcactctctttgaaattaagttaggtattttgcaacttaaacgcaaagatattcaacaagctaaacttttacaaagttggtttgaacaaaaacttttacatcattttgaaaatagaattttaccgcttgataccaaagttatgatgatctgtgcagagtttcatattccggataaaaagccgttaaatgactcttatatagccgctacggctaaagcacatagatttaaaattgtgacgagaaatgtgaaaaattttaaaggatgtggggtagaggtactgaatccatttattgatgaataaattaaaccacggaacacactgattacactgaataaatttccgagagatcagtgtgttccgtggttaattttttctaaatacttcaacaaactgtttatctcccataaagggaggggtattaaatatagattaaatcaaactactgaacacactgattacaccgaataaaatttccgagtagtccgtgtattccgtggttactttttgctaaatacttcaataaactgtctatctcctataaagggatatagtgagatatagattgaataaagccagggaatacaccgattacactgaataaaattccgagtagtctgcgtattccgtggttaattttttgcaaaattttacggaaatataaccgcttgttttgcttagtgtaacttcattgacggtctgaggaagcggttaatttgaccgactaataaaatcagaccggtttttacccagccgtgtaaagcaacttggtgcatacggtataacgagaggtaagcaaggcgtgcgattttaccttcgataaacatatcaccgctcattaagttgcccatcaagttaccgaccgtaccgaagtgagagaacgaaagtagagagcctttatcattgaatttaaacggtttttgttctttgccttcaagtgccgccacaatatttttaccgcattgtgttgccatttggtgtgcagcttgcgcacgtggtggaatggctttaccgtcttggattaatgaggcgcagtcaccgatgacatatactgagtcatctaccgttgtttgtaaggtatctttgatttcaatttggtttaaacgattagtttcaaaatcgaattcttttacaaattcaggtgctttaacccctgcagcccaaaccattaagttagcttcaattttgtcaccgtctttagtaattaagccgtcttctaccgcttcggtgatcatcgtatttaagcgaacgtccacaccagctttgcgcaattcagcaagggcagaagccgatactttttcggttaatgcaggaattaagcgtgaaccagcttcaactaaggtgacttttaggctcgctcgattcaatttaccaaaaccgtatgagtttaagtgttttaccgcattataaagttctgcggaaagctcgatcccagttgctccaccaccgacgatcgcaatttttacgtcttgattttcactgtgagagaactgtaggaataattccatcatacgtttttggaattgtttcgcctgttctgaaccgtctaagaaaatacagtgttccgccacacctttagtattgaaatcgttcgatttactgccgatcgcaatcactaatttatcataagcgatatgacgttcttctactaacagctgattttgttcgttataaattggcgcaagtgtcacttcttttttatcacgacttactgcggtgagcgtgccttgttggaattcaaaaccgtgatttttagcatgtgcacgatagctgagtgcatcggtaccttcatctaaagaaccggttgcaacttcgtgtaaaagaggtttccaaaggtgggttgcattacgatcgataagaatgactttcgctttattcttacgccctaatttattgccaaggtaggtagcaagctctaaaccgccagctccaccacccacgaccacgatggtttccattgtcataaaatactccaaatgataataaattgataaaagtcaaaaaattgcgttaattttaggcgcttatagaataatgtctagtaccttttaacgttattttaacgattgttacaaattgtctttggaagtgaggatttgtttacactgcttacagagatagcggcgaccatctcgtacgatggcattatgacgacgtaaagagagtagatgcgtttgacaaccgcactgataggcaaattgtttgccgacgacattttgcgtatcaaagcaatggtaggtttccgctggtacgccgaaaacttgttccatcatcattttccattctttaccgtgtggttggactcgcccgaattgttgataaaccaaagcgtgagcaagttcatgcggtacaacctgctgaataaaggattgcccgttttccgccaataaaacaggattgaagcgaatttcattacgttgcagataagcaacaccggcttttacaccacgcacggcataactgaccgtcggtggtgtaaaagttttattgaagtgagtattggcttgctccaaattgcgttttagctgacgctgaacctgcattttgagctgacgcatgagagcagtatttgagactgattccgtcatttatttcgggcagtccactggttgccattttttatcgtagcaaacgtagagttcggtcttgcttgcgcctaaataaacaccgcgtagctgcggattatgtttacgcatccattggaataaatcatttcggcgtagattttttgccggtagtttcaggctgtaaaacaactctttttgttttgcaaaatagctttccgcattatcgaaagcgcagctgccgtgtttttcccattcgccttgtaataatgcagcacctggtgattccggtagatattgctcaataattttcgctgacacttccggtaaatcgccttggcaatagcgaggatgctgatcaaccgaacgtgctttagcattttgtggccataaaccgtgaataacccagccgaagttttgactaccggcgcattgataagctaaacgttgcggcacatcaccttggtttttattgcgttgtgattcacaaaaagctggtgaccaagaaagtgccaacatatagtaatcaaccggtgcgtgcttgttttgcccgattttatcttcatccattttggaatcataattcatcgaaagtgccgcttgagtcgctgaagcggattgtgcctgcggtgcttttgcaatcggcgtatcgttttccgtcgcatagtcgttttgttgctgctgcggcagtggttgtttaaccggttctgacttattactttgattaccgaaaaaataagagattgccgcaataatcagtaatacggctaattttataagttgcttttggttcatatttaatggggttggatcactagaaagggcgctactataaacaaaaaagagaagtgagggaagaaaaaataagcggttaaatttgtaaaaaaatttgcaaatttaaccgcttgtaacaagctattttatcgtgccacagctgaggcaatataaataggcatgtttaggatcgttaaactgttgcagtaattcgagcgattgttgggcttgagttgcaactggaagccctaaccatgaactcaattggaatttgagtttagagccttttaggaatgaacctagtagactatcatcactgtcaataaaccattgtgctctaaagtgttcaattacggcttcgccttttgctttgcgttgttgattgactaattcggtgataacgtcataagcggtgtcaaaatcacctaattcatcgactaaaccgtgttttaatgcatcttcacctgaccaaacttgtccttgtgcaattttatctactgcctgtttagggatatttcgtccgcggctgaccaattctaggaatcggtcgtagccattttcaatgctgatttgaattacttccgcttgttctttcggtaatgtttttaatggactggaagaagcaaatggtgaaagtgaaataccatcttccgttacacctaaatttttagcggttttttcaaagctggttgctaagccgaaaatcccgatagaaccggtaatggtagtcgggctggcgataattttatcgctggtcgccgaaatccaatagccgcctgacgccgccataccgcccattgatgtcacaaccggtttaccggaaagttgaatcgcttctaattcttggcgaataatttccgaagccattgcgctaccgccggggctatttactcgtaaaataacgcctctcacatttttgtcttcacgtgctttgcgtaattgtttgacaatagtgtcgctgcccgctgaattttgagagcttttgccactaacgatttgaccttctacgttaataattgcaattttgtgttcggctttaacatgaaaacgatctgtaagcccgtgagcataatcaaaataatcaatgtgattatagttaccctctttatctgctccgaattgttgaattaaagcggtttgaatttgacttggtgtggtaacttccgtaatcaatttttgatttagtgcatattgcgcatcatcgccttttaatgctttatattttgcgatataagtttggctatccggtagaacttgttccggctgaatttggcgattgcgcgcaatgtcttggcggacattattccagattgatgtgagccatgtttgtgcgttttgttttgcttctggtgacatatcatcacgaatgaacggctctacagccgatttgtaagtaccgacacggaaaatatgtggaacagcttcaattttatcgagcaacgttttgaaatagatattgctatagctgagagcgtgaatatcaacaaaaccggctttattcaaataaatcttatcggcaaagcttgccaaatagtattgcgattggctgtattgttcaccaatagcgataaccggtttacccgattgcttgaagtattcgatttgagcgccaataaattgtagtgaggcaacatccccacattggaaataacctaaatccaatactaaaccggtaatacgttcatctttcatggctttattgatgctacgagctacatcaaaggttgagatttttatcggttcattattgcctaactcgttttgaattaagcggtgtaaatcaccgtattcgtcatgattatcggctaagtaaccgtctaaattgagttgtaatgcccctttttcgaaaaaagggttgttgattttgatgttttgattcttgttgtaataatgtggtaagtgcaaaacaaatcagtacgaaaataataaagaataggcttaagacaaattctcgaatacagcggaaaatctgataaagccctttcaacatttttaacatattagtcctaatgagtgtaagtattttgtgggataagctaccataaaaacggcttagaattaataaaatatgttattcttaatgcaatttttacataaagtacagcagactatggaaattttagatttattacatcgccgtcgttcaaataaaaaatttggtgaaattgcgccctctgcggagcaaattgaaaatatgattaaagcggcattgcgtgcgccggatcacggcaaaatgaagccttatcactttgtggtgatcgaaaaaagcggaatgtcgaaattacgagaatgtttagctgctgccgcagttgaatttaatatggatgagaaaaatgcggctaaggcggataaactttccagccaagcaccaatggtgatcggcattgtggcaaaaattgatcacgaatcaccgaaagtaccggcgtgggagcaaattgtgacagccggctgtgcgacttatgcgatgcagctagccgctaatgctcaaggctttgaaacggtttggattagcaaaaaatgggtggaaggatcgctattgcgtgaaacattcggctgccgtgccggtgataaagtgatcggtttattgttagtcggatcaccgaaagaagataatggcatttcgctagccagagaagcggaagaaacggaaggttttgtgagcataattcgttgataatagcgagctcgtattgaggaaggtatgaaaacaattttaatcactggctgttcttccggtattggttatgccacggctaaattgttgaaagacagcggctggcgagtgattgccagttgtagaaaaccggcggatattgaccgcttgcgagcggaaggtttcgaatgtattcagcttgatgtgcaagattcggcacagattgcccaagcttttgaatatattaaagcgaacggcggcttagatgcggtcttttgcaatgcaggacaagggcaaccgggctgtgtggaagatttgccgcgtgaagcattacgtgagttatttgaaatcaatgtgtttggcgtgtgggaagtgatgaatcatgcacttaaaattttccgcgcgcagaaccacgggcgtattttgcttactagcagtattttaggctttgctgcaatgcactttcgaggtgcttataatgcgactaaatttgcggtggaaggtatggcggatacgctacgtcacgaattatacggctcgaatatttatgtcagcttgattgaaccgggcccgattttaagcgattttcgctcaaattctttggataaactcaccaaatatattgatgtggaacataccgctaaaacggcatttaaccaaaaacaatatcagcgattggcaactaaaaagaatgataacccgtttgccaaaccggcatcagccgtggcggaagcctgtttgaaagccttaaccgatagtaaaccgaaagctcgttatcaagtcactttcccaactaaactgttctggtggctaagacgtattttaccgactacatggtttgattttgtgtgccgtaagtctggtggctagtggagcaataaaaccacggaatacacggattacactgaaaagcctagcacggcagaaccgtactaggttaagtataattcagccctgttagggctggaagttagagaaaatatagagccacagagtggctcactcagccgaaggttgattgtaaccacgtacggcttcgtgcgtgggggaaactagctacttcaacaatctctgactattcagcactacggtgatagaagacattgtcatcgcaacggcggcgatcatcgggttgagcagccagccggtaaacgggtaaagtacacctgcagcaatcggaatggcaatcacgttatacataaatgcaccgagcaaactttgcttcatattgcgtaatacccgtttggcaaacggcagaatttgtaccaccggtgttaaaccgtgttgcatcagcgagagatcggcagtttcaaccgcaatatccgaaccgttgtgcatcgcaatccccacatttgcttgagcgagagccggtgcgtcattaatcccatcgccaatcatcgccacttttttaccttgagcttgtaattcacgaattttatccgctttttgctccggtaaaacttcggcgatcactccgtctaaaccgagttgttgtgcaaaatattcagcagttgattggcggtcaccggttagcattaagcattgataaccttccgctttaaatttttcgatcatcgctttggattcattacgtaattgatcttccaccgataaaataccagctaattgaccatttactgccacaaaaatttgcgtggatcgagaagcggttaaattcccggaaaaattgacaaacttcgcattacccaccttgatttgatcttcgcctaagttggcaacaatccctgcccctttgactacttgcacgtttgtcacttcacaagcggtctgattttcagcaaattttacaatcgctttggcaatcgggtgagaagcgtggacttctaaactttttgccagttgcaacactcgattcggctcgaaaccgttaaaggtttggatatccgaaaccgtcatttcgccggtggtgagtgtgccggttttatcgaatactagcgtatcgatttcggagccggcttgcagagcttcgatattgcgtactaacacgccgaattcagcagctcgagccacgccggcaatagtggaaagcggaattgctaaaccgagtgcacaagggcaagcgataattaacaccgtagtaaaaattgagagggcaaacgaaaagtctttgcctaaaaataaccaaatcagaccgcttattaacgcaatcgaaactacaactggtacaaaaacacttgccactttatcgacaaattgtgcgagtggtggcttacttgattgtgcatgacgtacagcattgatcactcgggcaagagcggtttggctgccgacttgttcggcaatatagatacccgctccgtcttgaatcagcgttccggcgcgtactttatctccgacttttttctcaatcggtaacgcttcgccggtgagcattgattcatccacccaaatagaaccgctttccaatctgccgtccactgcaaggcggtcaccggtgagtgcttgcacacgcattcccggcttgatgccttttaccggaatggtttgtgttgcattattttgatcaaaaacgaccgcttgttgcggggcgagatcgagtaatttttctaaagcaagcgaagaacgttgtttggcttttagttcaagaaatttaccgagattgataaagccgataatcatcacgctggcttcatagtaaacgtgcgcttgcggttgggggaaaagtgttagccaaaatgagtagagccaagcgacaccggtactgagagcgactaaagtgtccatggtggaggctttattttttaagctgacccatgccccgacaaagaaatctttaccggcaaaatacatggtaaataaactgatcgcagcggcaataaaccaataaattaaattagttgaatttgggatcattccgataaccaaacccaatgccaccaaaccgaaaccgacaattaaggcgactacaaattgccattttttatggcttaaagcacgttgggtttgcgcttgttgtttggctcgacgttcttgttcgctttctaaaatttccgcaccgaaaccgattttttcgaccgcttgtaccatcgcttgcggatctgcttcgccctgtacaaatgcagtttgatcggcaagattgaccgaagcaaaactcactccttccactttcatcaaaattttttcaacccgacgcacgcaagcggcacagtgcataccgtcaattaaaagttgttgttctttagccatatcttttctttccggtaagtttaaccacggaatacacggatttcacggaaatattcagtgttttctgtgtatcccgtggtaatggttagattacttccgcttcaaaaccaatatcatcaaccgctgcaataagagcttctgcattagcagaaccttctacaatcgcttgttgcggatctaaagtcactgccgctttagttacgccttctactgcattcagtgctttttccacgctttttacacagttaccgcaatgtaagccgtcaagtttgagtgtaattgacattttgtttctcctaatgattagttgtatgaattgaaaattgtagttgtgccgtcttttttaagtaacagcacatcatatttatctttatgccccatatgtttcggctgatccattcccggcgagccaagcggcatttccggtacgattaagcctactgcatcagccggtttttctttgagtaaacgctcaatatcttgtgccggcacatgaccttcaatcagataaccgtctaccattgcactatgacaggcttgtaatttcggttgtaattgtagtttgctatgtacatggcgattacctgtatcatttgcggtgacattaaaaccatgctgttttaaatgatcaatccaaaaattacagcaaccgcaagttggacttttccatacttcaatattattgactgcataaacaaaagaaggagtcgcaagcattgcacaaaatgaaatgacttttaacagacgaaatttcatagctacctcataaaaaagaatgacgaatactgaatttctttatatgctaatccttaaccctaggttaaggtcaagaggtaatagaatgaatattagtcaagctgcggaacattccggattatcagctaagcaaattcgcgattatgaaaaagccggtttactgccgcaggcagtccgttcaagtagtggttatcgagtttattcgatttcggatttggaacgtttacactttatcagtaatgcacgtaaggttggattttctttagtgcagatcagcgaattattaaaactaaatgatgatccgcatcgcaccagccgtgaagtgaagaaacttaccgagcaacatattgaagaacttcagcaaaaaattgctgatttacaacaaatgctttctttactgaaaagttggagtaagtcttgttgcggtaatgacagtccggaatgttcgatattaagcggtctaaaacgctaaattttttgcaaatgattttgctgtcatcaaatcgtcatattgtttttttagaatacgcttaaaccaaataatttattccaaacagctagttcaaacatccatgaggagaacaatatgttattggtcaaagcagcaagaaaatgtgtagtgatcgggctttcattaggtgtgatggcatcaagttatgcggaaacgattacgggtgctggtgcttcgtttccctatccgatttatgcgaaatgggcttcactttatgaaaaagaaacaggcaataaagtgaattatcaatctatcggttccggtggcggtcagcagcaaattattgctaacacgattgatttcggtgcgtcagatgacccgatgaaagcggaattattggctcaacacaaattattacaatttccggcaattatcggcggtacggttccggtggtgaacttaccggaatttaaagccggcgagttaaaattatccggtacggtattagcggatattttcctcggtaaaattaccaaatggaatgatccggcgattaaagcattaaatgaatcattaaatttaccggagaaaaacattattgtggtacgccgttcggacggttctggtacaacattcggttggacgaactatttatctaaggtttcgccggaatggaaagaaaaagtcggagaggggaaatcagttaaatggccgaccggtcacggcggtaaaggcaatgaaggcgttgccgcttatgtgaaacagttgaagtattctatcggttatgtcgaatatgcttatgcgaaacaaaataatttagcctgggcttctttacagaaccaagcgggtaaatttgtccaaccgtcccgtgacagctttatggcggcggctgcaaatgcacaatgggataaagcgaaaggtatgggcattatgctgactaatgaaagtggtgaacattcatggccagtgacggcggcaagttttatcttgattcatcaacaagcggagaacccaaaggcaaccaaagcagtgtttgatttctttgactgggcatttgagaagggtaaaaatgcggcattagaattggattatgtgccgttgccaaagaatgtggtagaaaaaattcagcaaaaatggcatgatcaagttaaagataaagatggtaaagcgattcgctaatcattaaattggaaaacaagcggtcgaattttaggtttatattacaaccttgaattcgaccgctttcaattttattagcaagaaatcaacataaactatcatcaataataaaaaatattagagattttatgcatattatgaaaaagaatctttggcttattggtcttgcaagtgtgtatagcttagaaagctatgcgcttacaatttatgaaaggaatggtacaacgctccgttttagtggtgagatgaatatggtattggaaaaacaatattaccgcacacatcgttatccgctaaatgaaacgctaaatgaatcaatgaataccaatttagcgaataatggctcagaaatcagatttaaggctaagcataagttatctgatgaattaagtttatttgctagagtcggttggaatttaaataactatgaaaaaaatgctactcgggatagattcggtgagttaagtgtgcgtcgtgcttatctcggtattgagcatcaaaagtatgggcagttaagaattgggcgccaatctttgtttgctaatgagatttccgtcagcgattttgattattctgtaggaaatagtgaacgccttttagcttatagcggtaaatctgttattcgctatgattatacaggcatagagaatctacaattaagtagtcattatcatttttcagaaaagaccgatagttttcctagacaatcgaatcgtaagttaaaagacggtgtcgggattgccggtttatatgatatttcattaaatgacagacaagcattttctattggcgccgcttatagttatgtaaattaccttgaccgaactaatcagcgtgcttctcaggaaggcgctcaattaagtttacttttgttttcgaaaaattggctgttcggactggataccggtttacgatatcgaaaacaaccgaatttgtttgaggatgaaaagttatttctgattaaatcaggtattagatatgcttattctgatcaaggaagtgtttatactaattgtgcttatagtgttgctaaacggcaaaacttgaacttagaagaagaaatagatcggattgtcagaagaagtgctgtatttggaacggattatagtgtgcatcaaaatgtcagtgcctatttagaagcgggttatgcgtatgatctcgcttactccggcggcaataaattagaacagggtatagagaaaattattgcttctggtttagagatttattggtaaacagcaggttctttccagtcttattttgtcataaaactgtcatattctttttttaaaataaactccaaaataaacattggagttttttatgtctaataaaccaagctgtttaaatcatcctttagcagaaggcttgtttaagcatacaacgcaattttttgcttggcttgtctttgctatgttggcagctattttaatttcattagttatcggtagctgggaatcattaactcgatttgggcttagctttttgtggacaagcgattgggatccgaataatgacaactatggtgcggttgtgccagtgatcggtactttaatttctgcattaattgctttattgattgcggtaccaatttcttttggtattgcagtttttttaaccgaacttgcacctgaatggttaaaacgtccgattagtgttgcggttgaaatgctagctgcaattccttccattatttacggtatgtggggcttatttgtcttcgtaccgcttttccaagaacatatccaacccaccttaattgaattactcggcgatctgccacttatcggcgtactgttttccggcgcaccttttggtatcggtctgtttaccgcagggcttgtattggcaattatgattattccttatattgcttccatgatgcgagaagtattcggcgttgtcccgccaatgttgaaagagagtgcttacggcttaggttcaaccacttgggaagtggtttggaaaatcattttaccttacaccaaagccggtgtggtcggcagtatgatgttaggactcggacgtgcattgggtgaaacgatggcggtcacttttgttatcggtaacgcatttaatttaccggattcactcttttcaccgtctgcttcgattgcatccgcgatagcgaatgaatttaacgaagcgacaggcttacaaaaatcggcattaatggaattaggtttaatcttattcttaataactacggtggtactcagtatttctcgtttaatgattttaagaatgagcaaaaaagagggaaataaataatgcatcgtaataaaaatgggcgtttttaccgccgtaaatgcattaataaaattatgctttcagtatctttctttgcggttggattcgggctgttttggttaggctggattttatttaccttaattcaaaaagggattccggagctttcattaacgctatttaccttaccgacaccggcaccgaatgaagcgggcggtttgagtaatgcgattatcggatcattaatgatgttgttattcggaactctaatcggcacgccaatcggcattttagccgggacttacttagccgaatacggacgctatagcaaattagcgaaagtcactcgctttctgaatgatattttactttcagcaccgtcaattattatcggtttgtttatctatgcgatttatgtatcgcacgtcaagcactattcaggctgggcgggctctttcgctttggcgttgttagtgattccggtggtggtacgtaccaccgacagtatgctgaatctgattccgaataatttacgggaagctgcagtggcgttaggttgtccgcaatggcgaatgattaccatggtttgttataaagcggctcgttcgggaattattaccggtgtgttactcgcagtggcacgtatctcgggagaaacagcgccacttctgtttactgcgctttcaaaccaattcagttcgtgggatatgaatggaccaatggcaaacttaccggtcgtgatttatcaatatgcggcgagtccgttccaagattggaataatctagcatgggcgggagcaacattaattaccgggtttgtgttatgcctcaatattcttacccgtatcttttttaaccaaaaacaacgataaggaaatgcaatgagtaacgaattaatttcactacaagataccaaaattgcaattaatcatttagattttttctatggcgatttccatgctttaaaaaatattaatttacgtattgccaaaaataaagttactgcatttataggtccttccggctgtggaaaatcgactttattacgaactttaaaccgaatgttcgaacaatacccgaatcaaaaagcgcaaggggaaatcttgtttgaaggtgaaaatttgctaaccactgaaaccgacattgccttaatccgtgccagaatcggtatggtgttccaaaaaccgacaccgttcccaatgtcgatttatgacaatgtggcatttggtattcgtttgtttgaaaaattgccgaaatcagaattaaatgaccgtgtagaatgggcattaaccaaagcggcattatggaacgaagtcaaaaacaaattacatcagagtggcgacagtttatccggaggtcagcaacaacgtttgtgcattgcgcgtggtattgcggttaaaccggaagtcttgctgttagatgagccttgttctgcgctcgacccgatttctaccatgaaaattgaagaattgatttgtgaattaaaacacgattacacggtagcgattgtgacccacaatatgcaacaggcggcacgctgttcggattataccgcttatatgtatttaggtgagttagtcgagtttggtgaaaccaagcaaatctttgataagccgagattccaacgtactgaagattatattcgaggtcgaatgggttaaatttgtcttgaatcgatttaaacaagcggttaaattttactgaaattttgccaattttttgtcaaatttgaccgcttattcatagcaaaagggtaggagcagaagatgaatgagaaaattctgattgtcgaagatgaaaaagcgattagagagatgattgctttgtttttattacagcaaaattatcaggttattgaagcggaagactatcagagcgcagtgaaaaaattggatgaaaaacctaaactgattttgctggattggatgttgccggggcgttccggtatccagtttattcaatatttaaaaaagtcggaagacaccacacaaattcctatcttaatgctcacagcacgcagctcagaagacgattgcattacttgccttaatactggtgcggatgattatgtcaccaagccgttttctcctaaagtccttatcgctcgtattgaggcgttgctgagacgaacctatcaaaataacgatatgattaatattgatgatctgattttagatcaaaatgccaaacgggtaacttttcagaaaaaagaaattagtttaagcagtactgaatataaattactacacttctttatgactcatccggaaaaagtttatagtcgagaacaattgttggatttcgtgtggggtaatgatatttatgtggaagacagaacggtcgattcgtatatccgccgtttaagaaaaagtttagaaccatgcggttttgaacgttatgtgcaaacggtgcgaggctccggctaccgcttttccaaccactttcgggataattaatgaaaaaggtcaaactctcttttaagcacttctttattgaaacagcgctagcggcggcaattgcgtttttattcggattgtttgcgtggcatttcttaacgtggtttgctctgattttagtcttattgctcatttggcatcactataatgaacagcgattattgcatttaatcgacccgaatcgtaaaagtagccgaaaggttttaactacatgggaacatatttcacaaacggtcgctttttatcaaaaacgtaaccgtcgagaaaaaattaaaacgctgcgattactctccaaattaaacaagaacattcaatatttaccggatgctatcattatttgtcatcatgacggtaccattttgtggtgcaataacgtttcgcaagaaatgctaaatttctattgggataaaaaactcgaaaagagcgtgtttagcgtgattttttatgaagagtttaaaaagtattttcatcaaaataagaaaaatcgaccgcttgtattaatggatcgagacgagcgatatatcgaatttcatttaaatgattacgatagcgaaagttatttaattattgctcgtgacgtgacgcaaatgattcgtttactacactcccgacaaacctttctaactaatatgaatcacgaactgcgtacgccgctgaccgtattgcgaggttatttagaattgttagaagggcaagcggaaaccgaattacagcaaaaaagtattcaggcaatgcagtcacaggctaagcggatgggaaatttattggatcagctaaatttattggcaaaaatcgaaacgtcttccagtaaggaacattatgtggttgaaatgtcggcaatgattttggcattacaaaaaaatgcggattttttaaagcacagtaaacaacaaatcatttttaatatcaccccgaatattaccgtactaggcgatgaaaatcagctgcaaagtgcagtgtccaatttgatttataatgcggtcaaacacgctggtgacggtgcgactattgaagtagattggcattggtgtagtgaaggtgcggagtttagcgtacgtgataacggggttgggattgaagaaacgcacttaccgcatttaaccgagcgtttttatcgagtggacgaatcacgcagtaaccaaaccggtggcagcggcttagggctggcgattgtgaagtatgcgttggagcaacacggttctcaattacaaatcaaaagcgaagtaggcaagggaagccagtttagttttatcatcaaaaaatctctgcttggcgaaacaaaaaatcattaaaacagtattttttactcaacaaatggggaatttgccagtaaaatgcctgtttttctgtccattaagagagcttagtcatgtctgataaacgctacggtgctgatgaaattaccgttttaaaagatcttgaacccgtccaacttcgtcccggaatgtacaccgataccactcgtccgaaccatttagggcaagaagtcatcgataacagtgtcgatgaagcgttatccggctacgcctctcaaattgacgtgattctccatgcggataattcattagaagtgattgataacggccgaggaatgccggttgatattcactctaccgaaaaaatttccggtgtggagttaattctcactaagctacacgcaggcggtaagttttctaataaaaactacacattctcaggcggtttacacggggtagggatctcggtagtaaacgctctctcgcaacgtgtagaaatcaaaattaagcgtaacggtgaaatctatacgattgcctttgaaaacggggtaaaagtagaagagttaactgtaattggcagttgtccgaaaaaacaaaccggtactaccgttcgtttctatccgaacccaaaatactttgattcgccgagattttcggtcagtcgtttacgtcacctattacgtgccaaagcggtactttgcccgaaattaaccattaatttcgttgatcatatcaataacaatagcgaaacttggtattacgaagacggtttatccgattatttaagcgaagcgttaaaagaattcgaatgtttgccgaatccaccgtttattggcgatgtttcctctgaaaccgaagcggtaagttgggcattaacttggctaccggaaggtggcgagctattggctgagagttatgtgaacctgattccgactgcacaaggtggtacgcacgtaaacggtttacgtaacggcttattaaaagcaatggtggaattctgcgaaattcataatttactgccgaagagcgttaaattaaccgctgatgacgtgtggaatcgctgcgcttatgtactttcgttaaaaattcaagaaccgcaatttgcaggacaaactaaagaacgtctttcctctcgtcaggcttccagttatgtggatagcacaatcaaagatgcgttcagtttatggttaaatcaaaacgtacaaaccggtaaattgattgctgaaatggcgatttcatcggcgcaaagccgtttgcgtgcggcgaaaaaagtggtacgtaaaaagttagtgagcggccctgcattaccggggaaattggcagattgtacttcgcaagatttaagtcgtaccgagttgttcttagtggaaggggattctgcgggcggttcggcaaaacaggcgcgagataaagattatcaagcgattttgccgttacgaggtaaaattctgaatacgtgggaagtgtcttccgatcaagtgcttgcctctcaagaagttcacgatattgcggtagcgcttgggattgatccggataacgataatttagatgaactgcgttacggtaaggtatgtattcttgccgatgcggattcggacggtttacatattgcgactttattatgtgcattgtttttgcgccatttcccgaatttagtcaaaaacgggcacgtttatgtggcaatgccaccactttatcggattgatattggtaaagacgaagtacattacgcccttgatgaagcggaaaaagaagcgattttagctcgtctcgccaagaaaaaaggtaaaccaaacgtacagcgttttaaaggtttaggtgagatgaatccaagccaattacgtgaaaccacaatggatccgagtacgcgtcggttagtacagcttacacttgatgagttggatacaaccgaagaaaacgagccgaatacctttgaaattatggatatgttgctggcgaagaaacgagcggaagatcgtaagcaatggctacaaaatcgcggtgatgaagcggagcttagtgtgtagctcttgataaaacaagcggtcgatttttactgaatctttgcaatttggcaggctgaaatgtgagaactttccatttgcaaaatattagcgaaaatcgaccgcttgtattgttagtgtggtgttaataaaaagctaaaaatatttttgaaaaggttcacatttttcttacatttctatttctttccttaaaattttgtgtatagtgcctttgcattttaattgtcctattgtgggggcgctatggacgcaacttctttatctatcaagaaaaccaacatgcgtaataatgtcatttttattgcgaatgttgcattgtttttcattcttctcaatacattaccttttgcgcctgaagcgaataaaggcttagcgttattagtatttgttgctgtattgtggctcactgaagctttacatgtcactgtaacagctttactcgttccaattctttcgattgcattaggattggttaaatctaaagatgcattagtggcatttgctgatccgacaattttccttttctttggtggttttgccttagcgaccgcattacatattcagcaattagatcgtctcattgcgaataaaattatggcaatggcaaagggtaaactttctgttgcggtgatttatttgtttgcggtgacagcattcctttcaatgtggatgagtaatactgcaaccgctgcgatgatgttaccgttggcgatgggaattttaagcaaattggatcgctctcaacatcataatacttatgtattcgtattactgggtattgcttatagtgcaagtattggtggaatgggaaccttggttggcagtccgccgaatgcgatcgtggcgtcacaattgcatctgtcatttgcagactggatgaaatatggtttaccgattatgtttatcttgctgccggtaatggttggcgtgctgtatgtcgtgtttaagcctaaatttaatgtgaagtttgaacaaacttttgaaaaaattgagcttaatcgtgatcgtattctaaccttggttattttcgttttcattgctttaagctgggtgtttagctctcaattgaatccgatcatttcaggtttattagggttaaaaggcaatatcggtagctttgatagtattatggcaatggttgctgccgcactaatttgtattacccgtgtggcaacttggcaacaggttcaagagaataccgaatggggcgtattattcctatttggtggtggtttaaccttgagtgcggtacttggtcaaaccggtgcaagtaaaattatggcggatggaattgttgctttaattgacggtagccacttttatgtaattgggttaattgttgctgcctttattattttcttaaccgaatttacttcaaatacggcaagtgcggcgttattagtgccgatctttatctcgattgcacaagcgcttaatatgccaccgcttggtttagcgttaatcattggtttaggcgcaagctgtgcctttatgttgccggtggcaacgccgccgaatgcgattgtattcggaacgggacaaattaaacaaaatgaaatggttaaagccggtttctggttaaatatcatttgtgttgtggtaattgctactatcggctatgtattttggttatgatagcgtagtaaaaaaatagcgaaaattaaccgcttgcgccttattcttctggtttatatctaacctagaatagggcgttttttatatctattggttgtacctgtttaaatttctaactaaaaattatgatatatctcatgtttttttattttggttatttttttgaaatgattttttgatatagtcactttgttttaaataaatcgtaacattctaatcaaattcgaaacatgagggtcattgaatgtctgaagctaagcaatttaaagaagatgtggctaaaaatcgtcgaaataccatcatttatattcttgatgtgattttatttttagcattacttacctttttaccttttgatcctgctccgactaaagcgcttgctttgcttgcttttgttgcagtgttatggttgacagaagctatgcatgtaacaattacggcattatttattccggtactttccgttttgttaggattggttgaatctaagcaagcattagtggcatttgctgatccgacaatcttcttattttttggtggctttgcattagctacagcattacatattcaaaaaattgataaactaattgccaacaaaattatggcgcttgccaaaggcaatttatttgttgctgtgctctatcttttccttgtgacagccgtgctttcaatgtggatgagtaataccgcaaccgccgcaatgatgttaccgctagccttaggtttattaagcaatatggataaagaacgagatcacaacacatttgcttttgtcattttaggtattgcgtatagtgcaggtcttggcggtatggggactttagtaggtagccctccgaatgcgattgcggcatcacaattaggtatcggttttgccgagtggctcatgtatggcttaccaatggtagcgattttattaccgatggcattagtggtgctatattttaacttccgtccgaagttttccggtagttttgaatatcatgcggaagatattccgatgaaccgtaaacgtcttattacgctcagtatttttgttgtgattgcactttgttgggttttcggtcaacaagtaaatagttttatttcgcctcttttaggtttatcaaaaaatattggtagttttgatagtattgttgcgatgattgcagctcttgctttatgtgcttcacgtgtcaccacttggaatcaattacaagaaggaactgagtggggcgtgttgttcttattcggtggcggtttaaccctaagttatgtgttaagtcacactggcgcgagtaaaatcatggcagaaggtatcgtttcattaattgaggggaaacactattacattatttgcttaattattgcggcgtttattgtgtgtttaaccgaatttacgtcaaatacggcaagtgcggcattgcttgtaccaatttttatctccattgcagagtcattaaaccttgatcctcgtgcatttgctttaattatcggttttggtgcttcatgtgcctttatgatgccggtgggtacgccgccgaatgcgattgcatttagtacgggtattgtaaaacaaagcgatatgttacgttcgtataaacttagtatcgtttgtattctagccatctctcttatcggttatttcttttggttgaaataaattgattgaattctgaaaagcgtagcgtatcggctacgcttttttgttttacctctttacttttgataaaaatacgctattgtcgaatttagcgtctataaaagaccaatatgcaaacaataagaggtataactatgtcaaaaacaactaaaagcccaataaggggcatgataattttattgctggatctgatactgttttttgcgttgattaaattactaccgtttaatccgcaagagaatcgaggactggcattgcttatttttgtcggcattttatggctaaccgaagctttcaatattactgttacctctttaatggtgcctatttttgccattttcttgaatgtcttatcgactaaagcggctttcgctcctttctctgagcctattatctttatgttttttggtggttttgttattgccgccgtacttaatttacagaaaattgatttatggattgctaatcatgtgattcgtttagctaaaggtaatttaaaacttaccattatctatttattcggcgtaacggctgggctttcattatttattaataatacggcagttgcggcgttaatgttgcctttaacacttgggattttgcatcagttagatttccaacaacatcgcagattatatgtatttgtactacttggcattgcgtttagttcaagtatcggggggatgggaacattagtaggctctgctccaaatgcgattttagcctcttatattaaggtgtcattttctgaatggctcgcttatggaatgcctgttgccgtgttattaatgattgcgatggtgttttcgttattagtggtgttacgaccgaactttaacgtaccgtttgaagtaaaagttgaacaaattccattaacagtacaacgtttgacgacattagttgttttttgtataacggcaatcttattaaccttcagtagtatgattgagccattattacgtcaggcattggaattaaaggagtcaattaaaagttttgatgcagtgatcgcaatgattgctgttgtcgtgctttgtattacgaatacggctacttgggcacagattcaagaacgtgccgagtggggcgtattaatgttattcggtggcgggttaacccttggtatcgtgttgaaagataccggtgcaagtaaaattctggctgacggtatcgtaaactatatcggtaataaacattggctgattatgacgctttctatggcggcgtttattgtgtttttaaccgaatttacttcaaataccgcaagtgctgcgttaatgatgccgatttttatttcggtcgcaaattctttaggcttaccgccgatttcactggctgcaattattgcttgcggtgcttcggcagcatttatgttgccgatcgcaactccgccaaatgcgattgtttttgctaccggttatattaaacaaagtgagatggttaaagtcggattacttatgaatcttgcttgtgtattaattattggctgcttgtcgtatttcttctggaccacttggtggtagcactccatttggagtctggcaggtcaaataagcggtcaaaaattggctgttttttgcaaaattatgcaagaatttgatctacattcgcccaaaatgggtagaaaatgatataatcatgctgttttatttttgaaacttaaaaaagaggaacttactatgtcagttattaaaatggcagaccttgatcttgctggcaaacgtttatttatccgtgctgatttaaacgtaccggtaaaagatggcaaagtgacatctgatgcacgtattcgtgcaaccattcctaccttaaaattagcattacaaaaaggtgctaaagtaatggtaacttctcacttaggccgtccaactgaaggtgtattcgaagaagcaaactctttacaacctgtagttgattatttaaatgcatcagatttaggtgtgccggtgcgcttagtacgtgactacttagacggtgttgatgttgcggaaaacgaaatcgtagtgcttgaaaacgtacgtattaataaaggtgagaagaaaaacgatcctgaacttgcgaaaaaatatgcagcgctttgtgatgtattcgtaatggacgcatttggtacggcacaccgtgcggaaggttctacttacggtgttgcacaatttgcaccggttgcatgtgctggcccgttattagcggcagaattagatgcattaggtaaagcattaaaagagccacaacgtccgatgttagcaatcgtaggtggttcaaaagtttctactaaattaactgttttagacagcctttcaaaaatcgcagaccaattaatcgttggtggcggtatcgcaaatactttcatcgcagcagaaggtcacgctgtaggtaaatctttatatgaagaagatttaatccctgaagcaaaacgtttagctgcagcaaccaatatccccgttccagttgatgtacgtgtaggtacagaattctctgaaaccgctccggcaacagaaaaagcggtatctgaagttcaagcagatgaatcaattttcgatattggtgacaaatcagcagaagaattagcaaatatcatcaaatctgcaaaaactattctttggaatggtccagttggcgtgtttgaattccctaacttccgtaaaggtactgaagtgatttcaaacgcaattgcagaagcaacggcaaacggtgcattctctattgcgggcggtggtgatacattagcggcaatcgatttattcggtattgcagataaaatctcttatatttcaacaggtggcggcgcgttcttagaattcgtagaaggcaaagtattaccggcagttgaaatcttagagaaacgtgcaaacggctaattctttactccccctctttgaaaaagagggggctggggggagattttacaagcggtgatttttctctgattttttacaaatctcccctaacccctctttactaaagaggggaataattttgaatttattaacactataggaaactcaaaaatggcattattagacatcgtaaaaccgggtgtagtaacaggcgacgacgttcaaaaagtattcgcttatgctaaagcaaacaattttgcaattccggcggtaaactgtgtaggttctgactctgtaaatgcagtattagaaacagcagcgcgtgtaaaagcacccgttatcgttcagttctctaacggtggtgcacaattctatgcaggtaaaggtatcaaaccagcatcaggtgctcgtgcagatgttttaggtgcaatcgcaggtgcgaaacacgttcacgcgttagcagaagagtacggtgtaccggtaattcttcatactgaccacgctgcgaaaaaattacttccatggattgacggtttattagatgcgggtgaaaaacactttgcggaaacaggtaaacctttattctcttctcacatgatcgacctttcagaagagccaatggaagaaaacatggcaatctgccgtgagtacttagctcgtatggataaaatgggtatgacacttgaaattgaaatcggtattaccggtggtgaagaagatggtgttgacaactcagatgttgaagagtctaaattatatactcaaccggaagatgttttatacgtttacgaccaattaaacccagtaagcccacgtttcactgttgccgctgcattcggtaacgtacacggtgtttacaaaccgggtaacgtaaaattaaaaccttcaatcttaggtgcatcacaagagttcgtttctaaagagcgtaaccttcctgcgaaatcaatcgacttcgtattccacggtggttctggttcatcacgtgaagaaatccgtgaagcgatcagctacggtgcgatcaaaatgaacatcgatacagatacgcaatgggcgtcttgggatggtattcttcaattctacaaagcgaacgaagcatacttacaaggtcaattaggtaaccctgaaggtccagattctccaaacaaaaaatactacgatccacgtgtttggttacgtaaaatggaagaatctatgtctaaacgcttagaacaatctttcgaagatttaaactgtgtaaacgttttataatttcagattgtaaaaagttaaccaaaaaagaccgcttatcggcggtctttttcattgataattgaaaaaggataatcaataattattcgttcaaattatcttttttctattatctattactgttatggcattattagaaattcaaaatctcagtaaacgttttactgaccgaataagtttatttcgcaagcaagatttttatgcggtaaaagaggtctcttttagcttgaataaacgtgagacgctggcgattattggtgaaaacggtgcgggaaaatcgactttatcaaaaatgattgtcggtttaacgaaaccgacttccggaagtatgctatttcgtggcaaaaaattaaaatttggcgattatcaattccgtacccgtcatattcgaatgatgttccaagacccgaattatgcttttgatcctaactataacatcgggcaaatcttagatgcaccgctacgtttggcaacagatctcagtgaagccgaacgtaatgaacgtatctttcatatcttaaaattagtcggaatgtatccggaacacgccttaattcatattaaagacacctcaagcagccagaaacaacgtattgctttggctcgggcgctgattttagagcctgaaatcctgattgcggacgatacgttaagtacgctggatttctcggtgagaacacaattaaccaatttaatgcttactcttcaagagcgtcttggtatttctattatctatgtcggacagaatttaggtttaattaagcatatcgctgataaattaatggttatgcatgaaggggaagtggtagagtatggtaaaaccaaagacctcctgctaaacccacaaagtgcgattaccgcccgtttaattgaaagccattttggcaagcaacttacaccggaagcttgggctgaatagccttctttcatacattaataaaataaaaaattacttatgcaacatcatgaatttttccgtggcgtaaaggaagtctctccgatgacacttggctttattccattagggcttgtgcttggcgctcaagcttcacaaaaaggtatgccgttttacgaaatcggcttgttaacgggtttgaattttgccggcggttcggaatttgctgccgtgaatctttgggctcatccgcttgccatcagcgttattgttgccgtttcaatgttgattaatagccgtcatattattatgggggcggcgttatctctttatatgaaaaatatcggtcgtttgaaatcgcttggcttactcttttttatgacggacgaagtatgggcgatgaatttagccgatgcgcagaaacgcccgcaaaaagcaattagtattccctattatatgggaacggcaatcagcctttatattatgtgggtgagttccagtatgttaggtgcttatatcgggccttttgttggtgatctggaaaaatacggtttcgatatgtcttttaccgccatctttttagtaatgttaaaaggaatgtggaagtcgttttcatttgctcgaccatggtttgttagtctgttggtagcgggattggttttccatacggttgagggcgcttggtatgtgctggcaggcgcattgtcggggattttatctgcctatttctttgcctcaagggaggataaagaatgacctcgagcgtttttcttacgattattttaatggcattctcaacctatcttacccgtatccttggttttctagtgctgcgaaatcgaaaattaagccatacgacagagaaagtgatggaggcggttcccggctgtgttttaatttctgttattgccccgaccatcatgtccggtgatattgccaatacgatagcggtaatcctgacttgcttggcaatgatgaaattttccttatttccaacggtgattatttcgattgttgcaaccggcttcttacgcgcaatcttctagctgaacaagcggttaaatttgcgaaaaaatttgcaaatttaaccgcttgtttggtttttgatctagttcataaaaagttttaaatacctcatttagactatttctctttattttagctaaacgtacactgataaaaataatttgtagaaggaatgaaaaatggaactcaagaatgttattgaacagcgcaaaaccatcaaagtttttaaccctaacgtaagcattgagcgccaagatctagaagaaatgttagcgctggcacagcttgcgccctctaaagcgaatttacaaccatggcgttttgtagtggtggacgatgtggtacaaaaaagtaaattactgggttctgttgcatttaacgcaccaccgtgtgaaacggcttcggcagtgattttagtgctagcggatttacaatatcagctattactgaatgatattttagaacgttcgattgaaaccggttgtttacatgttcaatttaagcaacgttcattggattttctgctcggggtacataatgcctcaagcgaacaagatatccgtgaccaagtggtgacagataccagtttagcggccatgcagtttatgctgattgccaaagataaaggctatgatactcatgcgattggggtatttgatcgccctgccgtattggatgtacttgaggtagatgccgagcgctatttgccggtgatgttattagcgattggtaaggcggcaacggcggcactaccgagtagccgtttacctttggaatatacggtttcttggaataatgggaaaggctttaaaaagtaattgtaatatttgttaaacaagcggtctgatttattaaaacttttgcaaaaagttgttaaaattagcccgcttttttattgattgcttatattgaggaagtatgcaacctgtgaataattcaattttgaataaaattatttttgcaagccgttggctacaattaccgatttatttaggcttaattgttgtgcaaggtatttacgcttataagtttatgaaatcactttataacttaatcgtaaaccttggtgtcatggacgaaaatacgatcatgttaacggtattaaatctcattgacgtggtgatgattgctaacttattaattatggtaattgtcggcggttatgaaacattcgtgtcaaaacttcatgtggatgatcatccggatcaacctgaatggcttcatcatgtgaatgcttcggtattaaaagtgaaattggggatgtcgattattagtatttcttctattcatttactgcaaacctttatcaatgcggcaaatttagatgaaaaaaccatgcaatggcaggtgattattcatgtgacgttcttgatttcagcagtagcaatggcttatacggataagatttcgcattcgtcagcagttagctcaaaacagcattaaacctatcacaataatttaatgcatttttacaaaaagcggttagaattaaaccgcttttattttatttatagtagggaagattatgacaaaacattatgactatttagccattggtggcggcagcggtggtattgcttcaatcaatcgtgcggcaagttatggtaaaaaatgtgcgatcattgaagcgaaatatctcggcggtacttgtgtgaacgtgggctgtgtgcctaaaaaagtgatgttttacggtgcgcatattgcagaggcgattaatagctatgcgccggattacggttttgatgtgacagtaaataattttgattttgcgaaattaatcgaaagtcgtgaagcctatatttctcgtattcatacttcatacaacaatgtcttagctaaaaataatgttgatgtgtttaacggttttgctaaatttgttgatagcaaaacggttgaggtgacgtatgcagatggcactaccgaacaaattactgcagatcatattttaattgcaaccggtggtcgcccgtctattccggcggttaaaggggctgaattcggtattgattcggatggtttctttgcattacgtgagttaccgaaacgtgttgcggtagtcggtgccggttatattgcggttgaaattgccggtgtattaaacagcttaggttctgaaacgcatttatttgtgcgtcaacatgcaccgttacgtaatcaagatccgcttatcgttgaaacgttagtggaagtattagcgcaagacggtattacgctacatactcaagcgattccgcaagaagttagtaaaaatgctgacggttcattagtattaaaattagcggatggtagagaaacaacagttgattgcttaatttgggcgattggtcgtgaaccggcgtgcgataaaatcaatcttgatgtagtaggtgtgaaaaccaacgctaaaggtcagattatcgtagataaattccaaaataccaatgtgccgaatatttatgcggtcggcgatattattgaaggcggtattgaattaacaccggtagctgtagcagcggggcgccgtttatctgaacgtttatttaacaataaaccgaatgaacatttagattacaatttagtgcctacggtggtatttagccacccacctatcggcacggtcggcttaaccgagccacaagcaatagagcagtatggtgctgaaaatgtaaaagtgtataaatcttcatttacggcaatgtatactgctgtaacacaacaccgtcagccttgtcgaatgaagttagtctgtgttggtaaagacgaaaaaatcgttggcttacacggtatcggtttcggcgttgatgaaatgatccaaggatttgcagtcgcgattaaaatgggagcaacaaaagctgattttgataacactgtggctattcatccaacaggatcagaagaatttgtaactatgcgctaattataataatatatgaggtaagtaaaccttttgtttacttacctttttttgtcttattaggaatgaaatttaaaatgaaaaacttattagccgttttaggggtaagttttctcttagctggatgttttgatgatccgaaaaagcaggatgctgattctagtcaaacgcccgtagagcaaaaacagcctcaaacaggagaaaaatcttcagagcagaggagcgaagaaagtaaaacatcttcggaaaaagttgataaatctgagaaaactgccgacgcagatcacaagaaagataaatcagcaactcatcttgaaaaagaagagaaagcagaattagtaaaaaccaataaaactgctggctcaagtaaaattattgaaaaacgccataagccggaaaagagcgttacgaaaaaatcatttgttgcagtatctcatgacgcgaagcttgagaataaaacaaagcattcagtagcaaaatctaaatcagctaagcgtcgccaagatgttaacggtacttatgagaatggtaaattggtaagtaacttctctccggaagagttacgagttggtgcgcaagtgccaatgtcggataatgaaattcgccaacaaaaaatgcaatgtcgttatccatttatgtctcagcaagagatcgcagagaataattgtggtgtaaaaaccgtgacgatttcctattaattggtctgttatcgaataaaaaagagggcaaatttttgccctcttttttatttatagctagacaacgtctagctataaaaaccatacgctatgcgtatggaatcaaagagcttaagcggcgagcagaataaaaaatcctcctataatgaatcaggctggcaaccaaaattcaacatataggaggagaagtcatggcaagtaaatccaatgacgattcaagtctatcacacacaaagtggaactgtaagtatcatattgtttttatcccgaaatacaggagaaagacaatttatggaaagttacgtatagatataggcggcatattaaggcaattatgtaactacaaaaatgtagaaatcctcgaagctcacgcgatgaaagatcatattcatatgctagtaaaaataccgcccaaattagccgtatcaagttttatgggctatctgaaaggaaaatcttcactgatgatatttgaaaggcatgcgaatttgaaatataagtatgggaacagaaacttttgggcgaaaggatactatgtcagtacggtaggtttaaatacaaaagttgttgaagaatatatcaggaatcaagagaaggaggatatggtttcggatagtttatcgaagaaagaatatatagacccctttaaggggtaagctatagtgtcattgtgctgttgtcagtctttcacatgccccttgaggggcttgtgaagtcctaggcccttataggggagcctaaaaaccgcccgttttacgggcggattgttatttataccaaaataatttctcactggtttgccagatggactcggcaatttcttgtggtgattcatcgcgtaattcacaaagagattggaaagtcacagccaatcgctctggacggtttggttttccttgaaagccaaatacaggcatatcgggcgagtcagtttccagtaataaactttctaaaggcagcttacgaatagcctctctggttttattggctcttgcgtaggtgattgtaccacccaccccaattttataacctaaatcaacaaagcgctttgcttggtcataacttccagcaaatccgtgaattactcccgtatgcgataattgggcttttttcagaaagaccgaaagttggtcatggcttttccgagaatgtaaatttaccggtaaattaaaccgcttggcaaaaccaagttgtgcttctaaatattcacactgcttataccaaagttcgggggtacaaagtgtttctaccgctctttctaaaccaatttccgcaattgcagtacattgtggatcttgttgtgctaataacgattctaaataatctaaatgaaccgtttggtgttgttgaatataaagcgggtgtaatcctaagccgtaaaccaaatgtttcggtgcttgcttagcacaagcggtcacttttacaaaattttttgcaaataccgacacaattaaaatacgagtgacatttgaatgtttggcattttcaacaagttgagtaatggaaaggttgacgctttctgctacataatccagatgagtatgggtatcgaagaattgcatataagagaatggttgaaataaaaaagcgaggaaattatcctcgcttttaaaatatcaatcaatagattaatttgctacataagcatcttcatcacgttcacctaatggtttaagcatagtgaagaatagtacgatacaaataattgttgctgctatacctaagtaaactgaaagttgataatctaaaccgaagccgattttattatagaacaagtaggttgcgcatacggttgtaataaaccacgctgggattgaacatacccagtggaattttttataacgatataaatatgctgcggcagtccaaagcattaccattgctgtcatttggtttgcccaagtgaagtaacgccataagatactgaagtcaatttttgataccacgaaacctaatgcgaataacggtacagcaatcattaagcgtttagttaatgaacgttgatcaattttaaagagttcagccaattgtaaacgtgcggcacggaatgccgtatcacctgaagtaattggtaatactactacgcctaatacggcgaaaataccaccgataaagcctaagaagtgtaatgagctgtcataaactactttagacggtgaacctgcagaaatcgcatcttgtaacgcttgtgggttttcatagaatgcaagacccaccatacaccatactaatgcgataacaccttcagtaatcattgctccatagaaaataaagcgaccttcgctttcattttccgcacaacgtgccattaacggggtttgcgttgcgtggaaacctgatagtgcaccacaagaaatagttaagaataataaaggccaaatcggaacatcgcccttcacttggaagttttgcgtgaatttttcccatgttaaaccttgaccgtccgcattaatcgtacggaagaattcaattggatcagttgcactgaagtgtgcagtgattaaaccatataccattccgagcgacataaacagtaataatgccccgaagaatggatagatgcgaccgataattttatcaattggaagtaaggttgctaagatatagtaagcaaagatgagtagcgtccataccgaaataacggttgctttatccataccccaaaccgttaagccgccagcttcaaccgcatggtgaagtgcttccgcatcgtttagttgtaatgtaccacctgtcgcaccgaagacgtccatcgtaatggttgccattaattgtgctgggcttgctacgaataccacaccaacaagtaagagaagaacaagcgccatcacattaataaatactttaactggacgacctaagaatttacccgctaaagccggcattgttgcgccaccgttacgaatgctcaacataccgcagaagtaatcgtgtaccgcaccggcaaaaatacaaccgattacgatccaaagcatcgccaccggtccgtataacgcaccaaggattggaccaaaaatagggcctgtaccggcaatatttaataattgaatgagccaaatttttgtttttgacattggcatatagtcaacaccatcattcatcgcataagccggtgttgtttttttcgggttgatcacaaagattttctcaatgatcttcccatagacaaagtagcctagtacgagaactgctacacaaaagaaaaaccacaacatagtaaaggtaaccttataaagtttgaataatttggaaatcacaaatcgccaaaaggcgttgtattttagtaatatacgtgaataaagtaaattaagttcgttactataaataggtgtttatgtaataaatgtgaataacttcaaagttttattctaatcctcctgttttgaataagttacagtttataaaaatagccacagtcatttgtggctattttctttatttatttcgtttatatttgaaagattcaagcaattgattgatttgctcgtggctgaaaatttcgccgatagtacgacttaattttctacgccaattcggatattcattacttgttccgggaatatttaccggctcgagcatatttagccaatcttccggctgagtgccaaataaagcagaattggtatccgctacatacatttgtaattgatgtacaaattttaagtttacgccttcgctatcttttgcaagatcttggactttttcgaccgcttgtctaatcgcttctttattgaaatggcgactttgtttcagaatattaagcactttctcacttgggtaaacaccaaatttcttgcctaaatcaaagtcgtagcctttccagtagccttgtagggttggtaaatcatgcgtactgagtgtcgtcatcgcttgatatggataattagctaatggcttactgccgtgttgatcccattcaaaatagaaaatgttataagcgagaatacctttgtcttctaatttctgtagcatacctttcggtactgtaccaagtgcttcagcaatgattaaacactgatttcgctgactttctaacgcaagaattgctaacaaatcttctagcggataacgtacataagcgccgtttttagccgaatcgccttttgccacccaccacatacgtgcaaaaccaagaatgtggtcgatacgtaatgcaccgcaatctttcatattggcacgtaataaatcaataaatggctggtatcctctagcttgtagcacttccggatgcatcggtgataagccccagttttgtccgtttggtgccataatatccggtggtgcaccgacagaggcatctagcacaaataactctttatccgcccaagtttccgcaccgttatcggcaacgcctaccgctaaatcacggtaaaagccgataggcatattgagtgcttttgccaattgattacacgctcttaattgctgttgagccacaaattgcaaccacatatagaaacgaactaattggctatgttccgtttggaatgtctgtactgcatttgatgcgtagtcttgatattcttgcgcccagaaattccaaccccattgctcgctaaattggctggataaccaataatgtagtgcgtcgaatgtaccttgcacttttaggctttcgccgtattcattgataaattgttcgaaagcttgttgatcttgctgaacgaaagtggcataggctaaacgtaatccttcgagttttaagcccatcacttgcgaataatctacgtagtcttttgctcttgcctcaataagctgttgttgaacttctgcggaatgaaaccaggcttgcgcttcgctagattgttggaaggcatcaatcgctgctacatcgatataaataatgttttgccataaacgagatgaggggctataagggctggcactttccggattggctgggaaaatcgcatgaattggatttagcccaacaaaatcaccacctttttcagcaagtcgacttaagaaggttttcaaatcgctaaaatcgccgatgccccaattatgttcggaacgaagcgtatagagttgtaaaattgcgccccataatttttgtttttgttgtaattcttttggctggaaagcagttttcggcgtaataatcaggcggcagttcagtgaataatgctcacttttaagctgtaaatgatgatagccgagaggcagatctttcggtaaattgatcgcattacgttttactttaccgcaacgtatttcaccgttttctaagtgaagttgccagcgagcttgtaatgctttattgctatttgcaagatttagtcgaatatagaccgcttgtccttctgttgctacctttacaggaggaataataggtttgcttttaggagaacctaagcgttttgcaattttgtgacagaccgcttggctggcataacggcgtctgccatattcatcaaagaaataaggattaaggtatgggtgaagcgatttcattgtgattttccttttttgcttagtgagcatagcctcataagcggttattttttatttattttttgcaaatcggaggaggctcctccaatgttatccttttacgccaccggcagttaaaccaccgactaaccagcgttgtgctaataagaatacaagtgtgattgggatagcagacaagatggctgctgcggcaaagtcgccccagaggtagttttgcgggtgtaaatactgttgcattcctactgcaagcgtgtagttatcaacatctcgtaacaatagggaagcaaccggtacttcgataatgcttgagataaacgagaggataaatacaactgctaaaattggtacggaaagcggtagtaaaattaagcggaaagtttgccacgggcttgctccgtcgagggcagcggcttcctcaagcgatttatcaatagtttcaaaatagcctttgattgtccaaacatgcattgcgataccgcctaagtaagcaaagattactccgccgtgcgtatttaaacctaagaacggaatgtaatcgcttagacgatcaaataaggcatataacgcgactaatgaaagtaccgccggaaacatttggaaaattaacatcgatttcagtaataaacttttaccggcaaaacgtaagcgtgcaaaagcatacgcagcagtggttgaaagtgcgagggtaattagagcggtaatacccgcgactttgacggaattccatagccaaagtaaaacagggaatggcggtggggttatacttccgtccgcatgagtaacactaatgcctaaggcgagtttccagtgttcaagtgaaatttcacttgggatcaattcaccgattgctaggtttccgggacgtaatgaaataccgataatcatcagcatcgggaataagataatcgcacaaaaacagattagaaaaagatgcgtggaaaataaacgcaatttcattgatttaggttgaacaatagccatagttgatatcctctttgctccttcttcgtatgtagaaggaacaatgtcaattaatcttgtgataatttcgtcattctgatttggaataatgctaatccgcttactagcaagaagatgatgacggcgattgcagccgctaaaccaaagtcttgtgtaccgctaccttcaaaggcaatacgataagtgtaactgaccagtaaatcggtatgaccagccggtgttgttgtgcctaccatatttgggccaccgttagttaataactgaattaatacaaagttattaaagttaaaagcgaagctggcaatcattaacggcataagtggtttaactagcaatggcatggtaattttcgtgaaattttgccatacgcttgcgccatcaatcgcagaagcttcatataactcgtgcggaatcgcttttagcaagcccatgcaaacaatcatcatatacgggtagcctaaccaagtattcacaatcagtaacattgctttggctaagaacggatcattaaaccattccggacggataccgaataattggttcagaatgaggttgatttcaccgaaactttggttaaataaacctttgaagactaaaatcgaaataaagccgggtacggcgtaaggtaaaattaataacagacgatagaccgctttaccttttaatgcttcccattgtacgagcgaagcaaaaatcataccgagtaaagttgtaaaaatcacagttaaaagggcaaatacgacagtccaaataaagattttaatgaatggttcttgaacaccatcatcagttaagattttgacgaaattttgccaacctactgaaacggtataacctggttctagtcgattgcctgtaaaattaccttgttcgtcaataggttggaaaaagccgatatcatcattcggtttatagcgttcaccactctcattattcgttaagatctgattttgttcatcaaatgtatagcgtgttttttgttcagcaaattggcggagagaactcatcgtaacgatttgttcgcttggtaataatacttttattgcttgtaatttagttcggttttgcgtaattgtttttaaaggggcaaccgagatgttagggagctgctctacttcagttacagctaattcagcagggagggcatccaatacaagcggttcagaaagataatttttttgcgaattagggttacttaatgcaagttgatactgattttcattagtttgcagcaatttaaaattcagatgatcgcctgctgcgtaagtctgattttgtaattggcggacgacttgtttaaagttaagttgattggatccgctataatttgtaaaggcgataacgacagtacagattaacgggaataacacaaaaatccccatagcagaaacgccagggtaaacatagcgccaacgataagttgattgatttgaaaaaatatagatccctgtggtcacaacaactaaaacaagtaaggcaaagagaatttcgccttgtagataaatggtgaacacgaggtagaaagaaagcagatagagtaatccgataaatagacgtttagcccaaagttgagaagggggcattgtatttgatgttggcatagtgtttcccctgtaaattgataagctggaggtataggacgcctccagtaggcgtcctaacagtgaggttagcaaaagttattctttttcaatttttgcctgtgcttcatcaagtgctgcttttacagattgacgaccgcttgtcgcattgccaatagctgctttttctgaataccagaaacggctcatttgtggaatatttggcataatttcgccgttttccgcattcgccatagttgctgcgatacgaggatctttggcaagtttttcttggaaagattttaatgcaacggcacctaatggcgcgtctttgttgacggttgtgagtccttcatcggttaataaatgattttctaagaactctttggctaagtcttggttcggactagaagcatttaccgctgcacttaatacaccaacgaatggttttgatgctttaccatttaatgtcggaagtactgcgacaccatagttgataccacttttctcaatatttgcccaagaccatggtccgttaatggttaaagcagtattgcctttattgaaagccgcttctgaaactgcatagtccatgtcggcattaatcacttttttattcactaaatccacaacaaattgtaagcctttttgtgcaccttcattgttgacaccaatattttttacgtcataaccatttggtgtaactttgaatgcataagcgccttgagacgaaataaccggccatgtgaaatagggttcttgtaagttccacataatggcacttttacctttagcttttaattctttatcaagtttctctacttcttcccatgtttttggtggtgtcgcaactaaatctttattatagattaatgaaatcgcttcaatcgcaattgggtaagcaatttgtttaccgttatatttattcgcatcccaaccgatgtcagataattttgctttaaattcagcacttggttttacttcggctaataaaccggcttgagcatagccaccgaaacggtcatgggcgaagataatcacatcaggaccgtcaccggttgaagcgacttgagggaaaagttcttctaattttcccggatgttctacaatgacttttaccccagtttctgcttcaaattttttacctacttcagctaaaccgttatagcctttatcagcactaatccagatattgagttgaccttctacaatttttgcatttgcaccttgagcaatacaaagtcctgttaatacagctaatgcagttttagtaagttttttcataggattttcctcatttgattttggagatagaccgatttccagtcttttacgtagagcataataaaaaatttactcatcatttcatcatcccccatcctcctccccataaccgaatttattgatgtagttcacagattttggggaaatctcagttttttgtgaaacagatcacaaaatttcaggtgttttttgtgatcagattcacaaaaaaacaagaaaaaatgtaataaaaacattgagttgcggaaagaaaaaatttactaaaagtatgatgtggaaaaaagagaaatgcgtaaactacataacaaatttaaagcaagaggacaaaaacatgacagatgttcgattagtaaacgtatgcaaatcgtatggcaatgtacacatttctaaggatgttaatttagaaattaaagacggcgaatttgttgtttttgtcggtccgtcaggctgtggtaaatcaaccgtattacgtatgattgccggcttggaagaaattacctccggtgatttatttatcggggataaacgaatgaatgacgtaccgccggcgaatcgaaatatcggtatggtattccaatcttatgcattatatccacacctttcagtcgcagaaaatatgtcattcggcttaaaacttgccggtgctaaaaaagaagaaatcgatcagcgagttaatcaagtcgcggaaattttacagcttgctcatttacttaatcgaaaaccgaaagaattgtcgggtggtcaacgccagcgtgttgcgattgggcgtaccttagtttcacagcccgaagtgtttttattggatgaaccgctttcaaatttagatgcggcattacgtgtgcaaatgcgcgtagagatctcaaaattgcataaaaaacttggcagaacaatgatttatgtcacacatgaccaaatcgaggcgatgacactcgccgataaaattgttgttttacaagcgctttctgcaggtagcaatctaacaaccaacgttgctcaagtgggtaaaccattagagctttatcactatccggcaaatcgttttgtggcaggttttatcggatcgcctaagatgaatttcttgccggtacgagtgattgatgtgcgtgaaggtggagtgaaaattgaattaccggactcaacccatttaaatttctgggttccggttgaaagtggtggcgtgaaagtcggagacaacctttcattgggtattcgtccggaacatttattaccgtgtgaacaaagcgaagtttgtatttccggcacggtaaaagtggtggaacaattaggtaacgaaacgcaagttcatattgaaatgccaccgattaaacagagcttagtttatcgccaaaatgacattgtattagtgaaagaaggcgattcaatgtcgattggtattaatccgaatcgttgccatcttttccgagaagatggcacggcatgtaaacgtttatttgtcgaacaaggcgtataaatgttcttaagggtttcccttaaattttaataatgaaaaaaactgtctgaaaagagaaaggagtttcctatgaacctcaataaaacgatgttagcaactttagtttcaagtgctttactttcaaccagtgcattagcggttgatttccacggttatgcacgttccggtatcggctggacttcaggtggtggcgagcaatcggcatttactgtgaatggtggcggttctaaataccgtttaggtaatgaagcagaaacttatgcggaattaaaattgggtcaagaactttataaaaatggtgagaaatctatttatttagataccaatgtagcttattcggtaaatcaacaagttgactgggaagcgacggatccggcacttcgtgaagtgaatgttcagttcaaaaattttgcagacagcttaccgggcgctactttatgggcaggtaaacgtttctaccaacgtcatgatgtacatatgaatgacttctactactgggatatttcaggtccgggtgcaggggttgaaaatattgaccttggttttggtaaactctctttagcagtaacacgtaatactgaaaaagatggggcatatagctggaactataatcctattactaaaaaatgggaaagcagccaagataaaaataaagacgtttataacgatgtattcgatgttcgtttagcaggtattgaaactaataaagacggatctttagaaatcggtttcgactttggtaatgcacatactaaagatggtgcaatctatgaaaaagatgcaactaaacgtggctatatggcaactattgagcacactcaaggtaactttttcggcggttttaataaatttaccgcacagtatgccaaggatgcaatgacatcatggagtaccggtcattcacaaggtgggttagcgaataataaaggcgatatgcttcgtttaatcaaccaaggtgttgtacaagcaagcgataaagtagaagtaatgtatgcgttaatctatgaaaaaacagacttagataacaaacaaggtaaaacttggtactctgccggtattcgcccgatgtataaatggaacgatacaatgagtaccttattagaagtgggttatgaccgtattaaagatcaagcaagcggtaagaaaaatgatctagtgaaatacaccgttgcacaacaatggcaagcgggtagcagcatttgggcgcgtccggcaatccgtgtattcggtacttacgcacactggaatgacaaatttaacacggcaaaccgtacaaacgctggctataaagcgaaagacggcgaatttatcggtggtgttcaatttgaagcatggtggtaattaaaccatttgggggcgtatgcattacgcccctttatatgatgtaacagataatttctagagaggcatttatgaaaaccaaaattgcagcatttttatcaagtgttttatttgcatcggttgctatggcagctacgccatcaaaaacagagctaagccgttttggttggcaagatgttactttctcgcaaaagattgttaatgaactttcagaaaaacaaattcgtacatttagccaaacactagcaggtacaaatagcgctgtagtcggttataaaattccggcaaatcaaggcacggtgaagatcaaaatcagcagcttagtggtagataataaacatatttttgtaccgaatgttttagttctggatgcgaattttaatgaatcgctcatataccccgcttcgcaatttaaagttgtggaagaacgaggctttgaaggcgggcaaattcaagcggaattaagtttaacgccggcaaccggacaagattttatttatgtactaatctacaccactgaaaaagagcttgcagggcaaacgacatttacccatccggtaaaattatatgaaaaggcaaaaggtaaccagccgcctgcaattgcagatttacaagtaaaacacactaattcagggcaaattcaaattagtgtggatggtgttcagagtactcaatttgtcggtctaggtaatgtagctaatggcggagcgttatttgaagcgaaaccgactgttagtcaaacggtaggagcggaagtacaagcggttaaaaatccgcaaaaaaatgcaaaaccgaaagctgtagagaaaactacagaacaatactttaatgaagcggttacacaagcattaaaaaataatgatattagtaaagcaatgaatttagtaaacgaagcggagcaactagggctttcttcaccgcgtcaaatcttcttaaaacaagtttctgctaaaaaatagatgttttttatctttatccttttgccactgaattttcagtggtttttttatttccactaactaaataaggagaaaattgttagaatctccatatcgtatgtaatggaggaaaaatgcaagcaacattttcaagattgattccaactaagctaatttctagtaaagtcaatcgaaccgtcaaagagacagaaaccgttgaacgaacattactcttaaatgaattaaatcgggcggaattttacccgatgacgctggttattgcaccggcaggttatggcaaaacaacgctggtttgccaatggaaggaaaaacaattagcgaaaaaccagcgtatcggttggtactcacttgatgaaagtgacaacaaaacagaacaattctccgcatattttaccgctgcactttcgcaagcgaccgacctctctttttccggaattgtttaccaaaataatttggtagattatttctctcagttattgattcagctttctcaagtgcgtagccatttttacttagtgatagacgattatcaccatattgaaaatagcgaaattcacgatgcacttcgtttttggttaaagcatcaaccacagacgatgagcctgattgtcttatcacgtttaactcctccactaagtattaccaatttacgtattcatgagcaattattggaaattgatgtgcatcagttggcattcacaccgaccgaaactcgccaatttttagcgttaaaatttaacgagtcgctgacagatgatgaggttttctcactttgcgatcgggttgaaggctgggcaacagcattgcaattagttagttttgctgtgaagcaaaatcctgaattgttacgttctccggaaaaattatttgccaagctcaatcaacaacatattgccgattatctgaatgaagaagtattccattacgttgagccggaaattaagttatttatgcaacgctgtgcgattttacgttcgatgaatgaaaaattgatactcgctttaaccaaagatgaaaacggtgtgaaaaagctcgatgaattagaaaaaatggggctttttattcaaaggatattgcacgacgatggtgaaatttggtggaaatttcatccgattttagcatcttatcttgcgcaaagttgtcgtttagaactgccttgtgaatggcaagagctacataaaattgcagcgatgatgtggctgaaattaggctatggatccgaggcgctttatcatgcgcagatgttggaagattctcaaacgctttataccattttacaagaacatggttggtcgttatttcatcaaggtcagcttaagttattggaagactgtttggcattactttcagcgcagcaactttggcaagactcaaacttagtgctgttaaaagcgtggcttgcacagagccaacatcgtcatcaagaagtgtcgggcattttgcaaaagtttcaaccaaatcaaccgcttgttgccgatttacaagctcgttttgatgcactaaaagcacaggttgcgattaatgagggcaatgatgagcaagcctataatttagcaaaacaggcgctggttcatttgtcgtctgattttggttatgcacaaattgttgcaaattcgattatcggagaagcgcaacattgccggggttatttgaaagaagggttggctcaaatgcagaaagtagaaaaaatggcattggagcaaagggcctatcatcagtggttatggtcgaagctgcaacaagcggaaattttatcggcacagggcttttggcagtctgcctatgatttgctaaaagataccactttacaagcgcagcatttacaccaaattccgatgcatgaatttctattgcgtttaaaaggacaaatcttgtgggaatggcatcatttagatcaagcggaagcgatggcgaatgccggtattgaagtcttagaaaaagagggcgagcaagcgcattgtttggcattgttggcaaaggtttcgctgactaaaggcgatttaaataatgccggacgtttgatagaacaatgtcgcaatttaattattgctcaggcggtgcattgggattggcgttcaacttttgacgaagtgcaaatgctgtattggcaaatcagtgatgataagtcgcatttagaaagctggttgacgcaagttagttttccggaacaagacaataatcactttttgcaacgtcaatggcgtaatatcgctcgttgttatttgctacaagataactttgaacaagcgttgaatattttgaatagtctgttacaaacttctgcaacctttaatttaattagcgatacgcaacgagcgctgattttgcgtaaccgagtgttttatcgccaaggtagaatggatcttgcacaaaaagatttgattcgagcgttaaatctaacccaacaaaccaattttatcagtgcttttgtgattgaaggcgatttgatggcacagcaaattcgccaattgctacaaatcaatgtgttggatgagctttcgacccacaaagcacaatttattttacggagtattaatcagcacaatcgccataaatttgcgcattttgatgaggaatttgtcactaacttgttgaggaatccacaagtaccggagttacttaaaattagcccgcttaccgcgagagaatggcaggtgctcggtttaatttattcaggttacagtaacgaacaaatttcacaggaattggtggtagcgataactacgattaaaacgcatattcgtaatctatatcaaaaaatcggtgtggcgaatcgtagtgaagcgattgaatatacacgcagtttattgagaatgatggggtatagctaatttaaaaaaatactcccactagtgatacccctcgcccacaaggggcgaggggtatttctttcgttattttttccaaattctggtttggtaatcacgaattgagcgatctgagctaaagctgccgagacgagcggtattcagaatcgtagattttaaccaagcggtctgattttggtaacgttttgcaacttcttgttgtgcttcacggtagctggcaaaatcggctaatacgcagaaatagtctttgtttagcaaatcataaaccaatggttcgaagatttcttgattaccgccggcaaatgagccgtccgctaatgcatcaatcgctttacgtaatacttcgtcttgttcgtagtattcacgcgatacataacctttctctcgtaattcacgtactgattcaactgtatgaccgaaaatcacgacattttcctcgccggcaaattcggcaatttccacattcgcaccgtcaagcgtacctaaggtaatcgcaccatttagagctaatttcatattaccggtaccggatgcttctttacctgcaagggaaatttgttcggaaacatctgccgccggaatgattttttccgccagacttacactgtaattaggtaaaaatgccacttgtaatttaccttgcatttccggatcgtgattgatgacgtgcgccacattattaatcgcttgaataatttgcttcgccataaaataacccggtgcggctttgccggcaaaaataaagacgcgcggcacaaatggcatatccggattggctttcagctcttgataagtggcgataatattcaataaattgaggtgctgacgtttatattcatggaagcgtttaatttgtacgtcaaagatcgcattttgattcacttggatacccagtgtttcctcaatcacttgtgccagcgcctgtttattttgttgcttaatctcagcgtaagcggtctgaaatgccgaattttctgcaagcggttcgatttgacgtaacagctctaaattttgtgtccagtcgccttcgatgtgttgatcgagtaatgcgcttaataacgggttagcttgacggatccaacggcgtggggtgataccgttcgtcacattgtggaatctgccgttaaataatttagcataagcaggaaataaatcgctaatcactaaatccgagtgaatttgtgccacaccgttaaccgcaaatgaaccgaccacgcaaaggttagccatacgcacacgattattggcgatgattgccgtttcgtcccatacgttggctaattcatcttctgtaaagcaagctttgacttgttggtaaagctcaagattaatgcgttcaatgatgatcaaatgacgaggcaataatttagcaacaaggttttgctcccattgttctagcgcttccggtaacagggtgtggttggtataagcgaatacttttgaacagattgcccacgctttttcccaactgtaaccgtattggtcgagtaataaacgcattaactcaggaatcgcaattgcggggtgggtgtcatttaattgaatcacttcaaattccgctaattggtcgagagttctgcctttagctaagtgatttttgataatatccgctaccgaacaagcacaatggaaatattgttgcattaagcgtaattctttaccgttttgatggttatcgttcgggtaaagcactttggtaatttttgacgcatcaattaccattgattccgaatctaaataatcgccgtcattgaatttggctaaatcaaaagcggtttcactacagccttgccataagcgtaacggttgttgtacgcctttataaccgactaccggtaaatcaaacgcttcaccgtaaattgtccatgccggttgccattcgtatttatcgccggcaatatgacgaacttcaccggcaaagccgactggttggcggaaatccgcacgatgtgactgtaaagggaagaaatcacgtccccacgcatcgccttcttcatgttgtctacccgcccaatcaaagctttgtttgaataagccgtattgataatgtaaaccgtagcctactgccggttgagcaaggcttgccattgagtctaaatagcaggcggctaagcgtcctaagccgccgttaccaaatgcaggatcggtttcttgttctaaaatatcgactaacgttttgccgtatttcgccacttcatctaccacatattgatatacgccgagattctgtaagttattaccgagtaaacgcccaactaagaattccattgaaaggtaattgactttgcgagtatcaacaagcggtgcgtttttcgggaaaaattgcaaagcggcttggtgcgcgacttgtgccaccagctgataccattgttgatcggataattgagttggatttaaagaacgttcttcgcagtaagcttgtaaactacgttcgaataatgctgaaaattgtgccgtgagcgccatacattttctccagaatgaaagtaagaaatttttcgctattatcaaaaagccactaaataaaaaaatcctccccgctaaaattagtcagggaggatttagtagtaggactagcttgagtgctgttctgtcgcgtttttatcttgtgattttgttgatttcggttctttttccggatcgaatttcaccaccggcacgcagccacggcaagcaccttggtttacaccgagttcttcacaaaatttatcgtatttcgccagcatttttttgaaccagctttgtgatgtatctgacgatttaccagacatagttcacctcatcaaatttgcaaaaaaattgcaaaatttaaccgcttgttagtcgcggaagttattaaattggaacggctgaccaagttctgcgccttttaccagctggattgccgcttgtaaatcatcacgagatttgccagttacacgtacttgctcaccttgaatttgggtctgaactttaatttttgaatctttgatcaattttgtgatcttcttcgccatttctgtttcgataccttgtttaagtttaatctcttttgagtagagtttaccgtggtgttccgcttcacttggaatatcaagtgagttgtgttcgataccacgttttacacaagaaccgattaaaatctcgattaattgctctaattggaaatcagattcggtggttaatttaatgctttcgtttttttcgttaagctcaataattgcttcaacaccacggaagtcataacgtgtgcttaaaacacggttagcattttcaacggcgttacgcacttcgtgcatggtaatttcagaaacgatatcaaaagatggcattttttattcctcattattgaaaactacggctaacacagcttgcattagcttagttggatgatacatagagatttttcgcattaagcagcacgcacaatgcgctcaagtcgccaaagtttatcacaaatttcgcctgttcttgaacttttggtttagcgtgcagcgcaaccccgagggtagcggttttgatcatcggtaaatcattggcgccatcaccaatcgctacccactgagtttgtggaatattaaattgttcgcccaacttggttaaagtttccgctttatattgtgcatccaccactttacccagcacgacaccggttaactcgccgtcaataatttctaactgattcgaaactgcataatccaactgatatttctcttttaaataatcagcgaaatagtcaaaaccgcccgaggcaattgcaagtttccagccgtatgcttttagctcgctgaccatttgttcaaagccgtccatcagcggtagcttttctcgtacggtttgcaaaatactttccggtgcattttccagcgtaccaactcgtttacgtaaactttgctcaaaatccagttctccacgcatcgcacttgcggtaattgctgagacgatttcaccggaacccgcgagcttggcaatctcatcaatacattcgattttaattgcggtggaatccatatccataaccaataagccggcttccgcaagattcggcacaatcgctaaatccgccacatctgctgctacttggcttgccgcttcacgtaactcgcaagcggtcaaatttgtttcaaaaaatgcaaggctatagcctaaatagaccgcttgttttaacaattttgcatcggtttgtagtgagaattgctgaatttgctgttcgcttagttgcttggcaaagataaaaatggtgtttggcatagtgttctctttttaatagacattttggaattgtgcatagataatgcgtatttgaattatctattatcgactatttattagcaattaatctatgtatttaccccgtgaaaaactcgtgaaaatcggtttacttgccggaattagcgcattatgtgtaatggttgtgagtgtgattttaagcggcgttaaccagtttaaattaggttcacaactggcgagtgttaatcaagtttccaacctttcgcatttattagtgcgtcaacaagcgaatttgttttcgttgatgttagtgaaaaatgtaaaaaacgaagatttgatcgaagcattagacacgttttcgaaagaagattttgtaattgatgccagtttgtattcaccgtcaggcactttgattgcccaaagccataatgctttagaatttaaatcgttacttaagcaagacaagacggaagagaatgctcagcaactagcaacccaacaaatcgtagagccgattttttctcagcaagatttagtcggttttttgcgtgtgacatttgatgcggaatatgggcaaacgaccaaaagtaaagtggagcgcattttccatcagctatatggccaactgattattttagtcttggcaggcatcttgcttgcaagtagttaccattatttcttccgtcgtaaaagcgtggtgattcattcatcggttaagctgccgacaaccacgactaagactcaaacccaacgttttcattcacgtcgccgtacatttagacgtaagtaatcgcttggaaatgattgtaatttaggctgatgagagtataataaaccccgtttttttatttatatccaaaccctaatttaaagaggaatcaatggctaaagaagattgcattgagatgcaaggtacaattttagaaaccttaccaaatacaatgtttcgtgtggaattagaaaacggtcacgttgttaccgcacatatttcaggtaaaatgcgtaaaaactatatccgtattttaaccggtgataaagtaacggtagaaatgacgccatacgatttaagcaaagcacgtattattttccgtgcacgttaattgaaagcttaaaacaaaaaacggaagttgagaaatcagcttccgttttttgttttatcccgtttggcttgaggttgttttattgactttgagtaatattattcttccaagccaaatatccgtgttctcagtgcattccgtggtttataaatactatttttcaataatcgcttccgcacaagcaaaagcggacgaccacgcccattggaaattatagccgccgagccagccggtcacatccaacacttcaccgataaaataaagaccttcggtatgtttcgcttgcattgtttttgacgaaataaaatcagtatctacgccacccattgtgacctcggcggtgcgataaccttccgttccgttgggtaaaaattgccaatggtgaatcagttgatctaactgagctaattccgttttgcttaactgagcaatcacattatctttgaaatcaccttgttccagccaaagctcgactaattttttcggtaagtaacgacttaatacggtttttagctgtaatttcggcgaagattgacgcaattcggttaagattgttgaaatgtcatcagagggtaacaaatcaatttccaccgtttcacccaagtcccaataattagaaatttgcaaaattgccgggccggataaacctcgatgagtaaacaacatttgattactaaaactttgctgcccacaagtggcgcgaatcggtaacgcaatgccggaaagtgtcgcaaaatgtttgtccgagtctttccaagtaaaaggcacaaggcttgctcgtggcggaatcaccggaatattgaattgctcggcaattttataaccgaatgggctagcgcctaacgctggcatagataagccgccggtggcgatgactaaatgctcggtttcaaaggtttcactagcggtctgaatttggaaattttttgcaaatttttcgacagaaatgaccgcttgtcgtaaaaagatttccactttgcctttgtcacattccgcttgcagtaaatcgacaatttgctgcgagctttcgtcacagaataattgtcctaattctttttcgtggtagccgattccgtattgtgcgactaaagcgataaagtcccaattggtataacgagccagcgccgattttacaaagtgtttattttggctgaggtaatgattcgccgtaacctctaaattagtaaagttacaaaaaccaccgccggacattaaaattttacgtccgatctttttacccgggtctaaaacggcgactcgtttgccggcttgtccaagttgtgcggcgcaaaataaaccggatgcgccggcgccaatgataacgacatcaaaatgttgcattagaaatttaataccttgtctgcttcgattgtccaatccgccagttcaattaacgtaccgatttctacaccgtctgccagtggtaattcagtaatgccacgtgcattggtacaggttttgcaaagtttaacggttgcgccctgtgcggtgagaatttccagcatttgttgtaggttgtagccttccgccggattttgttttttcaaacctgccgtgacggaatcggacattaagaataatttgatttgagctttatgctgttcttgaatttgtagcgctaaacgtaaaccgctaaataaagattcattgccgtaaggcgctgagttgaagataaagaggagtttttgcataagtgttcccttaaaaagacggaatacacaaaacaagcggtctaattttgcatattttttaccaaagttgctgtttgtgtattccgtggttaagcgttattagccaacccaaacaaattttgcgataaataataatgatactaccgcaacagatggattgatttctttccaacgaccggtacaagctttcatcacacaatatgaaataaagccgaatgcaataccttcggtaattgaataagtaaacggcatcattgctgtcgtgataaacgccggagtcgcttcggttaagtcatcccatttcacttcaattaaacttgaagccattaaaatgcccacgaaaactaatgcaccggcagttgcataagccggaacgacaccagcaagcggcgagaagaaaatggttaataagaataagatacctacggttaccgcagttaaaccggtacgaccgccaacggatacacctgagccgctttcgatataagtactgattgccgatgttcccataaatgaacctgccattgctgcagtactgtccactaataacgcttgtttcatacgtgggaagcgaccttgttcatcggcaaaaccggctttggtggttaccgcaattaatgtacctgatgagtcgaataagtttactaacataaaagagaaaataatgccgagtaaaccgacatctaacgcaccggcaatatccacctgaccgactaccgcatctaaacttggcggcatagacattacaccgttaaaacttaccgcagggtcaaagatcaacgctaatgcagtgactacagcgatagaaataagtacgcctgagtgaatgccttttgcggctaacaccacaataataaagaagcctaagatgcccattaatacttttggatcgtgcagatcgcccagcgcaacaagtgttgccgggtttgctactactaagcccatatttttaaaaccgataagggcgataaataaaccgatacccgcaccgataccgacacgtaaaccgagcggaatggcggacataaaccaataacgaatttgtaaaacagttaataagaataagccgactgagcctaagaaaattgcgcccatacccacttgccatgagtaacctaatttttgtactaccacaaaagcgaaaaacgcatttaagcccattgccggtgcaagtgcgataggaagattactgaataagcccatcgcaatcgtaccgaatgcagcgattaaacaggtggtgacgaaaaccacttgggtatccatacctgctacaccaagaatagacgggttaacgaacacgatgtaaaccatggtgaagaaggtagtaatacctgccacgatttctgttttggcattagagccttttgcggataattggaacaaacgttctaacataaaaacctcaaataaaaagaaagaaaccatggaacagaaagcgatacaaggcgcaaacacaaccttttatcgttttgttccatggcggataaaattagtattccaacactaagttgagaagttgaacggctaagaatgccaagctgaatttttgctcgtcagcaaccgaccagaattgcacctcgttttctgattttgtgagtaattggctgatttgaagtaagttttcttcttcattttcaccgtttttaacaggtgtcatcacgctttcttcgtggaagcgtaaccaattttgttgttgccattctgcgctaacactctcaacgtctaattgatattccgaatgtaaggtgaccatttgtgaaataccgtaaaagaccggtgtttgcaccgaatggaaagtggtagaagcggttaaatttggtaaaacttttgcaagttgtaattcaaagacacgagagaacggtaagtttttctcttcgccttgcacatttgccggcacggtatcaaatgcgatacgttctgcattttcatcaaacggaataccgtttaacaaccgagcggtttgaccggcaagttctttaactttttcatcaccgaaatatgctgccggtagcaatgaggttacaaaaatatggcttaacggctgagctaagaatggtttgagggttaacgctaattgtgaaatttgcgggttagccagtgccacgatattacgttcacgtaagtttgcgatcgcttcgtcatttacgcttggcacgaccactggcacattggcaattaatgcagtgatgccgtaaagatcgagtacgatacaaccggcttgcactgcttgtgccaaaatttcggcttgcgccatttttccggcaaagaaaacgtggctgaaatccgcccaatttacttcatcaatcgcaatttgctcgatcgctttgctgcccatataaagtgattgttcttcaccaaacggttcgatttcgatcgcagaaatattgtctaaacgcaaatcactctctgctagtgcttcaagtaactttgatgacaaggtaaaatcagcggcaatagctaaacggatatcggatgtaattgaattagacataggtgagttgctccttttttatacgcttgatttagcgtaacgcacacacaaagggagtaattgtacaatatttttaagaggaaaaactaatgaccccagcaataaatttattaaaaaacaaaaaattgcacatacgcttcatccttatgaacatgatccgaataacactaatttcggccaagaagcggtggaaaaattaggcattgatgctaagcagacatttaagacattattagtggcggaaaacggtgatcagaaaaaattagcggtgatggttgtgccggtttcgcatacgctaaatttaaaacgtgcggcgagtgcgctcggtgtgaaaaaagtggaaatggcggataaagatatcgcccaaaaaacgaccggttatttgctgggaggaattagccctctaggtcagaaaaaacgcttaactaccgtgattgatagctccgcacaacaatttgtcacgatgtttgtatcaggcggtaaacgaggcttagatgtggaacttgcaccacaagatttggcaagtttgctcaatgcaacttttgccgatattaaagagtaacaagcggttgattttgggtggaattttgcaaagcaaacacaaatctacgctttctgaaaagttccgcaaatccaatgtaaatttagggcgtgcaatttccaagactaaattagtatggtatagttcacacctcattagttagtagcgtctcattctcaattagaatgatctattggaatgataggcaaatatctctcgtgtggaacaaatggcaaaacaggatgcagattgtataacgctagatctgttcgcaaccgtgccaaaagttgggcgaccacgcactaatcctttaagtcgggaacaacaagttcgaattaataaacgaaatcagcttaaacgagatcgctcgtccgggcttaaacgtgttgaattaaaactacattcggacttagtgcagactttggaagaggaagcttcccaacgtggagtgacacgcggacagttaatcgaaattattttaaatgattatatcggcaacaatttcgccgacttagaaaaataggtaaattcaaatggcagtggtaggtttattctacggtagcgatactggtaacacagaaaatatttcaaaaatgattcagaaagaacttggtgcgaatttagtggatattcgtgatatcgcgaaaagtaccaaggaagatattgaggcttacgatttcttattattaggtattccgacttggtattacggcgaatctcaagcagactgggatgactttatgccgactttaaaagagattgattttagcggtaaagttatcggtatttttggttgtggtgaccaagaagattatgcggaatatttctgcgatgcaatgggaactattcgtgacgtagtagaacaaaatggtggagtgattgttggtcattggtcaacagaaggctatagttttgaagtttcacaagcgttagttgatgaaaatacattcgttggtttatgtatcgatgaagatcgccaaccggaattaaccagtgagcgcgtaagccgttggtgtaaacaacttactgaagaaatgtgcttagatcaattagcatagtaattggatagacaaagggtgacagttatgtctgaagagaatacaaaacttcttaaaagtgttggcttaaaagtaaccgagcctcgcttaaccattcttgcgttaatgcaacaacatcgcgatcaaatgcagcacttttctgcagaagatatttacaaactcttattagaacaaggttctgatattggtttagcaacggtttaccgtgtattaaaccaatttgaagaggttggtattttacttcgccataactttgatgcgaacaaagcggtattcgagcttaacgtagagcaagaacacgatcatattatctgtatggattgcggtaaggtatttgaatttaaagatccggatatcgaacgccgtcagcgcgaaatcagtcaacaacatggtatggaattagcgactcacagcttatatctctatgctaaatgtaatgacattgcgcattgtgattcatcaaaagataaaaaataattgattttgaatccgtgaaatcggtagatttgtatggatctctagcaaaatataccgaaggtttttgaaaccttcggttttatgctatctaaaggatgctaaaaatcgcttacaagcggtcatttttagtttgttttttacgaaagtaaaccactaaagttgtcgagataaacgatagatatgacagatgaaaatgctttaagctccgtaccggcaaaggtgcgtcagcctcgtaaaatttcgccattttggttgttaccgattgttgcgtttgctatcggttgtttgctcttttttcagattttgaaagaaagaggtgaaacaattacgattcgttttaacgaaggggatggcattactgccggtaaaacggtgatccgttaccaaggcttacaaatcggtcaggtaaaaaaagtatatttcgtagatgatctgaaaaaagtagaggttcaagctgagatcaatccggaagctaagagtgtattacgggacgatacaaaattctggctagttaaaccgagcgcctcaattgctggtgtttccggattagatgctttagtttccggtaactacatcacgcttttaccgggtgaaggtaaaagcgcgaatgaatttattgcagaagaagagccgcctgcggtggcggtaaccgacggtgatttattggttcgtttgatctcgaatgatttgggatcgattaccgttggggcgagcgtttacttccgtaaagtgccggtcgggagcattgctgattaccgttttaccaatgatcagaaaaaagttgaaattgatgtcgtgattgataaaaagtatgccaatcttgtaaaacaaaattcgcatttctggaatataagcggtattactgccaatgtcggtcttggcggtgtatcggtgaacgtagatagccttgcctcagttgtacaaggggcagttgcatttgattcaccggatgattcgttacaagcggaccaaggacaaaagtttcagctgtacgaaaatttaagttcggcaaaacgaggtacggaagtaaaagtaactttaccgattatgccgaatcttaaagtgaatgaaacgccggtatttttccagaatatgcaagtcggtgtgctatcgaacttagagctttcagtccctgttgataacgaaaatacacaaacaaaagctgaaaattcgcaagataaaggcgtgatgaaaggtacattattgatcgatcctaaccacgtcgatttattgcgccaaggcagtaaaattttactaaaagagcctaaatttaatttaaataaagagcaaattagtaaaattaatgagcttttccgtggtctgtattttgatatagaagctggcaaaggtgagcccaaacttgaatttgaagtgcagaaagaagcggattatttactttctcgcccgaatttactggcgttaacctttactgcaccgcaatcatatagcgttgatcaagggcagggaatttactataacgatgtacaaatcggtgaattgctgaaacgtaagttaactttggacggagtaactttccaaggtattatttatccgccatatcgccatttagttgccggtaacagtaaatttgttgcgatttcaaacttagatgtatcggttggtttagatggaatgcgagtacaagccggttcaccgacggattggttaaaaggcggtattcgactattaacggacaaagcgcaaggcgaggccaaaaagcagtatccgctttataaagatgttgaaagtgccgaagccggtatcgttgatgatcataaaaagacaactttaaccttatcggctgatgatttatccggtattgataaaggctctgtggtgctttatcgaaatttccaaatcggtgaagtactgaaagtgcgtcctcaaaaaagtaaatttgaagtcgatttatttattgaaccggcgtatcgccatttactcagtgataagagccgtttctggattgagccggccgtttctgccgagctttctatgaaaggtttgaatgtacaagccgcaccacttatgcgcactttgaaaggcgcaatcagctttgataacggcggtactaaaggtgataaaaccttatatgccagccaagcaaaagcgacttcgggcaatacgcgtattaccttaattgccaaagatgcttccaaactttcaaaaggtatggacatcaaatatatggggttaactatcggtcagattgaatcgcttgagttacaaaatgtaaagaaacagataaaagcgaccgcttacattgatagccagtattatgctttagtggcgaaggaaggcagtcgatttagtgcgatttcaccggaaatcaccaccagcggcgttaaaaatattgatgcggcgttacaaaattacattaatgtcgatgttgggaacggcaatcgcaaaacgcaatttaatttaagcgataccgataccaataaaactatttatgcgaacggtttcccagtgattgttgaaactagtgatgcacgtggaattgaggtagatgcgccggtgctttaccgaggtatgcaagtggggatcgtcaaacgtctaaatctaagtgaattaggtgacagagtgatgattcacttgagtatcgaaagtagataccaacatttggtgcgtaataatactgaattctgggcggcttccggttataccatggatgtcagcttacaaggagtgagtatgaattcgggcaccatgtcgcagttattaaaaggcggtattgaattctcaaccccatcgggcagagtggtacagccgcaagcgaaaccgaatcgtcatttcttattacaacgtaagattccgcaagaagcgcctgaatgggatcaaggaatcgcagaataatttcagaatatggggtaattatcgttaccccctttaaattttaaattggagtaaaaaatgcctttattagatagctttaaagttgatcacactcgtatgaacgcaccggctgtacgtgttgcaaaaatgatgaccaccccaaaaggtgatacgattaccgtattcgatttacgtttttgccgtccgaatattgatattttaccggtgcgtggtatccatacgatggaacacttatttgccggctttatgcgtgatcatttaaatagcgaaaatgtggaaatcattgatatttcaccgatgggctgccgtaccggtttctatatgtcgttaatcggtacgccaagcgaagcggatgtggtttcggcatggactaaatcaatggaagatgctttacataaagtgccggatgtgtcaaaaattccggaattaaacgaatatcaatgcggttcttataaagaacattcgctggaagaagcgcatcaaattgctcgtgatgtgttagccaaaggtattggcgtaaaccgtaacgaagatttagcgcttgatgagaaattattaaatccatagtcattcaaaaaggcgtaatttttattacgtctttttcttctgcaaaatatattctaattttgacagacgcaccttgcgtcttttagttttttcaggaaagtaagatgttaaacaaaattttcagctggtttgaggcgagaatcgaaacctatccggaagatgcgcccagcacgccaaaagccggaattattccgtttatctttgaagcgaccaaaggtatgcgaggttatttagtcatgctaaccgtgttagttgcggcggtcgggattatcgaagcggtgctgtttcaatttatgggtgaattggttgactgggtagcaaaatattctccggtgcaactttgggcggagaaaagcggtagtattattgcaatgttttgcatcgctttgttagggattttatttgtttttttagcgagtagcatccgctttcaatcgttacaaggcgtatttccaatgcgcttgcgctggaatttccaccgtttaatgctcggtcagagtatgggcttttatcaagacgaatttgccggacgagtttcagcaaaagtgatgcaaaccgctttagccgtacgtgatgtgattatgacctgtgcggatatgttggtttacgttgcggtttatttaacgacttccagtgtgatcttattgcagtttgacggttggttgtttttgccatttattctatgggttattgcattggcggtgacgatccgcattttcgtcccgaaattggcggaagcggcacaggaacagtcggacgctcgtagcttgatgaccggtcgtattaccgatgcttattcaaatattgccacggtaaaattgttctcacacggcaaccgtgagtcggcgtatgcgaaagaatcaatgcaagaatttatggtcaccgtgcataaacaaatgcgtctggtaacagtcatcgaaacccttaccaatgcgatgagtatcggtttaatcgttgcaactgccggtattggtttatggttatggggtgcagaattagttactgccggtgcgattgccacttcaactgctttagctttacgtattaaaggcttatcgcaatggatcatgtgggagtttgctcgtttatttgaaaacttgggcacggtacaagacggtatgcaaacgctatcaaaaccgcatacggtagtagataaagcggatgcaaaaccgttggaagtcagcaaaggtgaaattaaattcgagcacgtcaattttgcgtatgatccgaaaaagccgttgcttaaagattttgaattaaccattaaagccggtgaaaaagtcggtttagtcggacgcagcggtgccggtaaatcgacactcactaacttgttgctacgtttttacgatattcaagacggctcaattacgattgatggtcaaaatgtacgtgatattacccaagagagccttcgctcacaaatcggtttagtgacgcaagatacttcgctattacatcgttcagtgcgtgaaaacttactttacggtcgtccgaatgcgaccgaggaagaaatgcttaaagcggtagaaaaagcggcagcggcggaatttatcccgaatctacaagatgcaaaaggcagaaccggttttgatgcgcacgtaggcgaacgaggggtaaaactctcaggtggtcagcgtcaacgtattgcgattgcgcgtgtgatgttaaaagatgcgccgattctgttattggatgaagcaaccagtgcgttggattcggaagtggaagctgcgattcaagaaaacctaaccgagctaatggatggcaaaacggtagtggcaattgctcaccgtctttcaaccattatggcgatggatagactgattgtgttagataaaggtgaaattgtggaacaaggcagccacgaagaattactggcacaaaatggggtttacgctaaactttgggcacaccaaagcggtgggttcttagctgaagatattcactaattcttcatacataacaagcggtcgaatttgcagaaaattttgcaaattcgaccgcttgtcatttatgcgccagtcattaaagctgtgctaaaaacggctgattaatcgcattcatttgtgccaatttaaaatctgctaatgcccagtaattttcatgaaattctagtggatttgggatcacaatacagctcatcgaagcggctttaactgagatcatacccgttttagaatcttcaatcccgacgcattcggcaggggcgattcctaagccttgtgccgcttgtaaatatactgccggatgtggcttgctataaggcagctctgcgccggaagcgatataactgaaataatcggcaataccacaacttttgacaatgttttctaacatatagcgtggtgacgcagaagcaattgcgatttttatgtcattttgtgcaagtaattccaaggtttccggtacgccattcatcagcggtttcgcttttaaaatattactgattgccgcatctaatagttcttgagcgactttttcgatatccaaaggcttttggtacaattcactggcatatcgtaatactggtacggacggcattcctcgagtacaggcaagttcttgttcggtaatcggaataccatagtgatgtaaaagatctaactctgtctgttgccataagggttctgagtcaatcagcacgccgtccatatcaaagataaatgcttttttcataatttttccttacttgtaaacatagtgctaaatattgtacaagatttaatcttttcgattgaaataattatttcatttcacttggcaatgatcaaaaagcggtgagatttacctgattttttacgatactaaaattagtatgttttatgctgaaaccgtgtgtacaatatagcttacgttttattaattagcttatttactaggagaaaaaatggcgattgtttctgttccggttgaaaaatcataccgtttactcaatattggcccgacaacgttagtttcggcaaaagcggataacattgaaaatgtcatggcggtggcttggtcttgtgccttggattacggcccgctttctaaggttacaaccgtattagataagcaagcttttacacgaggtttggttgagaaaagcggtttatttgcgattcaaattccggtagcaaaccaagcggaattagtgctgaagctcggttcgacttcacgtcatagcgatcctcataaattggataatgttgagattttttatcaagacggttttgatattccgttggtaaaaggttgcgctgggtggattttatgtgaattgatccgaaatcaagagaaccagcaagatcatgatctttttatcggaaaagtgttagcggcttatgccgatgatcgcgtgtttaaagataaccactggatttttgaccaagctgaaaatgacctacgtacgctacattatgttgccggaggacagttttatttgattggcgaaagtttggaagtgaaatagcgctttcatgctagcggctaatgactagctcgccaaaaagtagcataatacgccccttaaattttatcagtaggagagacaatgagcgataaattagccgcacctttaaccagtgaagaatttgagttacttgatgagctattattttcgtatgccaataaaggcgatgaagatgcgattttattaaacgtttcggaattagatggttttttaaccgcaattttatcatccgtaaatgtaccggcaatgacggattggttaccgattttgtttaataatgacgtgcctaatttagaagacaaacgttcgaagcaatttattgagttggtttctcgtcattacaattcattggcccaaacacttctcaacgacaaaaaagaatatcacccgattttttgggaagagcgtgtcggtcgccgtaaattagtggtcgtttctccttggtgtggtggctatattgttggcacaatggcggcaaattggcaaaatctctcagcagaaattcagccatattttgatttaatcgaacagcacgccaaatcaagctatgcggagcaaatgccaccgttggaagagcagcgcaaaattgaaaaagcgcttcgtaatgcggcattagctatttttgaacaggttaatgaagctgcaccattacttgaaaagccacaaccttacgtaaatcaaaataaagtgggcgtaaatgagccttgtccgtgtggaagcggtaaaaaatacaaaaaatgttgtatgaataaataatcactaagccgtatcttgttgtgcaagatacggctttttttgcaaaaaaagcggtaaatttaaccgctttcttttagaatagattaaagattatatttaggagaaaataatgaaagtgataaatgtagcgattgccggtgtcggctattccagccgagtttttcatgtgcctttttttaaacaagatgctcgctttcaaattatgaaagtttttgaacgtactacaaataatgcacagctttggttaccagaagtcgaaaccgtacgtagctttgatgccttattgagtgatgaagtggatttagtggtgatcaccacaccaaatcaaacgcactatgagatggtgaaaagtgcgttattagctggtaaacacgttttagttgagaagccgcttgtagcgagtgccgcagaagcattagaactagaacagttagctaaacagcaaaatgtggtgctatatgtttaccaaaatcgccgttgggatagccatattgccactgcaaaagaagtcttggctaaaaatttagtgggcgaggtagtggattgtgaaattcgctttgatcgttatgccaaaggtaaaaatgccaaagtatggaaagaagcgggcgatcgtggcactgggttagtttatgacttaggtgtacatttgattgaccaagcggtttatctgtttggcaagccgcaagcggtattcgccgatattcgttatcagcatgataaagcgttggtggacgataattttgatttacatctctactacgaaaacggtttaaaagttgccttacaagcgtctaaatatgcacgagaaccaagccctgcattcgtattgcatggcaaaaacggctcttatatgaaacaagcgacagacagccaagaagcgcatttaagcaaaggtgtgcagccaattggcaactggaatgcagagccggaaactgaatggggcatattacatacggaaattgacggtgaagtaattcgtaagccttacccgaatgctcaagccagttatcaaaatttagtggatgatttataccaagtactcacaacaagtgcagagccaatcgtaaaattagcagaagtcactttagttttacgtattatcgaagcggcatttgaaagtgcgcataaaggtcagaagattacgttataagtaaaacggaaggtttacaagcggttggatttgcaaaaaattttgcagattcgaccgcttttttttgtaaggtttcaattatatatcatgacttataacaacttcgtttaatgatagatttaaggatattgtatggaacagctctcagtagagaatttagtgattggttttggtaaagctggaaaaaccttagcgacggatttagctaaagcaggacaatcagtgattttggtggaacaaagtgaagcaatgtacggcggcacttgtatcaatattggttgtatcccttctaaaaaattattggtagaaggacagaaagggcaaaatgtggcggataaagtcactgtatttaatcagtcaatgacggcaaaaaacggcttaatcggtaaattgcgtaccgcaaattttgctaagttagatagccttgaaaatgtgcgtattattaccgccaaagcgagttttaaagacgaacatactgtgttattaaacggtcgtgacggcgaatttgaagtaggtgccgataaaatttttatcaataccggtgcgagttcaaatcgtttagcgattgaaggagcggatagcgcgagaatttatgacagtacgggaattctatctttaactgagcgcccggatcgccttgtgatcgttggcggcggttatatttcattagaatttgcctttatgtatcaagcatttggtagccaagttactattttagagaatggcgatactttcttggcacgtgaagatcgtgatatggcggaagcgatgcttgatgtattgaatcgtaaaggtatccaagtgcatttaggtgtgcaaacggaacgtttcattgaaaatgcagattcgactaccgtagccaccaatcaaggtgaatttgttgccgacgcggtattagttgcgatcggtcgccgtgcgaatacagaaggtttagcgcttgaaaatgccggtattaagctaaatgagcgaggtgcaatcattaccgatgaacaattacgtgttgcaggtaaatcacatatttgggcgatgggtgatgttgccggttctgcgcagtttacctacatttcattagatgattaccgcattgtgcgagaccaattatttgcagaaggtaaacgtagccgtgatgatcgtgcggtattcccgacagcggtatttaccgagccaccgtttgcgcatatcggtttaaccgaaagtgcggcacaaaaatcgggacgcaatgtaattgtgaagaaaatgaaagccgaaatgattccaaaagccaaagtattgggtcaaacagacggattgttgaaagccattattgatgcagatacggatgaaattttgggtgtaacgttattctgtgcagaagcacatgaaattatcaatctgtttaaaatggcgatggactacaaaattccggcaagctatgtcaaaaatcagatctttactcacccgacaattattgaaggcttaaacgatttatttgcttagttggtgaagaaagtaatgcctcatttgtaaaatgatttatatgttgttataaaaaacctgcactttaatttgtttgcttattaagcttaaccattaaagtgcagtttgtttttttattcagttgcggtaaaaaactcaatcaccgctttaattcgccctactttttggctgtgttgcataaagtaaagatataacgctccaaaactttgccaatgtttttctaatactggtacaaattccgttttatcaggctgaattgccattaatggttcaaaaaaacgcccgattcccaccccttgcaaaatagcagattttgccaccaccaagctattaacgatcatcggcattggcatttctatacgaatattttcccctttatcttgcaatgttaatggcataacacggttactggttgcaaagcgaaagccgatcagtttatgttgttgtaatgcattgagtgttttaggtaatccatatttctgctgatacgtttttgaagcgtaaatgcctaaccgaaatggttcagtcagctttttagcaaccatttgttcttcaacctgattaccaaaacgaaatcctaaatcaaatccttgtttcagaatatctaccgtgccgtcattgattgaaatttctaactgaatatctggaaattgctcggcaaattctcctaatctcggttcaatgaacagccaataagcaatatgtggcacggtcatacgaaccaacccttttggtttctcactcaaatcttgcacggtttccaccgccgtagaaagcgattgcaaggcatttttggtactgtcaattaagcggtgtcctgcttcggttaattccatttttcgagtggtacgattaagcaaaggtaaaccaacatggttttccagtaactttaatgactgacttactgaaggtgatgctatttgtagtcttcgtgcagcaccagcaattgagccttcagcgacaatagtgtggaaaacagttagtgcattgtagattgaactattcattgtgtgattttacctaagaatgaattaagtatttgctatcttatcattaaaaatgattgatttaaaataaccacactttcaacgaatagaggaactcaaaatgtatatcatcaacattgctgtaaataacaatgtaactgcagaacaacaagaaaaactttttgctgaacacgtagaatggtttaaaaaatacttccaagcaggcagatttttaatgcttgggccattcaaagatcaagccaacgctggcgtgatttttgctcacactgatagccgtgcggaattggatcaaattttagcggaagattgttactacccaaacttagccgactatgaaatccgtgaatttgagccaaaactcattgcagcaaacatcactgaatttgcaggaaaataaggatctcaacatgaaaagtgtgcttattgtttcaggacacccggatttaacaacctctatcgctaaccaagtgattttagatgaaacggcaaaattattgccgaatgcggaaatccgaaaattagatcaactctttaaaaatggtacgtttgatattgctgctgagcaagccgcagtactcaatgccgatattatcgtattccaattcccattctcgtggtttagtttttctggcgtaatgaaattatggttagacgaggtgtttgaacacggtttcgctcatggttcaaccgccaaattagcgggcaaaaaattgattatctctaccaccactggtgcaccattagcgctttatcaaaaagagggcttttttgagcatacaatggaagattttgccccgcagtttgaaatgatggcaaaactctgcaaccttgattatgcaggctatatctacactaacggtatcggctacaccagccgtgaaaaccaagaaaaaattgatgcccaaaaacaagaagcaaaaaaacacgcagagcgtttgaacagcttaattaggagtttgcaataatgaaaagattgcttaccacttttttattgggagtatcgacaatgagtaatgctgagcaaaaaatgagtctatttgaactcacggtcaaaccagaacaacagcaagcgattgatacggtgggtaaaacgaatcttggcacgtcaattcaaaccgaagctggtacgttagcaatgttccataccgtgaaaaaagatgagccaagcaaaaatgtgattttggaaatttaccaagatgaagctgcttatcaaacacatatcaatgcgccacattttaaacagtttgttgaagttgctaaaactgcagtaactggtcgtaaagtcgagccactagattcgcaaattttattggaaaaacaaccgcttgcaatatttgaaaacggtgattatctcattaatttagctgaagtgagcgtgaaccccgcacaaaatgaagactttaaagcaattgtgttagatgagatgaaacaatcaatggcaaaagaaaacggcgtgattttaatgtacgccgctacacgcaaagaccaaccgaatgagtggcgcttttttgaaatctatgcgaatgaaacagcttaccaacagcaccgtaacacaccgcactttcaggcctatttaaaccgcactcagctaatgttggaacgtaaaaatattacggctttagtgggtaaaacattagttagtaaaggtctgtttaagtaaaaattgacaatttttggctttcgaaaatagtcgttaaagtgcttgatctacgtatctaactcgcctacatttatatattcctgtgtgtaaattatacaaatggcaaaaaaatgaggaaatttaaccgcttgttataaataattattgaataattttgcatatttatgcaaaatattcctattcagatgtacaggacatcttttaataagattaaagaagcgaaaaggaacacaatatggcactttggggtggacgttttaaacaagaagctgatgcaaaatttaaatttttcaatgactcattacgttttgactatcgtttagcattacaagatatcgacggctcaatcggttgggcgaaagcgattacttcggttggtattttaaccgagcaggaacaccaacaattagtggtggcgttaaaagagctacgtgcggaaattgagccgaatattgcgattattttacgtgatgatgcggaagatattcatagctgggttgaatcaaaactgatcgaaaaagtcggtgatttaggtaaaaagctccacaccggtcgtagccgtaacgaccaagttgcggtggatatgaaaatgtggtgtaaagtacaagcgatcgtattacaagagcgtatccgcaacttgcaacacaaattggttgaaaccgctgaagcaaatcaaaatgcggtaatgccaggttatacccatttacaacgtgcgcagccgattacttttgcgcactggtgtatggcgtattacgaaatgttggagcgtgatttcagccgtttaagcgatgcttataaacgcatgcacacttgcccgttaggctctggtgcattagccggtacggcgtattcaatcgatcgtgatgcactggcacaggatctcggttttgcgattggcacacgtaatagcttggattcggtttcggatcgtgaccacgtgttggaactgctctcaaccgcttcaatcagtatggtacatttatcacgttttgctgaagatcttattttcttcaatagcggtgaatcggcattcttggaattatcggatcgtgtcacctctggttcttcattaatgccgcaaaagaaaaacccggatgcgtgcgagttaattcgtggtaaatcaggtcgtgtttttggggcattatcaggcttgctcaccaccttaaaaggcttaccgcttgcatataataaagatatgcaagaagacaaagaaggcatctttgatgcgatggaaacctggcaggcttgcttagagattggggcgttagtgctggaagatatcaatgtgaacgtggagcgtactcgtgaagcggcacaacaaggttattcaaatgcaactgaacttgcggactacttagtggcgaaaggtattccattccgtgaagcgcatcatatcgtgggtgaagcggtagtttatgccatcagcaaacgtgagccgttggaagcgttaagcgtagcggaatttaaacagttccacccggtgattgatgaagatgtttacccaattctttcgttagaatcttgtttagaaaaacgtagcgcgaaaggcggggtaaatccggaacgtgtccgtgaagcgattgaagcggctaaagtaaatttaggtgcttagttttaccacgcacggcaagtcgtacgtggttacgatcagcctacagctgagtgagccactctgtggctctagaacactttgtgatggcactcgtctttgaacataactgtttgagatatcataacttgctaatatataaaggaaatcccccctctttagtaaagaggggggatttcctttataagctccatttattctgtgtattcggtgtttttcgtggttcagaataatatctaaattcggctaccgtgttctactttgacgtggctggcgtggtcgatttcttggttattgtaatcggatttaaagccttttaaataaacacgaatatgattttctcgtgcggtaatattggcgaaatcttcaattaattctaatacgtccgaagcaatgtaagaggtgcgagaggcatcaataatcactttagagttcggtcgaatattttttaaggtctttttaattgccgctttatttaaaaacgagacttcttcggcaagttgcatttttatgtaacttgcgtcttccaattcttcacggcttaaataataagcgcgtttcatgttgccttgaagtaagaagataatactaattactaagcccaatccaacccctttgagtaaatcaaacgccaccactgccgctgccgtcgccacaaacggaataaattgataaatccctttatgccaaaagtgtttaaagatcgttgggcgagctaatttatagccgaccaaaattaagacagcagataaagtggctaagggaatttgatttaaaattgttggaattgccaagacacaaacaaacagtaaaatgccgtgaataatacttgagagtttatgagttgcaccggcattggcatttgcagaagaacgtacaattactgcggtaattggcaagccgcctaatacggaagagacaatatttcctacaccttgtgcgcgtaattcttgattagtatcggtaatacggcgtttgctgtctaaacggtcggcggcttcaattgagagtaaagtttcgattgaggctacgatcgccatggttgcaccggttacccatacaatagatgaaccaaaaccgctaaaatccggtaggcggactaaatggcgcatttcttgccaattttgagcaatcggtaattgcacgagctgattagccggaataactaaatggctactggttgcgataaatagttggttaatgccgatactgacgataacggcaacaagtgcggaaggtaacattttcaattgtttcaaacgaggggaactatcccaagctagcataataaacagcgaaataaacgcaatcagtaatgagcctaaatgaatatttaaatggtgttgtgttagttctgcgaaaacttgtttattgcctaacgcatagggcagttgcgagaaaataatcagaataccgatccctgctaacatcccttcgataaccgctaccggtatatagttagtaatgctaccggcacgcaaaaaaccgagcgagagctgaatagcgcctgctacaataccggcacacaagaacagttcaaaactaccgagttgattaatggcagcgagaactatcgccactaatccggctgctgggcctgcgacactaatatgtgacgtgcttagaaaaccaatgacgataccgccgataattcccgaaataattcccgataatggcggagcacccgatgcaagcgcaatacctaaacataagggtaaagcgactaaaaatacgactaaaccggaggcaaaattttgcttaaacaatcgttctttatttctttcggaaatcattgcgaataccatatgtaaatctattttgagaaaagccgttgttttgctaaaacaactcaaatgttattttacgctggattgtttcgataaactttggtttatgtcagagaagttgaaatttattttaaaatttgcaaagaaatgactgaatttaaccgcttgttaaaaaaatttgcttgaatttgcttgttaagattgcaaaacaagcattacatctttaaacttccgaataattttctgtaatttttaaccaagagcttagttatgactgaatcaattaatccgacacaagaaaatcaagatgttcgttcactaggacaaaaaataaaacaagcacgtgaggccttaaatttaagtgttgaagatgttgctaaaaaaacaaatttaaagaaatcacatatcgaagcattagaaaatgatattttcattttacaaaatgtagcgccgacttttgttcgtggctatgtgcgtaactatttacgttttcttcgtttaccggaagagttagtttcaagtgttaattatggtgaagtaactattccaaaagaagcagttaaaaccccttcggcaaaagctgtacaaaaatcacaaacacaatggatgaaatatttaaccgtattggtgttattagctgcagcggggatgacattattgtggtggtggcaagattaccaaaaagagcaagaaaatcgcgaccaatttgtgattagttctactcctgcagaagtcgcaccgagcgtgcctgttactcctgctccggtaaccgtagcgccacagccggtacaaccggttgcgccagccgttgttgaagaagtgaaagtaccggaagttactgggcctgtcgtaaatacaccggcagtggaaagtgcgccagtaaccgttcaatcggaagttgttgctgcagaacaaccggcagaagcagtgaatgtgttacaacaaacagtggaaacgggtactactgaagaaactagcgagccggcagcgattggtaatgatgaattacgtattgaagtcattggtaaagaaagctggattaccgtaaaaaataccaaaagtaaaagaagcttagcagaaaaattatatagcaacggcgaagtgttaacctttaacggtaacgaacaatatcgtttaacgattggcgcaccggcaaatgtaaaactttactataaaggccaagaagtaccgttaaaaattgatggtcgtgtagctcgaattcgtttacctttagcacaataaggattggacatgtcaattcatcaatcgccaattaaacgtcgtgaatcgaagaaaatttgggtgggtaacgtcgcagtcggtggtgatgcaccgatttcggtacaatccatgacgaatacccgtacaactgacgtagaagcaacggttgcgcaaattaaatcattggaacgtgttggggcggatattgtacgagtttccgtgccgaccatggatgccgcagaggcatttaaagtgattaaacaacaagtgaatgtgccgcttgtggcggatattcacttcgattatcgtatcgctttgaaagtggcggaatacggtgttgactgtttacgtatcaatccgggtaatatcggtaatgaagatcgtattcgtgcggtagtggattgtgcaaaagataaaaatattccgattcgaattggagtaaatgcaggatcgcttgaacgtgatttgcaagagaaatacggtgagccgactccgcaagcgttattagaatcggcattacgtcacgtagatattttagatcgctttaattttgagaactttaaagtgagtgtgaaagcatctgatgtatttctagcggtcgaatcttaccgccttttagcaaaacaaatcgtacagccgttgcatttaggcattactgaagcaggtggtgcgcgtgctggctcggttaaatcagcaattggtctaggtttattactgtcggaaggtatcggtgatacattacgtgtgtctcttgccgccgatccggtagaagaagttaaagtcggtttcgatattttaaaatcgttacgtattcgttctcgtggtattaactttattgcttgcccgacttgctcacgtcaagaaattgatgtaattgcaacggtgaatgcgttagaacaacgcttagaagatatcttaaccccgatggatgtttctattatcggttgtgtggtaaacggtccgggtgaagcgcttgtatcggatctcggtgtcaccggttccaataaaatgagtggtttttatcttgatggcgtgcgccaaaaagagcgttttgataacgaaaaactcatcgaccaattagaagcaaaaattcgtgcacgcgttgcagagcaacacaatcgaattcaaatcgaacaaatttaattttagtaaccacgggttacacaggttttacggatattgtggaaaacaagcggtcaattttcttcaaaatttacctgccgtattgatttgtgttgtccgtggttttagcgtaataaaaggaaaataaagtggctaaaaatattcaagcaattcgtgggatgaacgattgctctccaacagaatcaccattatggcaatggatcgaaaataaagtacgtaatgtattagccggttatggctattctgaagtgcgtatgccaattgtagaaagtacgccgcttttcgcacgtgcgattggcgaagtaacggatgtggtttcaaaagaaatgtacacattctgggataataacgagcaattaactcttcgtccggaaggtactgccggttgtgtacgtgcagcgattgaacgtggctggatctataataatgaacaacgcttatggtatatgggaccaatgttccgtcacgagcgtccgcaaaaaggccgttatcgtcaattccaccaagctggtgtagaaatttttggtattccaaatccggaaattgatgcggaactcattatgttaactgcgcgtttatggaaagaattaggtatcgaacaacacgtttctttacaactgaactcaatcggttcgcttgaagcacgcgcgaattatcgttcggcattggtaaaattcttagaaaatcataccgctttaatgagcgatgaagaaaaagagcgtttagttaaaaatccgttacgtattcttgataccaaaaaccaagcgttacaagaagtgctgaatgacgcaccgaaattattagattatttagatgatgacagtcgtgaacattttgcgcagctttgtagtctattagacgcaatgggtattgcttatgaggtgaatccaaaactggtacgtggtttagattactataataaaaccgtgtttgagtgggtaacttcagcattaggttctcaaggtactgtatgtggtggcggtcgttatgacggcttggttgaacagcttggcggtcatgcaacgcaaggcgttggttttgcaatgggtttagagcgcttagttttacttgttcaagaagtgaataaagagatcagcttaccgaaagctgttgatgtctatgtagtttattcaggcgaaggcgcaactttaaatgcattccaaattgcagaacaaatccgtactgaattaccgcaattacgtgtgatgacacattgttccggcggtaatttcaaaaagcaattcaagcgtgcagataaagtagaagcgcaaattgcattagttatcggtgaaagcgaagtcgctgagcaaaaagtggttgtaaaagatctacaaagcggtgcagaacaaattactattgcacaagcagatcttatttcagaacttactaaacgtttttaagttattacccgtttagggtaaatggagaaatcattattatgagcgattatttaaataaaacggaagagcagcagtttgaagaggcaaaaggctggtttaaagaaaacggtacaccaattttggttgcgatcattattgcctgtgctgcaactttcggttggaatttttggaaaaatcaccaaattgaaacggcacaacaaacttctgcaacttaccaaaatattatggaaagctatttacaagatccaagcaaaaatgcaccgcttgtagaaaagtttattgcggatcataaagattcaagttatgccgtttttgcacagttagaagaagcaaaacaagccgttgataaagcggattttgctcgtgcgaaaagtgtattagagaatgcattgacggctgcaagcgactcgactttacaaacagtaattcgtttccgtttagctgcggtggattaccaactaaaacactacgatcaggcgttagcaatgctcgcccagatccaagatcaagtgtgggaacaacgtaagcttgtgttaagcggtgatattcttgttgctaaaggcgataaagatgttgcaaagagcgcttatgaaaaagcaaaagagattgcaccggcacaagataaagtgttaattgatgtacgtttaaataatctgtaatcgaaataggactgttgtctagacagtcctatttttttatctgacgcatgagaatgtaatttatattttacattctatgctaatttaacttacactttcctcagtatcattacattggaggttatatgaatacacaaaccgtttcgaattttgttaaacaagagctttccggctggagaccctttgaagtgatttggcttgttgcctttattgccgcccaagtttgggcttacgtacaagcaccggattctattttggcgatgatttctggcatcgccggtattatctgtgttgttttagtgagtaaaggcaaagtaagtaattacttgttcggtttaatttttgcttacacctatttttatgtagcatggggcaataattttatcggtgaaatgaacagtgtgctttatgtgtatttaccggcgcagtttatcggttacttcgtttggcaagcgaatatgcaaaaagacagccaaggcggtggtgcggtgattgctaaatcgttaactgtcaaaggttggatcgtattattagcaacgattagtatcggtactttactttttattcaagcacttaaagcagcgggcggtagttcaaccggcttagatggagtgacaactatcaccacggtggcggcacaattactgatgattttacgttatcgtgaacaatggttattgtggattgtacttaatgtgttatcgattgctttatgggcggaaacaccggcaatgtatttaatgtacggagcatatctgcttaactcgctttatggtttctataactggacgcaattagagaaaaacgctcagcgttaatattcttcgctagctaataacaagcggtctaatttgcaaaatattttacaaattagaccgcttgattttttgctatgagcctaaaagcaaattatgctttttctcttgctactgcacggtaaccaatatcacggcgatagaaacgtccttgccattgaatttgttcggcaagttttaaagcttgctgctgtgcatcaaacaccgaattacctaatgcggttgcacataaaacacggccaccgtttgtcactaatttaccgtctttttgctcaacaccggcaaggaatactttctgtgatttttgtgcttgagttggaataccgctgatttcatcgcctttacgataatcgcccggataaccttccgctgcaagtacgatgcctaatgctgcttgttcacaccattttgatttaaccgtatcaagtttttcatcacaagcggctaaacaaagttgtacaagatctgattctaaacgcatcataatcggttgcgtttccggatcaccgaaacggcagttaaactcgatcacttttggctgtccgttcggcataatcattaaaccggcatagaggaaaccagtatacggattaccttccgccgccatacctttcacggttgggtaaatcacttcttccattacacggttatgaatttctggagtgacaaccggagccggtgagtatgcgcccataccgccggtatttaaacctttatcaccttcgccaacacgtttgtgatcttgactggtcgccatcggttcaacatttttaccgtctaccatcacgataaagcttgcttcttcaccgtctaaaaattcttcgataaccacacgactaccggcttcgccgaatgcattgcctgacagcatatcttttactgcttcttccgcttcttcaagcgtcatcgcaacaattacacctttaccggcagctaaaccgtctgctttgatcacaattggcgctcctttttgctttaaataagcaatagccggctcaacttctgtaaagttttgatattcagcagttggaatttgatgacgagctaagaaatccttagtaaacgcttttgaaccttctaattgtgcggcagcttgagtcggaccaaaaatttttaagccgtttgcacggaatgcatcaactacaccgataacgagcggtgcctccggtccaacaatcgttaagccaatttggttttctttcgcaaaagctactaatgccggaaggtctgttgctgaaattgcaacattttcgataccttcttccagtgcggtacctgcattacccggtgcgacaaaaacttttttgactaaaggcgattgacgaactttccaagctaaagcgtgttcacgaccaccgttaccaataattaatacattcatttggattccttataaattaacaaaagcaaacgtttgcgcaattgtactagaagatcacaaaatactgaactattattcgtattttcatctgataaaacctattttcatatttaagtgataaatcacattattaaattatgcttaaaagacagcattaacaataaattttgcttgcaaaaccaacaagtttacgtataattccgccgttcagtcacatttgttttttaatccttgcttccacaagttggtgactggctaaagttggaggctgctaacccgtaaggatagtcaatgcgtcactacgaaatcgtttttatggttcacccggaccaaagcgaacaagtaccagcaatgattgagcgttacacagcatctgtaaaagaagctggcggtcaagttcatcgcttagaagattggggtcgtcgtcaattagcatacccaatcaacaaacttcacaaagcacactacgtgttaatgaatgtagaagcacctcaaagtgtaatcgacgagttagaaactaacttccgttataacgatgcagttcttcgtaacttaatcgttcacactaaagcggcagtaactgaagcttcaccaatggtgaaagcgaaagaaagcaaagttgctgaagcggtagctgaagttgaatcagaggaagctggcgagtaattcgccaattgataattgcttaattctgagcggctcggtcgcttcaatggttaagcaaagccaaaacccgttaggggttccgaattatcgtttttggcttgaacatcgttcaatccaaaccgaagtgaatttagaacgtcaggcgtggtgtaaaatccaagtgattttaaatggcagtcaatttagtttaataacccaacaaataaagctcggcgataaaattagagttcatggatttattcatactcacaaagactataatggtttaaaccaattagtcgttcacgccgaacatattgaatttatagatcaggagaagccaaatggcacgttatttccgtcgtcgtaagttctgccgtttcacagcggaaaatgttgttgagatcgattacaaagatatcgctacattaaagaactacatttctgaaagcggcaagattgttcctagccgtatcactggtactcgtgcgaagtatcaacgtcaattagctcgcgcaatcaaacgcgctcgttacttagcgttacttccatacactgacaaccatcagtaatagagaggtcgagtacaatgcaagttattttattagataaagttgctcacttaggttctgtgggcgaccaagtaactgttaaatcaggttttgcacgtaacttcttaatcccacaaggtaaagcagttatggcaacagcagcaaacattgctcacttcgaagcacgtcgtgctgaattagaagcaaaagcggcggcagcattatcagcagcacaagctcgtgcagctaaaattgctgaaatcgcagcagtatcagtatctgcaactgcaggtgacgatggccgtttattcggttctatctctgcaaaagatatcgctgatgcattaacagcggcaggcgttgaagtagctaaatcagaagttcgtttaggtgaaggtccacttcgcacaactggcgaacacgaagttaaagttcacttacacgctgaagtgaatgcaactgtaactgttaacgtagttgctgaataatctttagattattagaaaacccagcttaggctgggttttttgtttttgataactatcgaaatttaatggctattaaaatgcccaccttcaaaaagtgggcattgtcgttaattcattaagctgattttttctttagaattgcgtatagctcatcttttatatgtaatttctcttttttgagaagctctacttcatcattggttgcaagctctatatttgactccatgtttttaatgcgttggtctagctcattatgtctctcaaataggcgagtaaaatgcgcatcactattttttaatttggtgattagctcacgaaattctgggaacatatacaactcctataatgtcttaattgaacctttggtttaatttgatactactcttttttagctaggttgggataactttattttaaatctttgaagtcgatcacaaaattttcgtgaaacaaggattgatgaatttactctatactcggctcaggtataatacagcctcttttgtttactggggacaataataatgcgttacaaagctctcttatcttttctctttgcagtattgagcagcactgcggttgctaagtgggaaaaaatcaatgatgtggattacacttggggaccgttcaaaatttataatatttccctatttacagaaacgggcgaatataagaatacggaacgcccagtaatgttgacattgaaatacagtaaaccggttgatggtcgagatttcgcgatttcagtagcgaaatcatgggcgaatttggggattacacttcctgcacaagatgaagtgatcgatcgacttcgtaaaatcttaccggatttaaaaccggatgattcattaagctatattgcgttagctgatcgtggttattttgtgttaaatgataaagtgattgagcaagattttaatgctgaatttaatgatgcaatgctggctatttggttagatccgaaagttgagttcagctataaattaatcgctaagaaagtagaaggtgcagagcaagaagtacaccagtcagcagaatatcgccaaagtctggaagaaatttcaattgaaccgaaacaacagaagttatcgactaaagctgaattaacggatcagccggcatcaaccgaacaagcggtggattctgagtcacaatcgacaaaattagaatcgccgaaaccgactaaaaaagtggatattgcaaaagttgcagaagttaaaccggcaaagagtgatgttgaaaaaacacaaaataaaacggctgtatcggcttctgaagccgtggtagaaccggctgaagaaaaaactgaaacaccagctgtagcaccagaagctgagactaagccggtagagcagaaaccagaaccaacgaaggaagaattagaaaatccggagaaggaaatcttgccggaatctgaccctactcctgcttaccaactacctgtatcctaatgaaattaacgattaaagatattgccgcacgttgtaatgttggtaaatccacagtgtctcgagtgttgaataatgatcctaaggtgagtgttcagactcgagaacgagtgcaagcagtcattgatgagttaggattccagccgaatcaaagtgccagagcaatgagaggggcttcttctcctgttgttggaattattgttacacgtcttaactccaccgctgaatctcaaactttaagcacgattttacagcagctatacgctaaaaatattacccctctgattgttgagagccaatttcaacctgaattagtgactcgccattttgaattattccgccaacgtcaggtggatggcgttattctatttggtttttcacaactttcacttgaaattattcagcaatggcgaggctcattggtgactgttgctcgtgcttaccccaatattcctgcggtatattatgatgatgagaatgcgattagtatattaatgacgaaattgtatcagcaggggcatcgtaacattgcctacttaggcgtaaatgatcaagatgaaacaactggtcatgatcgcaatcgcagctatttggctttttgtaattctcatcagattcccgctaatttagtggaagcggaattgacgattgaaagcggctatttacagatgccgaagttaatgtgtaaaccggtatcggcgatattgtgtgccagcagctcgctagcgattagtgcattaaaatatttgcaagaaaatcagcaaaatctaccgcttgcttgtatcgggcaaaatacattattgcagtgttttgcaaccaatttgcttacgctggattttggttatcctcaggcgggaaaatgggcggtagaattgttattaacacagctcggcggcaaaacaaccaccgagcaacgcaaagtaccggttaacttttcttaactgctttgataaacagtaatggcgggcgatgttgtagatctttaaactcgttatgccattgcggttgttccgccagcattggctcttccacttgcacgatttcaaaaccggcttgaatcagctgattgcagattgttgccatggtgcgatgataggttttgaatgcttgttggaaccaacttctgtctcgctcaccctcatctcgataataatttaaacgataagcaacttgttgtttttgctcatttttctcccaacgatagccgtctttatagcaagtgacgatcggatgttcttgggaaaaaatcagcgtaccgcaagcggtcatttttgcggaaatttttgcaagtaaatcggcaaagtcctcaatataatggaacgcaaacgagctggtgaccacatcaaaatgatcttccggaattttatctaattgttccattggcaagcagtgcagtgagaaagcggtcgatttttgccagttttttgctaaatcactttccgcctgttttagcatgagttccgataaatccagaccgacaactttacttgctcccaattccaaataatgtgctagatgtacgccggtaccacaacctaaatctaacacttttttcttggtaagatccggtaaaagtgaaaacatggtaggcttttccaccacttcattcatactgattgggttttcacgtaattgttgataacgttcaaagaaaatcggggtatcgtaaatactttttttcaactgtttattcctataaaaaagcccacaaatgtgggcaatatgttactggtatcgggcgagcttttgcaaggtttggtaggctttatctgttctcagcaaatctttgacacgctgtacgttggtttttaaatctcgttctccgaatgtgcgcatgagcatagcagtatttactgcaaccgcatcaatatgtgccgcttcgcctttgccttttaataaagcggtaattttttccgcattttctgtaggctcaccaccttttaacgcctcaattgaatggcgttggataccgaaatcttccggtgtcagtgtgaaataatggatttcgccttgttcaatttcagcgactaaagtttcgccgtgtaccgccacttcatctaaaccggaaccgtacaccacaatcgaatgttgatgatttaaggtgcgtaccgtttctgcataaattttcaaaacttccggtgaataaacgccgagtaattggcgtttcgcgtgtgccggattgactaacggccccagaatattaaatagcgtgcgagttttcaatgcttggcgtaccggtacggcgtgtttaaaaccggcgtggtaaagcggtgcaaataagaaacagagattattttcatctaacgcttggcgtgcggtttggggtgaaatcgccacattaatccctaatgcggatagtacatcacttgcgccggttttactggagacgctgcggctgccatgttttgctactttatagcctaaggttgcggctacaatcgcactggcggtagagatattgattgtattttgcccgtcgccaccggttccgacaatatcggcaaaatcgtaatcgggagttgggaatacggttgcatttgcaaatgcagcttcaaccgctccggcaatttcctcaattgtctcgccccgtacttttaacgcaattaatgcgccggcgagttgttcgttagaaacattaccttgaattacttgttcaaaaaagtattgcgattctgcttttgtgagtgcttggttctcaaataattggctaagaatgttgtcgagttgcatagtgttatcctgttttcgttatactgataagcggttatttttctaaatttttttgcttaatgttgtgtggaaagcagccattcgaccgattgttttaataatttagtgccttctacggttaggattgattctgggtgaaattgaaagccgcaaatcggtaattgtttgtggcgaatcgccatcacgatattatcgaagcgagcattgatttctaactcctccggtaggttatcacccattaatgaatggtaacgggcaaccggcatcgggttattaataccgtggaacattgcttggttatcgtgttcaattttagacactttgccgtgtaaaacagtaccggtatgcacgatacgtccgcctaacgcttcgataatcgcttgatgacccaaacaaataccaatcatcggtacaacgcctttgagctgtttaataattgctaacatattgccggcttctgccggtgtgccggggccgggcgaaagcgctacaatacaattttcggtagtttgtgctttgtttagaaagtcttctaatgggtaatcgttacgaaaaatagttacttgatgacctaattcacgaaattgatcgacaaggttgtaggtaaacgaatcaaaattatcaacaaaaagaatatgtgccatagcttatccgtccttatttggtattaacttgtgcgattgcttttaatacggctttcgctttatgacgtgtttcatccgcttctgattgcggatccgaatccaatacttcgccgcaaccggcttgtacgtaagcgatgccgttttgtacgaatgcagaacgaatcacaatgcaagtatctaaatcaccttgtgaggttaagtaaccgactgcaccgccgtaactgtggcgtttttgttgctctacttggtagattaattgcatcgctttaatttttggcgcaccggttaatgtacccatattcatacatgcttgataagcgtgtaacgcatctaaatcgctacgcaatgtgccgactacacgagagacaaggtgcataatttgtgagtagcgatcgatttgcatcagatccaccactttacgtgtaccggcttggcagactcgtgcgacatcattacgagccagatcgactaacattaaatgttctgccaattctttttgatctaaacgcaattccaattctaagcgtgaatccaattccggatcgatattgccattagcatcaaagccacgcggacgagagccggcaatcggatagatttctaattgacgagtagcttgcgaatatttcaaggcactttcgggcgatgcaccgaataaagtaaagttttcgccttgcataaagaacatatacgggcttggattattaattttaagctgacgataagcggctaaaatattcgggcaaggcaaactaaaacggcgtgacggtacaatttggaacacatcaccgatatgaatatgatgtttgagtttttgaacgatctgtttaaagtcttcatcttcaatattggttttcacttcaccactcgccgtttgaatcggtaggcgtaattcgcaaggctgatattttgcaagaatttggctaaattcgaccgcttgttgctgtaagcggctttgctgtgtttcatcaaaacagaaagtgtgcaataccgattcctgtttttggtggtcaataaacactaattgttcggcaagatagaagctgtaatcatggcaacttaagccgtcatcttgtagttgaataccatccatcggaataaaatgggcgaccaaatcgtagctaaataaaccgcctaaatagattggatctgctttatcagcaaaaagttggctcacacaacgtaaaccgtcaaacacggtgctggttttaagtttactatcttcatctaaattttgggcaatgggtggaaaggttgccgacaagcggttaaattccgttgaaactttgcaatttggagtcggagataactgagcaagcgctgcttgaatatggggaagtacggctttaccgttttcagttaacgcctcaaaagtgacggtttgagcatcgcaataaatatgtaatgcggattgggcgaataatagactttttaggctgtttttactgtgaatttctgctgagtctaataaaagtgtatgtggtttattatcacataggtgataaaacgctacggttgtatcttcataatagggaagttgtgtttgctgagtatttagattcatttcacgattccttgttttattttttaattttgtactattaaactagtataaaaatgataagtcaagtgatttttttaatactgggaatttgactaaaacggctgattttatttactcgcttttgtacaataacgattgtttcttatctattttcttacttatgggatacattatggcaactccacaatccggcattacactaacgcatcgtaaatcgggcatttttattgaagcgaatattttaaatattgaaatgtttcgttctaaagttcataccattcagcatcaatttcaggaacttcaacagcaattttctacggaagcattagggcttaccttggcttttggtaaagcgctttggaaccagctaaagactaattccgctgccgaattgaaggattttattgcattaggcaaagccgaacgagagtatgcgccggcaacccaatgtgattttttagtgcatatccaatctaatcgtccggatattaatttttctatcgctttgatggtggtggaacaattaaaagaggtggcggaaattgtggaagaaacccatggttttcgttgggtggaagagcgtgatttaaccggctttattgacggtactgagaatccgcaaaccgatgaaaaactgcgtgaagtcgctttaattgaagacggtgaggatgccggtggtagttatgtgttgagtcaacgttatgttcatcaattggcaaaatggcataagatgaacacggagcgtcaagaacaagtgatcggcagaacaaaagcggacagtgttgagcttgaggatgtaccggaaaattctcacgtaggtcgtgtggatttaaaagaaaatggtaaaggtttaaaaattttacgccacagtttgccgtacggtttagcgagcggcgagcatggtctatattttattgcttttgcgaaacgtttacacaatatcgaccaacagcttaaaagtatgtttggtgaattagacggcaaaactgaccgcttgttaggctttactaagccggtttctggtagttattattttgcgccgtcgctagagcaattagcggcactctaagaacggtataattctttagagaatataagaatgttggtgtataatgcaccaacatttttttcgaaggatattacgctatgagccaatttttttatattcatcctgataaccctcaggcacgtttgattaatcaagcggtagaaattattaaaaatggtggcgttattatttatccgacagattcaggttatgctttaggctgtgcaatcggtgaaaaacacgcaatggatcgcattgttgcgattcgtaaattgcctgaaaatcacaattttaccttggtatgtagtgatttgtcagagctttccacttacgcattagtcactaatcaatcttatcgcttaatcaaaaataacaccccaaatccttacacctttattttaccggcaaccaaagacgtaccgcgtagattaatgactaagcgtaagacgatagggattcgtgtaccggataatgcgatcgctttggcattaattgcagcgctaggcgagccgattttatcttgctcgttaatgttacctgatacggaaattaccgaatcggatccggatgaaattcgagaacatttagagcatcgtgtggatttaattatccacggcggttatttaggtcaagagccgacaactgtgattgatttaaccgaagatagtcctcgaattattcgtgaaggatcgggcgatattacgccttttaactaatcatgttttctcctatcgtgtataggaaaattggagaaatccatatttcagacgctcgtgagagcgacaatttaaggaattttaatgacaacatttcaaaaaaaaccaactgataaacgttcaccgtcttttaaacattcgcaaggcgaaaagcgttttgataaacgtagcggagacaagcgttcatcatctagaaaatttgatgaacaatctgaaagacgtgcccgtccaacgtctaagccattagtaaaaaaatcagtaaaaccgaccgcttctgttactgaaacagtagaaaaaaaagcgaaaatagtcggcgaaaaattacagaaaattttagcacgtgccggtcaaggatctcgccgtgaattggaagagattattgcagcaggacgtgtgagcgttgacggtaaaatcgcaagcttaggcgatcgtgtacaggtaagcagtgccactaaaattcgtattgacggtaatttaatcagcttaattccggcacaaaaagaaatttgtcgcgtattgatgtattacaaaccggaaggtgaattatgtactcgttcagatccggaaggtcgtgcaacggtatttgatcgcttacctcgtttaaccggtgcacgttggattgcggtcggtcgcttagatattaatacttcaggtttattactgtttactacagacggtgagttagcgaatcgtttaatgcacccgagccgtgaagtagagcgtgaatattccgtgcgtgtgtttggtaatattgatgaagcaatgttacaacgtttacgcaaaggtgttcagttagaagacggtccggcaaactttaaacagattaaaaccgttggtggcacaggtttaaaccaatggtttgatgtcactttaactgaaggacgtaaccgtgaagtacgtcgtttatgggaatcgcaaggtgttgaggttagtcgtttgattcgtattcgttacggtaatatcaaattagaaaaaggtttacctcgtggtggatgggaagaaatgggcttagagcaagtaaactatttgcgtgagcttgttggtctaccggcagaaactgaaaccaaagtggatgtgacaaaaaatcgtcgtcgcaccaatattcgccaaattcgtaaagcggtaaaacagcattctaaatatcgcgcgaaagtataataaattagtaataaaagaaacggccagattgataagaatcaggccgttttcatattcagtgcaattaacgtttaatcttctaaaaccattaaccccggtaatgttgcaaaactttgcgattttacggtattgtggaaatcgttcagataagcatagttttgatccgtttctcggtatgcgccataaagattgctgtacagtccttgttgcgtaatcttttttgcaactacatagcctctatctaaataaggttttaccgcccaataaggtaaggtcgcaattcctcgtttacttgccactaattgaataatcgcaatagtcaattcgctagttctacgtgttgggctgatacccgctgggcgtaatactttacgtaataaatctaacatatcgtcaggaaccggataagttatccacgtctcatcaataaagtcttctgcttcccaaatatctttttgagctaaaggatgatctttagcacaaatgccaaccatttcatacgaaaagagcgggcggtaaatgatcccttccgtttgttctgcctctgcaacgactgcccaatctgcacgatgtgttaataataagcctacggtatccgtgtggaaaccggatacgatatctaattcgactaatggccagctttgacggaaagtatccattgctggcattaaccagtcaaaacaagtatggcattcgactgcaattcttaattccccaacttcgccttgctttactcgtgcaagatcgagctcagcttctgcaactttaggtaaaatttcatgggctaattttactaaacgatctccagctggagtaaaacgtaaaggttgtgttttacgttcaaataatgtgagctcatattgatcttctaataattttatttgatgagaaagggctgattgtgtcaagtggacacgttttgcagcaagagaaacactgccgctttcttttaaagcgagtaatgttttgagatggcgaagttcaagaaagatgggtttcatttacaattaataaagtcttcagaaaattaagtagtaggatgagtataatataaattattgttttaaataagtaaatttttttcattataattgaaagataaatgatttaatttatggaactaaataaatttatatttgtctatataaagttttttattatttggatggtgttttttattattttttttagtggggagttatattgaataaattaaaataataatttacataactctagattatttattttaacttatatatactttaataaatttctttataaggatatattaggagtgtatatatgcaaaaaatttcaaaactaagtttaactgtattaactgggcttgtattaagcgcttgtggaagtagtggcggcggtgacaataatgattcatcaaatactgctgtaaatgtaccggtagctgataatatgcctcagccaactactccttctcagccaaacaatccttctaatgataataatcgaggctatacaccggtagtaggaaatatgccttcaaattcatcaacaggaactgttcttgtgatatcgaatcaagacgatgatgttttggaaaagcgagttgaattacataattcaaatactgaactcttaaatgttgaaggtacagaaattcgcgttggctataaaagttcgggtatttattcgggtacttggttaaatatgggacttttaagtgcctgctgtgataaatatagcgcagtacgttttggggttctcgataggaatggtccggaagtagacagttatatgttctataatggttctccaacagcgtcaatgccaactagcggcacagcgacttataatggtcatgcaattattgccggtaatacagtgcaatttgatgaacatgattggttaaaaggaacgtcacaatttaacgttgatttcggtgcgaaaaaactgaatggttctttaaatattgatacgcttgaagcagtgaatattacggcagatatttctggtaatagctttgccggtgcggcaaattcaaatagtttcccaacgaaagcgaatgtagaaggcaaattctacggtgaaaatgctaaagagcttggcggtatgattagagatgtatctaacattggcagtgatacttcttggggcgcggtatttggtgctagccaataatagctaattaaatgtataagcggtctaattttattctttttttgcaacaaaaatgctttgcaaataatgaaataaattaggccgctttatttttactgagtagtttttgcgcaaaccgtttctttgccgatttctttttgccaacaactccaataactgtaatgatccgcccattgcatattttcatctaaagaaaagaagacggttttcgttttatccggctcaggtattttgtccggcatttttttactaattagcccgtattccgcaccagtaatttcgtatgttaactcataggcggaaacatagaatcgattatgattgatggtaatttgatcggtgaaatattgattaccatgtacgattccttgttcaagccgttccacatcacattgtacgctttttaatttcttccctgttaatgaatataagcattcatcggcataagcggtattaagtgctaaaagagcgcaaagtcctagccattttttcatttttcctccctaaaaaatgtcttgagatatgattaagcataacataaagggcatactttatgcgtaatctataacttaattgattattaaaaatattcataattaaattgaagattatgaagttgcataatgtttaaggttcttgcattatttttgacacagcttagcggattaatcgctaagttagctgaataacaaacagatcgcaggagtgcagtatgacaacattacatatcttaggtttcccacgtgtaggggcaaaacgtgaattaaaatttgcgcaggaacgctactggcgtaaagaattagccgaacaagatttattagatctggcaaaagcgttacgtgaaaaaaattggcagcatcaagcgcaagccgatgcggattttgtcacggtcggcgattttacgttttacgatcacattttagatctacaagtagcaaccggcgcgataccggctcgttttggttttgacagccaaactctgagtctcgatcaatatttccaattagcacgtggtaataaagagcagtttgcgattgaaatgaccaaatggtttgatactaattaccactatcttgtaccggaatttcagaaaaataccacgtttaaggcgaatcctacgcattatgtgaatcaaattcgtgaagcgaaaactgccggacatcaggttaaaccggtgatcgtcggcccgctaacatttttatggctaggtaaagaaaaaggtgaagcctttaaccgctttgatttgctcaagcaacttgtgccggtttattttgagattttaaccgcactagccgctgaaggtgtggaatggattcaaattgatgaacctgcattggcattagatttacctcaagaatggcttgcggcttatcaagatgtttacgctcagttagctaaagtgaatgcgaagctattattggcaacttatttcggctcggtggcagaacacgctgctttattaaaagcgttgccggtagacggtttacaccttgatctcgtgcgtgcgccggaacaactcagtgcatttgaagattatccgaaagtgctttctgccggtgtgattgacgggcgtaatatttggcgagcgaatttaaatcgtgtattggatgtgttggaaccattaaaagcgaaatttaatcagcgtttatggattgcaccgagctgttcgttattgcatacaccttatgatttagcggtagaaacgcaattacagcaaactaaccctgaattgtatcgctggttagcttttaccttacaaaaagtggcagagctgcaggttttaaaacaggcattaaatgcggggcggtcagcggtcgcagaacaattaaatgacagccaaaccgcggcagatgctcgagaaaacagtaaagtgattcataaagcggaagtggcacaacgtttagcgaatttaccggcaaatgcggacaaacgtcagtcaccttttgccgagcgaattaaattgcaaaataaatggctaaatttaccgcttcttccgactaccaatatcggttcttttccgcaaacattggaaattcgccatgcccgtgctgcatttaaaaaaggggaactatcgcttgccgattatgaagcggcaatgaaaaaagaaattgaatttgtagttcgtaaacaagaagagctggacttagacgtattagttcacggcgaagcggaacgtaacgatatggtggaatatttcggtgagttgctggacggctttgctttcactaaatttggttgggtacaaagctacggttctcgttgtgtaaaaccgccggtgatttatggtgacgtcactcgtcctgaaccgatgacggtgcgttggtcgcaatatgctcaaaacctgacggataaagtgatgaaaggcatgctaaccggtccggtgacgattttacaatggtcgtttgtgcgtaacgatattcctcgttctaccgtatgtaagcaaattggcgtggcactttctgacgaagtattggatctggaaaaagccggaattaaagtgattcagattgacgaaccggcaattcgagaaggcttaccgcttaaacgagcggattgggatgcttatttacaatgggcgggagaagcgttccgtttaagttatatgggcgtaaaagacgatacccaaatccacactcatatgtgctattcggaatttaacgatattttaccggcgattgcagggcttgatgcggatgtgatcacgattgaaacttcacgctctgatatggaattactcacagcgtttgccgatttcaaatatccgaatgatatcggcccaggtgtttatgatattcatagtcctcgtgtaccgacagccggtgaaatcgagcatttattacgtaaagcattgaaggtaatcccgaaagaacgtttatgggtgaatccggattgcggcttaaaaacgcgaggttggaaagaaactatagagcaattacaagtcatggtggatgtaacgaagaaactgcgtactgaattaacacaatagtttggttgagatagctttcaatctattgataaaacaagcggtctaatttgtaaaaaaatttgcaaattagaccgcttttttatttatatccaagatgagatgaatagtctttaatcaataaaaaataataagccttttattttttatgtgtatattttggttgtgaattataccgattgtataataggatcaaatttaaatgcatttaataataattcttattgaatagatatggcaaaattgctagtatcaaaaaattgtaaggtttccattgtaatgtaaatttaaacgcagaatgatgcgtttaatgattttaatctatgtttaaaaaattagcgtttttatgtgctggcttattctatttgcttcaatttaatatcgcttatgcggagcaacaaattaatacacctgaaaagaatgtggaaattgctaagttacttaaggaaaccccaaaattacctgaattaaccataaattcgattgaaaatattcaacaatctgaacaagatttattaaataataaattgtttgttgagcaatttctgaataatgcaatcgaaacaggtcacctttcttcaattaaatatttattggcgatttatcgtcaattccagaattctgatcctattttaattctttttgcacaagctcagattgctaaaatccagcaacaatatgccgaggcggctaaattatatcgtgaaatattagcgattaaaccaaggcttactcctgtccgcatacaacttgcaattgtattgttcctgtctcaacaggataaggcagctaaagagcagtttgaaaaatcattgagtgaaccacagctccctgctgatattgaacaattaattcatctttatttgcaggcattggaacagcgcaatgtatggcaagtttcgttgagtgctaattatttacgtgaagacaatgtaaatcatgtttcaagcgaacgatatattgaaaataccgcttttataaaaggcgaaagtatgttgccacaaaaagcacaaggcatcagctattactttggtttagagcgcgatatcaatttatggaatgctcattatttacgtatcgataatagtttatacggtaaaaattactgggatcagcatgattatgacgatattaccaatcgcctatcgttaggctatgtacataaaggctcacagcaacgctttgcgattttgccgttttatgaacagcaatggtatggcggtcatcgatacaagcgcagtaatggtggcagaatagaatttaatcgttggttaaattcaaattggcaattttcaacggccgcagagtatgctcggaatttctattcaaatagcttaagtttaaacggtaagagtaagttagcttcattaacgatgttatggcgtgctagtcctcgtacttatttttatttaggagcggattacgctcaagaacgcactaaagttcgtcattacagctatgacttaaaaacagcccgtattggttgggggcaagaatggtatgggggaatttcttctcgtttaagtttttctgcttctaagcgagagtataaggataatctttcgctcggttcggcttttcatttcgataaacagcgtgaagaccgaatctatcatatcaatgcaaccgtttggaaacgagattggcacttatgggggattactccaaagcttaattatcactggaaaaaacaacgtagcaattttgtaagcctttattcttactcggataaaagtatcaacataatactggaaaaaactttttaattaacaactttgttttatataaggactttcaatgaaaaatattttaaataaacaagtattaaatacggcagcaacaattttattgtctatcggggtaacagcgtgttcatctgggggaagtgatcagcccggaattgatcaaagcactcgcttaagccaagtcgcggtacaacatttattagaagataaattacaagctcaagaacaccttgacgaggtaaaacaagcattggatgctctgcaattagctttagttaaagcacaagcggctaattcgacatcagatgtacaacaaacattaaaagatgctagtagcttattagaaaaagcgaaattggcagccgaaaatgctaaagatgaagcgaaaaatgctgcttcacgagtatcaagtgcaagtgcacaattatctaccgctgtagatgaagcgaataatgtaatgaacattgcgaatcaagcaaatagcgtgttattagaggcaactaacacctttaatcaaattcaatcagtgcttgctgatttaactcaaaaagaggtggcaaaagctgaagagcagacgaaaaaaatagcacaagaaaagcaaatagcgacaaataaagcgattaccactgcaatatcttataacaacctcgattcgattgtgcatgattatggtaatagcgaggcacgagaagcattattagcaaaattacaaaaacaaggctcaaatgcgccagcctcttgtagtaatgcaaaaacctcaacttgccataaagaggtagcaagaggcagtgtcgtagttaattacaatcaagcttattcaagttatgcggttattcgtgaaacctataataatgaaaatccacagccgagtaatgcttttattgtattagcgaaggagagcgatttaaccacagatcgtgctgcagtcgtaaatgcaacttatacgggtaaagcgtcttatagtgcaaaaaatgtgccggcggtaatgacgcgagatttcaccttaaaagtggaaaatgacaaagtaagtggttcggttttccaaaaaacgattaattcgaaggggatagaaaaagtaacagaaaatgtagcgttaaatgaaggaaagatcagtgttgataatggagtagtgggctttagtggctcagcaaaattcggtgcgatcgcaagcaatgccgaaggtacttataaaggcgtattcgtaggtaaaaatgcagaggaagtgatcggtacttttgaaacaaatagcacagaaaaagcttcttcagcacaaggtgcttttgcaggaaaaaaataatcacgaattttggctttttttagagaacacatgatgaaacatttttcacattccttattgtattccagtatcttgctggcattaactaatgcagcctatgctgaagaaaccgctgagttagaagaggtggttgtcgttgggcaatcattcagtcagcaagtcggtacacaaaaaattaccgctgaacaaattaaacgccaagtctcaaaaaacggtgggattaccgatttacttaaatcgaacccgaatgtccgcttttcaaatgaggcagacttatctaccaacgctggtgagatccgcccgaatgaagtttctttccacggcgaaaaatattacaacaataacttcattttggacggaatgtcgaacaacgataatatgaacccaatcggcaaccaaatgcgtaacggcgaagcggtcggcgcaaatccttacgatttaccgaatggttcttctcaatcaatgtggattgattcgagtttattagaatcgcttgaagtttttgacagcaacgtttcagcgaaatacggtaattttactggtggtgtgattgacgctaagttaaaagatccgaattttgaaagacgctcgggtaaaatttattaccgtactactcgtgatgattggactaaattttatattcaagaaggtcaggaagatgcctttgaacgagcagctcgtttagattatcagccacgttttgttaagcatcaatttggtttaaatgctagtgaaaagctaagcgataatttttccattatgttctcttatgatcgtttgcaatccataatgaaaaatgcgcatgcgaatatgcgttatctagcaagcccgaatacgccgattgagaaaaaacaatcccgtattaatgaaaactatattttgcgtgcggtttatttgcctgaaaatggcgatttatggcgtgcaactgtgatgtattcgccgaattatgcgaagcagtttaaatctaacacggaaaatggcgcatttgaaaatatcggtggcggtgtacaagctaacctcgaatgggaaaaaacgttagattgggcgaaagtgaaatcctatatcggctataagaagacgggtaatcgcacagaatatgatgtgaatgattaccaccgttatatgtcatccgataatttctactggacaagtaatggtacctattcacaatacggtggctatggtgaacggtcattagaaaaagaaatttatacgttcaagcaagattatgaaggtaatgcgttcgattttgcaggaatggaacataaattaagttttggttggattactgaaatcgctaaagccaaatcaggtcgggatactagctaccattcttactattatcgcaaagctccgaatgtgatttgtaatggtgctgaggcttgtcttgagggtgatcagtttgcataccaacgtttaaattataatcagcatacggtaaaggtaagagatgatgatttcgcactttatctgcaagatcagctcaaatggaagcaattagagctctctctgggttctcgcttaagttataaccgctttttagataataccaatatcgattatcgtttatcgggttcttatgatctatttgccgatcaaaacacgatcatttttgctggggcaaaccgttattataacggctcattgctttcatctcgtttaagacagggcttggaaaccgccgagaaagaagtaagagagtttaacgatgacggttcggtgaacgactggacgttggatagccaaagcacagcgccaaaccgctatttacaaccacgcaaactcaaaacaccttacagtgatgaaaaagtgttaggtttagcgcaacgagtttgggatactcgttggacattcaaatgggttaatcgccaaagtaaaaaccaatttgctagtgcaaatcgttatttctcaggtgcgatgtatcgtgtaatgaataataacggcagaagtgaaaatgatactttcacattaagcgttgccccagttaaaggctatgaatggcgatatgcaaaacttcattgggatctaggtgttcgagttagccgtagtaaatcaagtaataaaacttacaataatgatgtgagcttaaaaacgaaagccatttacaatggcaaattgattgatgcagatgatttaccaccaaatgactttaatacaccgtggagtgcgttcctgaatgttaataccgaatttccaacacttaatctgaattggaatcaacgttttagctttactaaagggcgtaaaacacgcacggtagatacaactttcctctgtaatggacaatatacagaaggcgaaaatcgagctatttgtggtgattatgtcggtaatgcagacatttatgaagatctagaaatgggaaatgaatttaatgttgattggcgttttatctataaacagccactcacacaaacgcaattccttgaatttactcttgatgtaaataatgtgctaaatcgtaaatctttatcgaaatcgagtaagaaaagcgcagtttataagcaaggccgtaacttctgggctggggtaagctacaattggtagtagagtaagcggttaaattttcagaaaattttgcaaatttttgttaaaatttgaccgcttgaaacctattctctctcttgctttctaagcgagaggatttttcatttttaaaaggctaaaaaaatgcgtgtaattttaacagcgctcaccctcttgatggtatcgagcgcaagctatgcagaaaaaagtgaaccaattcaaggtcaattagaaaacggtttgaaatatacaattctccctttgcatgacgaaaaagggcatttggaaattcgcttacgtgtcaatgcgggcggcgtggatgaaaatgatgatcaagccggtgtggcgcatatggtggaacatttagtgtttagaggaacccatgcacatccaaacggcttaatgccttatttacatgagcaaaaatgggtacgtgccaaaaactataatgcggtgacaaccactgacagtacaacctatttattaacgcctcctgcaacttcaggattagatcaaagttttgatgcgttatcccaaatggtgtttcacgccaatttaacccaagaagatctggatgatgagcgcaaaatcattatggaagaatggcgccaaggtttaggtgttggcgcaacaatgaatgaacaacgcactgctgcggtgagagtggattctcgctatgctcgtcatcgcgtgattggtacacaaaaaagtattcaatcaatgccggcaacgcagttacagcggttctaccaaacctggtatgtgccaaataatatgaacttattggtggtaggcgatgttgagccggaaaaagccaaagcggagattcagcgttattttggcgaggtaaaagcgaaagcgttacctaagcgtgattaccttgagccgactttaaaagagcgtttattaattaacaaaattcaagaccctcgtagtggggtaagccaaattgcgtatattttccgttttgacgaaagtaagagccgagctcagacggaagacggccgttatcaacgcctattagatcgccttgcgctttcttcgttaattcaacgtttacgtaatcaagcggatgtattgccgaaaggggtatcagcagtggttcctcgtaaatcggatattggtagaaacagtgttgcacttgcgatttttgctagcgttgagccgaccgcacatcagcttggtttaaaacaaattttcgaagagattgagcgtattaagcgtttcccactttctcaggaagaattggataagcaaaaagcaccgatctttgcgcaaattgaaaatgcgaaaaaacatgacggcaatcgtgatttccaaaaatggatgcaagtgatggttgatacggtactggtagataaaccgtttttgactcaacccgaaattgctaatttaaccgaaccgatgttgaaaaaaatctcggtagaagaagtaaaccaacgcattcaagattggtttagtgcgaaagatcgcttggtgaattatcaaccgcctcgtaaaacacaaattgccccgattacggaagcaatcgtgaatgaattacaagcacaagtagagaagtcagaaattcccgctccgcaaaaagagaaagaaattgtgccaatgtcattagagactattgttggtaaaggcacaatcatcagtgagcaaagctttgatgcgcaacaagtaaaatattggacgctttcaaatggtgataaggtggtgtggctcaaatcacctctcgctaaagatcgcaccttatttatggcgcaaagttcagccggttttaaagcgcaaggtttaggtatttggcaaagccaaatcgcttcgcaattaattgagcaaaatgcaccgcttgattgggagattgagcaactggtacgttggaaagagctcaataaaattaatctgtcgattaaacaaaccgcaacgaaattaagttttgacggttcggcagaaaatagcaaattagcggaactacttcgtctctattatgcttaccaaaaggaaactaaggttaaagacggtttagatgaaaccaaagaatctattgccagaacgattgatttacagaatgagaaaagcgatgaaaccgaacgtttaaaagcgatctcaaaactacgctttaatcttgaaaaagtggacgataccttgccgaataaggcttcattagcgcaactaaccgaaaaagagttgaatgagcaatgggcgaaaatggtgagtgcgccgacaacattctatttaatgaatgatatgaatgaagtggacgtgaagaaattagtcgctgaattgttggcggatctccctcgtgacaagcggttgaattcgacccaaactttaccggttgacggcaaagcacaagcagaatttgcgatgaatctagagccgaaagacgatgtccgtttatggagttttaccccgcatcaatggcagggtaaagatgcaatgttagtttcgctggtacgcaatattgcaaccactaagttgaagaatacgctacgagatcaacaacttggcgtgtatagcttacgcttcgacagtacgctcaacccggaaacgcagcgagttgaatcggaattaagttttgtggcaaaccctgaaataacggataaattggtggaacaagctcgcttagtattaagcgatctagcaaaccaaattacggaagaggatgtacaacaagctaaagcaatgttcgtacaagcggaaaaaggtcgcttgaatgaaccaagaacatggctttcacgtttaatattaagcgatgagcagttcggtaatccgcaatatctctcggatatgcaacaacttaccgatgaaatcagcttagaaaaagtgaaagcaatggcgggaaatatttataacccgaatagtgaaaagctgtttgtaacgacgccgaaaaaatagtgtgaagaaatgataggcggagcatagtttccgcctattttttagtttttctcggaattttcaggaattttcatgacacaattttttaaaaatttatacgcattatgtcagccgtattgggtcaacagatcgaattggcaagcatggttgatggcgatagttattatcggtatcggttctggttttacttatatcaacgttaaaatcaccgagtggtcaaaagtgttctatgatacgcttgccgggcttgaagtggaaaaggcttattcactgttaggtgaatattttatttatgttgccgtttttgtcttggcgaatgtttaccgtacttggctacgtaaattgctgattattcgttggcgtcaggcaatgacggaacagtttttaaatcagtggttttctaagcagatttattatcgtttagcacaccgtaaaaaaatggataatccggatcaacggattgcggaagatattcgtctgtttatcgagttaaccattgaattaacgatttcttttatcttcaacatcattcagctgtatgctttctttatggtgttatggaatttatccggcagtcctgaatttaccttatttgggcatacttttgtggtgaaaggttatttggtctgggtagcggtagtgtattcaatattcggtacgctgtttacccatttaatcggacgtaagttacatggcttaaattatcaacaacaaatgtttgaagcgaatttccgtaccagtttaattcgcaagcaagataatgcagagcagattgcactttaccaaggggaagaggctgaaaaaatcacgcttgccaatgagtttaaagctatcgtcaccaactggcgtagcctgatgactaaagagttacagttagggttattcacggtgggctacgatcgtgtttcgaacttattaccggtggtattctctattccattgttggtgatgaaagtgattacttttggtggcattatgcaaatccgcagtgcttttagtgtcgtaattaatgcgtttagctggtttattttcgcttattcacgcttacctgagtggagttcggcgattaaacgtttaacccaattaaagcacgaaatggatgaattggaaaaacgtgttaaagcggaaatcgctatcagtgataaagccttggatacgcaaaaacttgccatctacacaccggaaaataaccgcttgtttagtgatttatctctggcaattgatcataaccaatggattcgcttaaagggtaaaagcggtttaggtaaatcgactttattgcgagtattaagcggtatttgggattattatgagggcgagtataagcaaccgaataaaccaagtttgcttgtgccacaacgcagttatttaaacgaaggcactttggcggacgtattaagttatccgaacaaaaattgttatagcgatattgaaattaatacggtcttagagctggtagggttaagtgcatggcagaatcgtctaacggaagttcatgcttggcataatgttttttcaggcggggaacagcaacgtattgcttttgctcgtatcttactgaataagccggcagtgatttatttagatgaggctaccagcagtttagatgcggaatctgcagctcagatgtttaaattaatgaagcaacagcttccaaatgcttctgtgatctttattactcatcaacctgagttaagccattttgccgatcaagaaattgatttaactttatataaagattaatgtaatgaatacaaagcctctctttcattgaaaagagaggcttttgtttttattggggttaacaagcggtcaaaaatagcaaaaattttgcaaattagccttttagacggaatcgtccacgactataacgggttttcattaaggcgagaatttgttctttatcactactgactttctgattactttgctttgcgaccactaacgaatgttgaatcgagtgagcgtgcgtaatcgcaatcgcaagggcatcggcagcatcggcttgcggtttggacgaaagttgaagcatgcgagtgaccatatcttgtacttggattttatccgccgagccaatgccggtgacggtttgtttgactaaacgggcggcatattcaaacacaggtaaatcgtgatttaccgctgcaacaatcgccgtaccacgagcttgcccgagtttgagtgccgaatcggcattttttgccataaacacttgttcaatcgcaaacatatctggctggaattgggtgatgatttctgtcacgccggcatagatacgttttaagcgagtcggtaaatcatcaacggaagtgcgaattgcgccgcttcctaaatattctaaatggcgtccggtttgacgaatcacaccataaccggtaacccgcgaaccggggtcaattcctaaaataatcggcatagtttatccaatgaatgaaaacaagcgggcagatttgcaaaaaattttacaaatccgcccgcttatctaaacgaatcaatctgttatttatttaattttgcggttgcagtttgattaacttcgcagttttttgcaaggatttcatctgcatttttaccttttttgaataacattcccgcttcggttttattaaatgtcgaaagtgcgaacgtttcatctaggttccatacatgtgtttttgatacgaatgatgcgaagtctttatttttctcatcacgcattaactcttttactgccacatcatttacagttaaagttaagccggtagctttttcaccttcaaaatcataggttgctactacagttttgctgttttggcattgataaactacggttttagaagacgcagttaatttattttttaccgtatttactgtgtttgaaacgccgttagatacggctgttgcaccttcttttactgcatttgttgtcgctgaagccgcatttgatacgccttcgcttacagttgaagccacatcgcttgctgttgagcaagccgctaaaagagtcgctaaagataacgctgaaataaattttattgatttcattttatattccttatgttagggataaatacacgtcttaaacgcatccattagatgccaacttattgaagttagttccatttaagtaaaaaagaagccaacctaaatggttggcttatgtattatgatttatagtaatgcagcaacttcgtcactgatttcaccgttgtgatatacgttttgtacatcatcacaatcttcgagacggttaatcaaatcaagtaatttcggtgcagtttctgcatctagttcaacggtggttgatggaatcatcgtaacttctgcattttcaattttgaaaccggctttttcgataccatcacgtacatcacctaaatcttcccaagcggtatagatttcgaatgaaccgtcttcttgcggttgaatatcgtctgcacccgcttcgatagctgcttcagttaaagagtcttcatcgcctgaagcaattaaaattaaaccttttttgctgaataagtaaccaacagaaccttctgtgcctaagttaccgccacatttagtgaagcttggacgaacttgtgaaatggtacggttagcgttatcacttaaacattcaaccatcaccgcggtaccgcccgggccgtaaccttcatagatttttgtttccatattggtgtcatcgccaccgcctacaccacgctcgattgcacggttgatcgtgtcacgagtcatattgtttgataacgctttatctactgcagaacgtaaacgagggtttgcagaaacatcaccgccacctaattttgcagctgttaccaattcacgaattaatttagtaaagatcttaccgcgttgcgcatcttgtgccgctttacggtgtttaatgttagcccacttactatgacctgccattctgttgtttcctttatatttgatttgtgaaaatttgccctcaccccttgtgggagagggacagattgaagcctcgtttagaggcggaaatcagggagaggggaagcggttagtttttgtaagaaatttacgaatttagaccgctagttttcccctctctctgtctgctcgctatacgcttcacagactgtctctctcccacaagaggagagagagtggttatttctttaaatattttgcaatcgccgccgcattattcggtgattttgttagccggatggcttcttcgacgctcacccatttaaacgctaaatgttcacttaatatcggttgtcgttcttgcgttaaggcaagtaaaaaccaatgttccgagcaatgcgtaacatcaggcgcgtatttataccgaaaatgcggaaaaatctcaaattctaccgactcgttgcaatccgttagcgtaagtttttccgctaaaatatcaatgccaacttcttctttcacttcacgaattgccgtttcaaacggctgttcgttcggttcaagcgaacctgttaccgactgccaaaattcggaatcgtcttggcgttgcagcatcaagactctacccgaattttctgcataaatcacaactaaaacggagttaggatttttgtaattcatttagataattattcacactaggtcggaataataaaaaaataacgaagctgaataatgcaaatactgaaaaatggataataagctcaggagtcatgcctaagtgatggattcctgcaattacgcctacaccattttttagagccattggaatgagataagccaataacagtatttttccccaatatttcttttttaacaaagcgatacttcctagtaaaaggaagaatgcattactgatattaaacagtacatctgaaagagtatagaagatgttgtcttgtaaaatagggattgtaaatgagccatataaactagataagtggtttactatcaataagacagctgtacccatcattagccatgacgtaagcattattgttaatggctttttcatttatttagctacttcctttactgcaattcccaactcttccaacgcttgcggatttgcaaaacttggtgcttcggtcattaaacatgctgctgcggtggttttcgggaatgcgatgacatcacgaatattttccgtaccggtgataagcatggttaaacggtctaaaccaaatgcaagacctgcgtgcggtggtgtaccgaattttaatgcgtctaataagaagccgaatttttcttgttgctcttcttcgttgatacctaaaatgctgaacacggtttgttgcattttcggatcgtaaatacgtactgaaccgccgcctacttcgtagccgttgataaccatatcgtaagcattcgcaactgcattcaccggatttgccgctaattcttccggcgttaaatctttcggagatgtgaacgggtggtgcattgcagaaaggttgccttcatcgtctttttcaaacattgggaagtcaattacccaaagcggtttccacgctgaaagatcggttaatgctaaatcacgaccaactttcagacgtaaagcgcccattgagtcggtaaccacttgccatttatccgcaccgaagaataggatatcgccgctagttgcgttagtacgctcaattaatgctttgaaaacctcttcgtttaagaatttggctaccgggctttggatgccttccataccggcattcacatcattgattttcgcccatgctaagccttttgcaccgtaaataccgacaaattgagtatattcatcaatttgtttacgagtaagcgttgcaccgtttggtacacgaagcacggttacacgaccgtctgctgaatttgccggctcgttaaatactttaaactcaacgtcttttaaaatgtctgccacgtccactaattctaatgggttacgtaaatccggtttgtctgaaccgaaacgttgcattgcttcctgccatgtcatgattgggaatttgcctaaatctacgtttaagcgatccaaccataagccgtgaatcatattttccattaattcacgcacttcttcagcggttaaaaatgaggtctccacatcgatttgggtaaattctggctgacgatcagcacgtaaatcttcatcacggaaacattttacgatttggtaataacggtcaaaacctgacatcattagcaactgtttgaaaagctgcggtgattgcggtagagcgtagaatttaccgttgtgtacacggcttggcactaaatagtcacgtgcgccttctggtgtcgctttggttaacattggcgtttcgatatcaaggaagccgttgtcgtccatatagcggcgtacaaaactggtgattttcgcacgtgttttgagtttttctgccatttccggacgacgtaaatcaagatagcgatattttaaacgttgttcttctgtgttgttttggttgaaatcgagcggtaaaacttccgagttgttatacacaatcacatttttcactaacacttcgatttcgccggtcgccatctctttgttgatttgcgattcgtcacgggcaattacttcaccttgaatttgtacgcacgcttctgaacgtaggcttgaagcaattttgaaaatcgcttcgtctttctcgtcaaagaaaacttgcacgataccttcacggtctcgaatttgcataaaaataaaacgacctaggttacgcacacggtgaacccaaccgcttaatgttacggtttgaccaacgtgcgagcggtttaaaacaccacaataatgagaacgcatcataaaaatatccttaagatttataaaataggttttccgctgtgataaattgcggagacaaaatctttgaaattatagcggaaaattgctgaaaattggagagaggaaaagaaacaagcggtcgaatttacagatttttttgcaaatttgaccgcttgttctgattaaagaagattaaaaatcagcgattaattagaaattaaagtaaacctaacacttttctaccgttgattgaggcaatattcgccatttcttctaaattggtaaagcgacagccggcagagagtaggctaagttcttgccacatatcaccttcacataacggcaccatatagtcgcaaatattatctgtaccgattgcaacggtaatgccttccggaattaattcatccgccggtgttagtgcattatggaatggctgtaaatcttctttacgaccgctatcaatccacgccattgggcaagcgatcaccatcatttgcgagtcacgcattttttggtagagcattttacgatattctttcggatgtgcaccgattgaaataccatggattgccaccactcgaccttgcataccgtgttcgattgctttatcgcataattgttcggtttctttttctttcggggtattaaattggtccacgtgtacatgcaacatcttgccgagtgatttggctttatccagcaaaatatccattgcttctaagcctttgccgaaatctaattcgtcacggtatggcaagccaccaatcatatctaccatttcagagcctatatcaaaccatttttttgcagttggctcaattacgccttttaaggtttggttggcaaattttaaggtaatatcgcttttatacacttcacgtgctttgtgagcggcaataattgcacgatcttcacatacgccgtcaatatccacaaaagttccgaatgcggtaaccccttgtgaaatcattaattcaatcgcttgtgaaaaacggcggtagtaatcatcaaccgttgaattgcgttttacttcatcaactaaatcccatttttgttgtagattggcattttggtaaatggcaattttttccggcgtcatcgtaaatgctcggtctgcatgggcgtgagcattcacccaaccgccttttttaataatttcgtcacgaatatggcttttgagcgtacgaattaattggctcatgttaatcttttcctctctacttattttgctgaattttaggtaaaaaaaagatctctaaaaaagagatctataaatgagttgaaatgccaaaaaaagagccaagcaccataatgaaatgatgtttggctaaatgagtgtttaagtatgttgtaaggttttgcatatgaatctatctagttcctttcttggcactaggactgtagtatatcttttaaaaaatcaaaaagcaaacgtttgctttttggatttgcattatatttacgcatgccttacaatttgccgcgttctcattggggtgctttacaaagctgagaaattacccatagaacctgatctgattagtatcagcgtagggatttgagacatttgctatacttaccaaattaggcttataaaagcatttaatcagcgtatggaaggcagctggttctactcaaatccttctagtttatttttagaaggaatagatgacaatgaaaaaacttttggcattatctgcttggtgttttgcagcacatgctatggcgcaaacacctgtattgacggtttatacttatgattctttcacttcaaagtgggggccagcgccaaaacttgaagcattatttgaaaaacaatgtcagtgtgacgtgagatttttaccctttgaagacggtattacgatgtttaatcgaattcgtttagagggcaaaaaaactaaagcggatgtgatgctcggactggataattttacgatggaagaagcgcaaaagtcaggtttcttcactgagcatgaattaacggttaacgatttcccttggcaaaataaagtgtttttcccgtatgattacagtgaatatgcttttatctatgataaagagaaattagcgcagccgccgaaatcattaaaagaattagtcgaacgccaagatttaaaagtgatttatcaagaccctcgtaccagtacggtcggtcgaggtttattattttggctaaacagcgtatacggtgataaagcggaagaagcttggcaaacgttagctaaacatacggtaactgtaggcaaaggttggtctgaaacttacggtgcttttttgaaaggcgagtccgatttggtactaagttatgcgacttcaccgctttatcatcaatggcatgaaaaaactgacaagtatgtcgctgcgcaatttgaagaaggccatttggttcaaacggaagttgctgcgattaccaaagtgagtaagcaaaaagcattagccaaacaatttttgcaatttttacatcaagctcaagcgcaaaatgtgatttcttatcataatgtgatgaaaccggtgataagtacagaagcagatcccgcatttaaagcgttacctgaatataaacaactagcttttatacagccgtctcctgagacagtgagacaatggatcgcaagctggcaacagagctggtaattgaaataattaggttattttaacggctaatggaatctttagccgtttttattgtctgctaagcggtaaaaattacaaaaatttttgcaaaatctgattgccaaaagggattacatttgttatttatacgcccttttgaattatcccctaaaattttttatatcaatttattctaaacaggggcaacactatccaacaaggagtgaaattatggctcaagtggcaggtaccacttcattaggtttattagctctagcaggcgttacaccttaccaacctaaaaaagacgaagaatacatgagcgatgcgcaaaaagagcattttcgtaaaattcttcgtgcgtggcatgttcaaattatggaagaagctgagcgcaccaaaagccaaatgcaagaagaagttgcaaattttgccgatccagcagaccgcgcaacacaggaagaagaattcagtcttgaattaagaaatcgtgaccgtgagcgtaaattgcttaaaaaaattgagcaaacgctaaatagcattgccgaagatgaatacggctattgcgaaacttgtggggtagaaattggtctacgtcgtttagaagctcgcccgacggcagatatgtgtattgactgtaaaacgcttgcagaaatccgtgaaaagcaaatgggcttataagcttaattagaaatggataattgaaattgataatggacaatctcatattgtccattatttttattatgatttaattatctattatcgattgttaatttcagaggtgtattatttttaactatatcaaatcgttgtttactcgtcgaaaaaacgttaaaaagcaaccgcttgtagagtttgaatcggaaggacgtaagcaaggcaagaacgctaaagcagcagaatcacgtactaaacgctctgcttcgaaagcgattgaaaacaaaacgcactcgtctaaaaaagccaagaaggcaaataatacaaatatgccttctcatctgttacacaaaaaatttacagtaaatgccggccattatgatattacgccgaaagactttccgaaaaatgcgttagtaatcgttgaaaaattacagcgtgccggttttgaggcctacgtggtcggtggttgtattcgagatttattgttaggacataaaccaaaagattttgacgttgcaactaatgcaaaaccggaagaaattcaaaaaatctttggtcgtcaatgtcgtttaatcgggcgccgtttccgtttggcacatattgtattcgggcgtgatatttatgaagtggcgactttccgagcggatcacagcaatcatagcagcgataaaatctcaaaagtcagcgaggaaggtatgctgttacgtgacaatgtgtacggcacgctacgtgaagacgcacagcgtcgcgatttcacggttaactcgctctattatgatccgaaacataacctgatttttgatttctttgacggtattgcggatctgaaagccggtaaattacgtttaatcggtgatccggttgtgcgctatcaagaagatcctgtgcgtatgttacgtgcggttcgctttatggcgaaattggatatgttcttggataaaccgaccgatgcgccgattcgtgaattagcccatttattgaagaatatcccggcggcacgtttatttgatgagtcattgaaattattgcaatcagggcaaggctttaaaacttatcaattaatgcgtcaatatggactatttgagcagttattcccagtacttgtgccgttttttaccgaacgtaatgattcgaatgcggagcgaatgttaagtaaagcacttaattcaaccgatgatcgtattcgtgataatttacgtgtgaatccggcatttttatttgcagcccttctttggtatccattacgtgagaaaatggaagtgctgaaaaatgaaggtggcttaaatagtcatgatgcgatgatgctggcggctaatgatatattggccgaaagctgtaaagcaattgcattacatcgccgtcatacatctgtgattcgtgatatttgggcgttacaattccagatgactaagcgttcgggcaaacgtccgcagcagacgctagaacacgtaaaattccgtgcgggttttgatttattagtgatgcgtgctgagattgaaggcggtgatttagttgagctttcagcgtggtggcatgaataccaatttagcaatgacgcacaacgtgcggaaatgcttaaagcggtcagaaatttgccgaattttgcaggcgaagaaaagaaaaaacgccgtcgtaagacatttagaaagaaaaagccggcgaagaaagccttagctgaataaattgaagtatggcgcaagtgagagcttgtgccttttattttagcaagtattgacagaaacggacattatgatgaaaacggtttatatcgcattaggttccaatttagataatccgcttgcgcaagttaaacaagcggtcgaatctttaaaaacatttgcaattaattttgaaattagtccgttctacggcagtaagccggttgggccacaagatcagccggattatgtgaatgcggtggcaaaattcgataccgatttaacggcgcttgaattgttggataaattacaaagtattgaaaacgctcaaggacgagtgcgaattcgccgctggggagagcgtacgctggatttggatattatcttatacggtgatgaacagattcaaaacgaacgtttaaccgtaccgcatatcgaaatgaaaaatcgagaatttgtaattgtaccgatgtatgatcttaaccctgatttggtactaccaagcggtgaaaaattagcggaaatttaccaacaatttaaatatcatcaaatggtgacgttctaattataaatgcacggaatgttccgtgcatttttttatgggagctattctgccggtgttgctaccaccgcttctgatttagccgctttgttatctgaggtttgcaatacggcacgagacttttcatcaaatttcacatcaatacggtgatcaaccaccacattcatattaatcgtgatcccttccgccggcgtttcaagctgtacttttggcgtacaagcggtcaaatttaggcaaaaaattgcaaaaagtaggctttttctcattttcttttatctagttgctggtaaatagaattttcaagattctgttcgacataagaacctgaattgatcatatgccaaaggctaaagatattctctttatgatgataattaaagttaattttggctttttcttgctgattaagctgcatttttaatttggcatctaacgtcatttcaccattcggcccaacattaatcaagctacgtaaatcggtaattttcgtatcattgagtaaatagagtaatagtcgttcggaatagccgctggtttgtgaaattgctttcattaattcgggctgaatttttaaattcgattccacagcttgggtcagtaagccgtcacatacataacaaggtttaccttccaaccaaaacggcaaggtagcattggctttgcctttgagctcaatttgctgatattgcaccaattcgaggatacgttcgaaattgatatttgccagctttaaataagcaatttgagtttgtggcaaggcaaattgctcaacactcaacgcaccatctaataaattcattgaaagttgtttaagcattaacggttttttacggctataaggataatgcccaaacacttttacatgaatattctcaatcggtaaaccaatattcaattgcccgatttttaagtcgataggctgcttcaaaccaaagtcaaactcgttgtcctgtaagcggtagggcaggttaaattcaattgcttttgcttcaccgttcggcatggaaagcgctgcgttacgaatggcaaaatgcccgccggcaataatgcctttttccgcactggcactaaaagcggtttcgcctcgaacagtgccattggtgattagccaatgttgacgaaacggaattaacggttggaacacttttgccgattgttctttccaatataatcgcccaatcagttcgcttgcggttttggtcagtttacggcgggcgaataattgaagcggtttgatttgttctgcttgcagttcgccttttaggttcaagttttcaatttcaccgttcacttgtaattttgcggacggcgatggaattttcccgccgtaatcaaaactaatttcaggcgattggatttgaagtccgccgttaagttgccatttttcataagcaaatttaattggttccagtaaacgtaattcagttttaggaatatacacgcctttctggtgaattttgcctaattcaccacttaatttgttgagttgtaccaaattttggtgccaatttccttgcccgctaacgttaagtttactggctattgtgtggatattggtatcgccccaaactcgccattgccacaaatcttgtaccgcatttttatccgcaacgtcttcaaaaaagtctaattgtcccattttgaagtttttggcaaaaccgtctaaatgcagattgatatttttaaaatcggggctttcacctttgaatactgcatgtaagcgaccatttacaccatgcttattaatctgaataccggcaagcggaaaacgtaattcatgaattgccagtaatcgttgtttcccgaccaaacgtaagagcgattttggctgaaatttaaaactcagatgatcaaatttaccgctaaatgctaccggtaaagaactgtacagaatgaaatcgtcatatttcacattaccggtgatttgaaacggcatatttaaaccgtcagtttgtaattcaccgtcacggctttccaatacaatatttcctttaccggcatttttactttgcgatagcaagttaaaacgtaagtaggttttaatcggataataatcgccatttgcaaaactgttcggcgtgagtttggcattaataaagccttgcagcggaaaatcttccagccaatcccaatagaatttgccctgtttaatttcaagggtttgtgaatcaaaacggaatgggaagtttaagcggtttttcggggcagtttcagaagcgaaagcccaatcgccgactaactgattttgttcatcggtttgccaactgagtagagagctgccttctcgaattacttcatttgcgacgatttctttcggtagaatccagtgataatcaccttcaaattgtgatggaatggcgaacaaatctttcggattcacgtgggcggaaaacagtaaattatgtttttcctgttcgctcggttgatagcttaaattgccggaaagcgtttgattggtaaattctgcagttaattcgaccgcttgttggcggattaaagcggtcaatttttgctgaaaaaatgcaaatttgctgtaactcggcgtggttagtaattgcgctaaacgtggatgcaaatcatcaggcaaatttctccaatataacgctttaatttccgcttcaccttcgggtaacaaagctagaattggcgtaagagagaacgtagatgatgaatcatccgaggttggtaattgagttaaacattgataatcaagaatcgctttatcgattgagatactatgctggttgtgccaatgtacagcaaggttatcgactgtaattaaaggacaattttgataggtgagagaaaatttcgctaaatttgcattttctaaattagcttgaataccgccggcgggcgtttgaatttgccagccgtccggtagtaaccaattggttaccgtagcaagttgcttacctgaaagcagtgtcgcaccgccgacaatcagcagtgcaacaaaagtaccgataacaagtaagctacgttttagcattagatcatattggtaaatggatagaacatcgctaataaggtagctaatgtccatccgaatgggtttttaatttgtttttcgcctttgccgagtaataaccaagcgagtaaagcgaaaatcacaaattgcacgagaaaataaactacatagggcaataacgacatatccggcataatttgcaattgttggtacagtacgaatgcactccataaataatttagtactaaaacgattagcgcaagctgtactaataatttaaagaaaacatcaagacggctttttgccaacatcaaataccaaccggcaagtaaaataccgaataacagttgggcaaaattattggcgcgcacaccgttaaataaagagggaagttcaacccaataaatcgctaaatactgaatcattcccaccgcaagaataccgaaagcgcagtaaattaaggtgttcatcggtttttcatgtgcgttaaataaccaataaaaaataccgagcatcaatgatgccaccccggcaagagccatcggattatgttttggtgtgaagccgattgaataaacgaaattgccaagtgcaaatacgatgaagaattttagtacgaataacaatctacccgtttgccccgggcaaatttctcctttccataacacaaaaaatgcaatgagatttgcaacgaaaaaggcgagtaaatacggcgagataaaaatcgcattttgtggtgcaaaatagtgattaagtaacatttgtacaaacagcattagtaccattggtagtagtgcgtgtgtggcaatatcatattttttttcagaatcgtgattgtgcgacataacttaaaattgatagataagtaaaattgaaaaatgattttagcgtgaaattatgccataatatatgtagttttttaacttaaataaggaatgaactatgcgaattttacataccatgttacgcgtaggcgatttggagcgttcgattaaattctataccgaagtattaggtatgcgcttacttcgtactagcgaaaaccctgaatataaatattcattagcatttttaggctatgcggacgaaagcgaaagtgcggttattgaattaacttataactggggcgtagaaagctatgaattaggtacggcgtacggtcatattgcattaggtgttgacgatatttatgcaacgattgaaagcgtgcgtgcggcaggcggtaaaattacgcgtgagccgggcccggtattaggtggtaaaacagtaattgcttttgccgaagatccggatggttataaaattgagtttattgaaaataaaaatgcacaggctgcattaggtaattaattttatttgctataaatagcctccggctattcgtagtgcaagcggtcaaattttgagagatatttgcaaattctctttaaaatccgaccgctttttctttaagtaggtgtaaaaccacctgtaatgaatagacaatgacagaacaagtaacagactataatttattaaaaaatcgttttcgtggttatttaccggtaattattgatgtggaaaccgccggattgaatgcacaaacagacgctttgttggaactggcagccatcacggtaaaaatggatgagaacggctatttagtgccggatcaaaaatgccattttcatattcagccgtttgaaggggcgaatatcaatcccgattcgcttaaatttaacggcattgatattgataacccattgcgtggagcagtaccggaaaatattgcgattcctgaaatgtttaaaatggtacgccgtgcaatgaaagatcaggggtgtcagcgagcagtgattgtggcgcataacgccacctttgatcaggcatttgtgcaagcggcggttaaacgtatcaatgcgaagcgtgatccgtttcatccatttgcaatgtttgataccgcaacacttgccggttttatgtatgggcaaaccgtattagtaaaggcttgccaaatggcaaaaatttcgtttgatggtaaacaggcgcattcagccttgtatgatacggaaaaaactacagagttattctgcgcaatggtgaatcgtttaaaagatcttggcggctttccgctcgtgagtgatagcgaatcagacgtataatacgagtaaaaataagcggtctattttccttatttctttgcaaaaaagttgggaaaatagaccgcttgtgtatttccagcgcttagaatttaagccaacatacccaattcataagcgataaagagtagggtgaatgctgaaagatagattaagcctgcaatggataaccaaaataatccgcctttcactttattttctccttttaatacaagtgatagatttaatgcagcaaagattggcgttgaaacgaatgaacaaatcattgcgaaagaaagcatttttgccacatcactcataaataccgaaataatcagaactccgatagcagcggtgattgtcatccaaatacttaaacttgccgcagagctttcttttttgtttagcaataaacgtaacgcttcattattagctcgtgaataaccgtcaattacggtaatggttgtgccaaacatacacataaaagcaatgaaagcgatcaataatttagaccaatcaccgatagcgaatgcatacattttaattaattgtgcaatatattttacacccgcttgttcaaccgtttcgcccgaaccatattggactaatgcgcctaacgctaagaatactaaggcgagaattgcagtaccgataaaaccgacattgaaatcaaaaataccgtcttcatagttcactttatttaaacggcgttttgccacgacccacattgagttgatcgcagaaatctcaatcggtgccggcatccagcccattaatgccacaataaaaccgagtgaagctagattccaagggctaggctcaataaaatcaggtgcgatttgtacaccaccttttgatgccgccacaattaccgccgtcaccgtggaaacggttagtgcaatcataatccatttagacagtgaatctagaaaacgatatttacctaataataaaatgccccaagtgatagcaataataattgtactggcaagcggaatactcagatcgaactgtacaccaatggcagagaataagaattttaaaattgctgcagtaacgatacctactgctgccgtattgatcattgctgcaatcacattcaagacaaagaaaatccataaatagattttgcctttttcttgatagccttctaataaagttttattcgtgcttagcgtatattgcacgccaaagcggaagaacggatatttaaataaattcgctaaaataataattaacgctaattgccaaccataaatcgcacctgcttgggttgaagcaacaatatgcgaaccgcctactgcagcagatgccattaaaatccccggtcctattgcttttagttttgattgccagtttgaaacaggttctagttgttgtgtttgtgtcatgttttctttccctttattgtaaaaaatttaatacggtttaagccattgtatgcctaaattcttaagagaaacaatcgcttttttgtgattgtttaattttgtaaaaaaaatgataaaaattttgtaagctgaaatgctttagctaaagcataattatataagctttatatggaattggtttattatgctaaattttgttgatttactagttttttataaatttaagttaattttgattgattgctgagttattgctctagcttattgaaactgctaggattcttgccgttttataacaattaaatgagatttatatttatgtctaacacagcacaaaatttaaggaatgatcctaaaaaagttgcgattgcttcaatggtgggaacagcaatcgaattctttgattactatatttatgccgctgctgcggtattagtttttaatacgcaatttttcaaaagcggtgatccggtttcggatgagttactttctctttccactttagcactcgctttttttgctcgtcctatcggctcggcgctttttggtcactttggtgacaaaatcggtcgtaagaagacgttagtcgcttcattgctattaatgggcggttcaaccgtttgtatcggcttattaccgacttatgcggatattggtatttgggcaaccgtgttactttgtttatgtcgtgtcggacaaggtttaggtcttggcggcgaatgggggggggcggcattagtagcaaccgaaaatgcgccggacggcaaacgtgcttggtacggtactttcccacaattaggtgcaccaatcggtttatttctagcaaatggtgcattcttccttgtcagttatatctggggtaaagaagggctcgttgaatgggcgtggcgtattccgtttatttcatcagtcgtgttagttatggtgggattatgggtgcgtttaaccttacacgaaagccacgtattccgtgaagcggaagaaaaaggtaaaacccaaaaagcgccggtaagcgccgtgtttaaacaccatatgaaaccgcttattttagggacttttattatgacggcaacttatgtgttgttctacattatgaccgcctttgcgcaagtttattcaagaacgccggcaaaactttctgaagccggtcacccgatgggactcggtattgagccaaatacctttaccggtttattactattaagtgcgatcgtttttggtgcgtttactagtatttcaggtcttttagctgataaagtcggtcgccgtaagtttctgttatgggtaacctttgcgatgggtattttcggtttagcaatgccgttattcctttcaaatggcactccgtattctgtatttgctttccttgtcgtgggtatggcgttaatgggctttactttcggcccaatggcggcattattgccggagctgttcccaaccgaagttcgttattcaggtgcatcactcgcttacaacttcgcctcaattgttggtgcaaccgtcgcagcgacatttgccattaaaatcaacgcagcctacggcattttaggcgtagggatctaccttgcggcaaatgcagtcttaaccttaattgcattatttatgtcaaaagaaaccaaagacctagatttaaccaaagcgtaaattgatttaaggtggtaaaaaaggctccgatatggagccttttttgttttacatataaataacaagcggtcaaattccctaaaattttgcaaaaaatctgaagaatttgaccgcttgtaataagaaaaaagtgcgtattaaacgcacttttttactttatatgggttggtgattagccgttgtatttttggaatactaagcaagcattcgtaccaccaaaaccgaagctgttagacattaccgttgttaatgctttgtcttgacgctctgttacgatatttaagccttctgcttgttcgtctaatgtttcgatgttaatgcttggtgcgataaagccgttatctaacattaataatgagtagattgcttcgtgtgcgccagctgcacctaaagagtgaccggtcattgattttgttgatgaaatcgccgggctcttatctccgaatacatttttgattgcgcctaattctttcacatcaccaactggtgtagaagtaccgtgtacgttaatgtattccacttcactgtttactgttgctaacgcttgtttcatacaacgttccgcgccttcaccgcttggcgcaaccatatcataaccgtctgaagttgcaccgtagcctacgatttcagcgtagatttttgcaccacgagcaagtgcgtgttctaattcttcaaccacaacaaccgcaccgccgcctgcgataacgaaaccatcacggtttgcgtcataagcacgacttgctttagtcgggttatcgttatatttggttgaaactgcacccatcgcatcgaattcggttgcacattcccaagaaagttcttccgcaccgccggcaaacacaacatcttgtttacctaattggattaattccattgcgtgaccgatacagtgagctgaagttgcacatgcagaactgattgagtagttaacaccacggattttgtatggtgttgctaaacacgcagatacacttgatgccattgttttagttaccgcataaggaccaactgctttcacaccacgtgggccacgtactgcatcacaagccactaattggctgtgtgctgaaccagtacccgcaccgattactaaaccggtacgatcgtttgatacttgatcttcagttaaacctgaatcttcgatcgcttctttcattgaaagataagcataagcagctgcatcacccataaaacggtaaattttacggtcaattaactctgctggatttaatttgattgttccggcaacttggctacgcatacctacttcagcaaattcaggaacgaattcaatgccggatttaccttcttttaatgaggctaaaacttcttctttattgttaccgatactagaaataacgcctaaaccagtgataacgactcttttcattttgtttccttcatcataattgatttcgtaagatattagattgagcttacacttgttcgctaaagtaagctactaaaacttgtctattttacatgattttaggactggtctgaactcttttcgcgaaagatagcggtctgatccgagctgttttttgcaaatttttgcgagatgtcaaaagtaacaaggcaactgactttacttttttgagcaaaatgttaaattgatcacattttttataacaagggatttaacgtggaagagttggagctatcagcagcttacttacatcagccattgtctggtgtgtcggatgctttgtcttcaataactcaccagttggaatatgctattcctcgtattgatgccttaaatgattttagaattaaacgtgctttagctgcgaataacccgcagtttcagtacgttttttctttattacccctcttaattcataccaacagccctgaattgcccgcttatgtaaaaaatgcgccgagcggcattgtccaatttcagctttcggattttcaaaatcgttatttaacaactattgatttaagtgtagaggaagtcgaaagcttttctcaaaatccggcgtttgatgcattgtattcgatggggagtaccggcagtattacccaaaccagcttatctgatttggacttgtggctttgttattctgatcgcttgagtgcggttgaatatcaattaatcgaacaaaaactcactaaaatcaaacattgggcaaagcattttgatgtggaactcaatttttatttaatgaatccgagccattttaaagcgaatttagctagcaatgatataaatgcggaacatagtggatctgcgcaacattttttcttgctggatgagttctatcgttcggcaattcgtttatccggtaagcgtttattatggcttcatctaagtgacaaacaatatcaaaaatgtatggagttggcggactttgatcaaagtgaatggattgattttggtgatttttcttcactttcaactgcagaatttttcggtgcaagtttatggcaattatataaagggattgattgcccgtataaatcagcacttaaaattttattattggaaagctatgccgagacttatccggaaacagcgttaatttcaaaagtatttaagcaaaaattgctcaatcaagcgccggaaaaatatcattttgacccttatttagcgatgttggagcaagttacggtttatttgaccaaccgtaaagaatttgtccgcttaggtcacgttagaatgtgcttttatatgaaagccaatgagggcgacaaatccgattcttggcgtaagcaggcgttattagaattagtgaatggctggcaatggaatgtgaacgaaattaaattgctggataaccgtgagagttggaagattaaacaagcgattagccatcaacaaattattgttgatttgttgttgcagagttatcgtaatttaattcattttgcccgcaagtttcatattgatccgagcattttaactaatgatatcgacaccttaatgcgtaaattgtattcggtgtttgaagtcttaccgggtaaagtgccgttgattaatccgcatattgccaaaaatttatcggaaagtgccgtaacctttattgaggcgagagatggctctacgctgcagtccggttggtatttaattaatcaagcgccaagaagcccgtacaattcggaattacgttatgtgcgccatgcaaagaacctgaccaaagtagtggcatggggctattttaatggggtgattacctcaagtactcagctacacttaattagtcgtagcctagatttaccgaaattacgccaatttattacggatttaaggctctcttttccagtgacggcaccggtgatcagcgaacaggatatgttacatccaaatgagattcgcagcttaattttggcggtgaatttagtgaatgatccgacccaaaaactggcggatatgcgccgtagcgtacagccgagcgatttattcaactttggttcttcacaagaaaacttggtggggagcgtcagtattatttaccgtaatatgtggaacgaaattcgcacactccaatttgaaggggatgatgcgatcttaaaggcgttaaaactgatttcgaataagatctatcgaggttcagcaccaccgcagtcggtcaatgtattttgttatagtcgtcgttttagaagtgagttgcgtgagtttatcgctgatcttgtacaccgttgtattacgattcaaaccggcacgatttcacatcggcactcgttgaatacgttgaaggttgcaggtaaaacgtggcaatttatttttgaaaaacaaaaagttgcgattcagcaaatagaggatcaagcggtcgattttactgaaaattttgcaaatagcgcattaaattcggagagtaatgggctgacgttcccacgtgaaattgatgaatttgcgagtgaagggttcttacaattcttttttgaagacaatccggacgagagcttcaacgtttatattttagatgaaaagaatatgttagaagcttattactactgttttggttcaaaagaagaaaaagtgaaagaaatcaatcgactgcattcggtggaagaaactgccacattagcgaccagcagttttaattttcctcagttttatcaacttattcgggttaacggtgaaatgcaaattgtgccgttccaaagcaaacaacatagagactatttagcgcagttacaagcggtctaaattggctaatttttacattataattttaaatttatacacaacatcattatgtccgaaggtatttctcatcttgccaatcctgaattggcgaaaatcgttgttttactggcaaccagtattacgattgttccattatttaaacgtatcggtttaggcagcgtattaggttatttagtcgccggctgtcttattggcccgtccgtactcggtttattccaagatcctcaagcaattgtgcatttagccgaacttggtgtggtcatgttcttattcattatcggtttggaaatgcatccggagttgctgtggagtatgcgcaaagctatttttggacgaggctttttgcaggttgcaacttgtgggacgttacttactttcgccggtattcatattctggggcttaaaccggaggtggcatttattgccggtgccggttttgcgttgtcttctactgctattgtgatgcaagtgttagaagataaagggattgccagcaccttaaaagggcagcgcattgtttcaacactattatttgaagacttagcaattgtgccgttgctggcttcgattgcttttctttcaccggaagcggaggcagaaccgacatttaatttcacttcgattgggatcgcaattgtcggtattatcattttggtcgtgggcagtaaatgggtgatgaatccgctgtttcgaatgatttcgaaagctaaagtacgtgagatgatgacggcagccgccttgctggtggtattaggtgcggcttggttaatggaagcgagtgggctttccatggcaatgggagcatttgttgccggcgtaattttatcggaatcggcgtttcgccaccaattagaagcggatattgaaccgtttcgtggcttattactcggcttattctttatgggcgtagggatgtcgctcgatttaaattttgtctttaatgatttgctatggttattaagtattgtggcgatatgtgtgctgggtaaagcgttggtagtgtatgtgatcgcccgcttaacacgtttaagccatagagaatcaatgatgcgaatgtcgattatggcgcacgggggggaatttgcattcgtattattctcagcggcggcggcaatcggtttatttaatcaagatcagcaagcaacgtttacggcggcagtgattgtttcaatgctgatttctccgttggttgtgttgtttgtacaacgtgcaatgatgcgaaaatccgcccaagaagcgccgaatatgacggatattgagattgccgaagatttggaaaataacgtattagtcattggttttggtcgatttagccaaatcgtatgtcaaacgttattagcgagaggcattacggtaacggtgattgattccagcactgatcgtattcgtgcagcggcaagtttcggttttaaagtgtattatggggacggcactcgcttagatgtgttacgcgccagcggcttggcgaaagtagactgtgtggtattaggtattaataatccggaacgcagcgcactcattgttgaacagattaaacaagagtttccgttaacgccgattttggctcgaacctatgatcgtcatagtgcgattgaattaaccaagcgacatgttgatttccaaattcgtgagacgtttgaatcggctttagtgttaagtaaagcggcaatgatgaaattaggtattgatgatattgaagcggaaagtgtgatagaaagcgtgagggctttggataaggaacgttttaaagaagagctgatttacggttcttcggttgaaattgtacgtaaatattttacgccgaaaccgtttgtgaaaccgcaacaagaagcggaagcgctgaatgaatctgctgcagaaattttagcagaggacgagagcgatcagacggcgaacagtaaaaataaataatggctaatttatcgaagcgataaaattcggattagatcaaatctttttacaacaaagggcgagttatcgcccttttcatttacatcatgctaacaactctttatgatggcatggctatgaaaaacacgtatttcggttagcattcgtttgtctttatagagttagataaggtttatttatgctccctgagttgggttattttgcattgattttggctacagttgtagctgtgtttcaagtgggcttatcgctgtggggcgaaccatttaaacgcccacaattactgagctttaatccgctatttagcggagtacaagcgttatgttgtactatctcgttcggaacattggcgcacgcttttttgcgtgatgatttttcggtcatttatgttgcgcagcattccaatagtcaattaccggacttctttaaatttgcagcgacttggggcggacatgaaggctcaatgttattttggctcaccgcattaaccctttggaccggcgtgttttgcattttttccgataaatccgaccgcttgtttaactatcgtacccaagcaatgttagggctgataagccttggctttatgctatttatcttattagtttccaatccgtttgaacgtagctttccaccgccgccggaaggacgagatttaaacccgatgttacaagatgtcgggttaatctttcatccgccgttactttatttaggctatgtcggttttgcggtaagttttgcgatgattgtggcgagcttactttccggtgtattagatgcggcaactgcacgttggattcgcccatgggcgatgatttcatggggatttttaaccgctggtattattttaggcgcttggtgggcgtactatgagttgggttggggcggctggtggttctgggatccagtcgaaaacgcttcattaatgccatggctattaggtacggcattaattcattccttaattgtgagcgagcaaagaggcatttttagctattggacgattttattggccatttttgctttcgcattgagtctacttgggacttttattgttcgttcaggcgtcttaacctcagtacacgcttttgcagttgacccggatcgagggatggcattactgattctatttttcagtttaagttttattgcattagcgctattcgctttccgcgtaaatttatggcaaggcgaggtacgtttccgcttgttctcaaaagaaaccggctttctgttattgaacggattgttgacgatcgctacttgcgccgtggtactcggtacgttttatccgatgatttttaccgcaatgaattggggttcaatttcagtcggtgcgccttatttcaatagcatatttgcgccgttagccgtgtttcttatgttagcgatggggctggcggtgatattacgttggaagcagattccgctaaaaacgattttagtaaaattagcgttcttaccggttgcgttgggattggcgctagccttgattcaacatacgattgcacaaacgcagttatatcaattcgagctattacctttattatttgtgacgttagctatgtggatcattctgacccatattccgtatttgcaatatatgtggcaaattcgaccgcttgcaatgcgtttagcacatatcggttttgccatttgtgtgattggcgcgatgatgaatagttattatggcgatgagattggcgtgcgtctcaagccggatcaacaagcgaatttagccggttttactttccgatacgaaggctatcgtgatgttattggagcgaactatacagcggaacaagcgatttttagtattgcgaaagcgggagaagaattggcggtagtcgtaccggagcgccgttattatgatgtaagaactatgacgatggcggaagtcggtttgtatcatcatggcttagatgatgtgtatatcgtaatgggcgataaattcggtaacttagaatatgcgttccgcttacattataaaccttatgtcagagcattatggcttggcggtattatgatggttatcgcctcaattttggcgctgtttggttatcgccgtaaataaattttgtaatggatgaataagatgaaaaaagcctttttgtttttgcctttattattattgattgctttagtggcgtttcttaccgtgccattaatgaataaagacgcattagcgccgaccgaggattggcgagataaaccgtttcctgaatttgtcggtaagaatttattagatccgcacgcacgtttaaataataacagcttaccgaaagaaccttatattctgaatgtgtgggcgagctggtgtacttggtgtattaaagaatttccgattttattaaagcttaaagagcaaggtgttccgattgtcggcttaacttacaccgatgaaccgaatgcggcgagagcggcattaaatcgttggggaaatccgtttagcctgattattgatgattatgaacgtagctttttaattcaaacgctaaaagtctcttctgcgccttccagttatttaattgataagcatgggatcgtgcgttatcagcaaaaaggctataacccggatttcgaaaaagattttcttcctcgtttagaagcattacgtaaggaaccttaatgaaatttttgcaaaaaatttggctttttttaccgcttgtattaagtggtattgcacaagcggaaatggttgatacctttcaatttcagcaagagtcagaccgagtaagagcggtggcattagcaaaatcgctgcgctgcccgcaatgtcaaaatcaaaacctggtggaatcaaatgccactaccgcttataaactacgtttggaagtttatgaaatggtcaatcaaggtaaaagcgatgaagaaattattcaaattatgaccaatcgcttcgggcattttgtgaattacgatccgccggttaatgctcaaacttgggtgttatggggaatgccgttcggattatgtttaattttattaagcttaattgtttggcgcacgaaaaagaaatagtaactcgtatttattgaagcgaatttgatgacgataagatgaaaacaagagcagaaattaatcacgaaaattatcagcaagcggttaaatttgccgaaaattttgccgatgagctgaaagcggagtatctcaatgaagcggaacaacgctatcattttgagcagcaaactagccaatctttgcaaaattttgctaaaaacagaccgcttgtcgggctatttctattagcgttaagctttatagcggctgctattttttattggcaaacggaacgttatcagatagtgaaccaaggcgagcagttgcatcaagcttttcaaatccaaacagggctagaagataaagaacaaaaaaataatcgttatgttttaagcttacaagagcgcttacgagaaaacccgaataacggggaattgtggtatgagttggggcaagcttacgctttaaataatgattttggttctgctttaatttgttatgataatgcacaaaaagtgttgggtgagaaggcagcgattttcggtgcaatggcaacagccaaatattatcaagaaggaaaaacgatctcggctcagacccaacgatggcttgataaagcgttgagcttagataaaaaagagagtaccagtttactgctacttgcatcgcatgcttatgcgaataaacagtatcaacaagcgattgatttttggcgtcaggtattagacggagagaatgaatctattgatcgccgagcaattattcagagtattgatatggcacgccaatctttaaaataaaaagcgacagcccctgaaaggtcaggccttaaaaccgacttctcggggctgttttatttcattttgctttcttaagctagctggatagtttggaaatcgtctctcacttccggatcaccttttttccattccattttaccgaatttgccgagtgaattatcaataaggcgaacttgttctaattttacttcccaaacggataacgcatcatcaacatatggcttgaattctgctttatataagtcttttgcggcttgtgcatcttcaccgcttaagcagtgcgttgtaccaagaaattgaataccttgaatggaggaatgaaaacgcgtcggtgagaaaatcgttccggcgactttaggatttgtatgtgcgattttggaatgggtggtttgctctgagctcatatagattaagcgataattagcttcatcaaatttataaaaacaagcaaaggaccaaggttggttattttctgtcacagacaaagtacagagatattttttattaaggaaattagctatgcgtttctgcatatggacccctatttattaataattgtaagatatgtcaatttttaatgttttgacatactgtttaataagcaaaatcctttttggcgaagtaaatattcaagaatgaacagattcattttgacacaaaattgtaagtttagtaaagtgaaaagccctttttatggctattaataggccttaatttcaaagagatacaaccactcgctgattatttgttcgtcaaaagtaaaaatttacatttttaacattgcgaaaaaaaacagtataaatataattaaaaataatttgtattaacaatacctgttgataaaatttacataaattttagttgaggagaacttatgactgtgactaatcgtcaagaagtcttacaaaatcgtttaggacctgaaattcaagaattaaaagaaaatattcagacaattgtgctttcaacagtagataaagacggtaatccgaatgtgagttatgcgccttttgtgattaataatggcgaataccaagtactgatttcaacgattgctcgtcatgctcgtaatttaattgatgtaccgaaagtatcattaatgttgattgatgatgaaacgaaaagccgtcaaatttttgctcgccgccgtttaacgtttgatgcgacttcacgtttaattgaacgtgaaggtgaagagtgggaaagtggtttaaaagcattaaaagcacgccatggtgatcttattgatgagctttcaaaaatgaaagatttcaacttattcagttttaaaccgacacaaggccttttcgtaaaaggctttggtaaagctttcgaagtaagttcggatgatctagtgaatatcgttcacctagatgaaggtcataaaacagaataactatataattaaacatttactgtgctagttttggctagcacagtttttttatcttgtctaaaggagaatgattgtgattaagcttcgttttaatctatctattgcagcactttgtgttttgcaatacaacagtgcattggcacaagagcaaatgcaactcgacaccgtgattgtaaaggatggtattcagcaacaaaaaatttctgaaatcaaaaaatctgcaaaacaactggcaaaacagcaagtacaagactcacgagatctcgtacgttatgaaaccggtgtgacggtagttgagaccggacgtatggggagtagcggttatgcggtgcgaggggtagatgagaaccgtgttgcaattacagtagatggtttacatcaagcggaaacactttcatctcagggttttaaagaattatttgaagggtatggcaattttaataatacccgtaactcggtagaaattgaaacacttaaacaagcgacgattcgtaaaggtgcggattccgttcgtgtcggtagcggtgctttaggcggcgcagtaatgtttgaaaccaaagatgctcgtgattttttaacggaaaaagattaccactttggttataaaaccggttattcaagtgcagataatcaaaaagccaactcactgacctttgccggtcgttataaaaattttgatattttagcgttaaaaacttggcgtgacggtcatgaattggaaaactatgattacaagacggctgacggtagtgtacaagggaaagaacgagaaaaagccgacccttattcaattaagaaagacagtactttaattaaattcggttattcaccttcggataatcaccgttttagtgttgttgcggatttgtatgagaagaaaaatagaggtcatgacttttcttacaacttaaaaccgacaacttatattaacgttgacgaatatgagttacgtcatacgaatgataaaagtaaacgccagaattatgcttttgtgtatgagaattttagtgcgaatccattatgggatacattaaagcttacctattcaacacaaaaaattaaaaatcgtgctaggacagatgattattgtgatggttcgcattgtaaggaaaccgagaatttagccggtttacagctaaaagatggtaaagtggttgatagagacggtaatcaaccgaacttaggcgtggatgaattaggtttaaccacaattaccgattcaaaaggcacttatactgagggagtaaatctcgttagagcttattggtttgattgtagtgtttttgattgtaataaatctgtcacagcatattataaagattattcaaataatataacctcggaagaggttgcacttacaaaaacgtatacggacgaaaaaggacgtaagtttgcaactttagatccaaagagtaaatttaaaagcatcctattaccaggaagtaaaggctatacggaaaatatttatactgaacgagatttagatacggatacaaagcaactgaatcttgatttaactaaatccttctctttactcggtcaagaacattcattggaatatggtggtagctatagccgtacagagaaaaaaatggttaaccgtggcggtttcggtgcaacgagtaatactcaatggtggacaaagcgtttccttggtatgcggaataacttctttaaaggaacggaagaagtcattacttgtaaaaatgcgaccggtagcgatcaatggaatggcttaatttgcccgaatgaagatacgttttcgttcttaattccggttgaagcgaaaaatggttcattatattttgcggataatttgaaagcgaatgactatttaagttttgatatcggctaccgctatgatgatattagctataagcctaaatatgttgcgggacaaacggcgaagattccggatgatatgctgcaagggttatttgtaccgttaccagatcgaccaacaaaagagcaaattcgccaaaatgcggaagaaaatattaaatatttatcacgtaatgttaaatatcaaaaacattcttattcattagcggcaactgcggatccgtttagcttcttgcgcgtacaagttaaatacgcaaatggatttagagcaccgacttctgatgagctttattttacctttaagcacccggattttaccgtattgcctaatgtggatcttaaatctgagcgtgcaaagacgaaagaagccgcattaactttacatggtgatttaggctttattacaaccagttactttaaaacggattatgataattttattgatttgaagtatcttggtcctaaaaatctaatgaatgctttcggcggcagtgcaacggcaagaccttatcaaatttatcaaaatgtaaaccgtcaagaggctagagttaacggcttagaaattagttctaaattgaatttcgggcaattatggcaagctttagaagggttcaacgcaagttataaatacacttatcaaaaaggtaagatggaggggaatttaccgcttaatgcgattcagccgagaacttctgtgtttggtttaggctatgaacatccggaagagaaatttggcgtagatgtgtatgttacccgtgtaagcgcgaaaaaagcggaagatacttacaatatgtatcatagtgaagaaaaggcaaaagacagctacttaaaatggcgcagcggtgcttatactttattagatatgattgcttatgttaaaccgtggaaaaacgtcaccttacaagcaggtgtttataatttacagaatcgcaaatatctgacttgggaatcggttcgttcaattcgtccatttggtacgagtaacttgatcaaccaaacgacaggtaaaggattaaatcgtttcactgctcctggaagaaactttaagttaaccgcagaggtaactttctaagtaaaatgcccgataagtcattgcttatcgggcattttttgcaaaaaaatcttaaaatttaaccgcttgttagagttttaccggctcgataatttcactagggtagcaacctaatactttgatatagcttgtaacatcttctaaagcttttagtgcttgttgggtattttcagcatgcgtattcgcctctagttccacataaaacatttcttcccaaggtttaccgtaaatcgggcgagattccaatttggtcatacgaatctgatactgtttgaataccatcaacgcatccactaatgcaccggcttgctgagaagtggtcattagcaataatgtttttgtttgtacttgcggtgaaacgtttatcgcttgtttcgctactacgataaagcgagtgatattattctgttggttagcaatatcggttttgatattggttaaaccgtagagctttccaccatcctcattacctaatgcgacaatgttcggcttatttaagcgtgcgaccatctgcattgcgtgtgagctactttcgcaatacttgatatggactttattcaggctttgaataaattgactgcattgttggatcacttgcggatgactgtacaaggtatcaatttcagcaagatcaatattgccgtttgctagtacgcagtgtttgatcgggtaagccagttcaccaaccaccgctaaatcagtatgttgtagtaaatcatatacgtcattgattgaccctgacgtggtattttcaagcggaagcacaccaaattcggcttcaccttcacttaccttatcaaacacttgttggaacgaatcacaactcaattcaattaaagaaccttgatattttttcgcaaattgacgagacgccatattggaataggaaccacgcatacctaaaaaggcaatcgatacattctgttctttctgctcgtttaatttattttgcagataattttgctgagtcaacacggaatcttcaataatacgttggaaaatttgtgtgacatattgcggatctaattggtaattttccgcttcggcatggctcactagtgcttgtaatagcgctttttctcgttcgatatcacgtagcggcttttgtgtgatttctttgctacgaacaacatcaaaagcgagacgatgacgttcggcaagtaatttcagtaaatggcgatcaagttgggtaatttgctggcggatattggataaatctaatgacatcgtgttttctcttaattatttgatttatcaagattatagcgatttagttgataaaaaaaagataagcggtcaaatttgcaagattttttgcaaatttgaccgcttgtaagaatagagcgaggttagttcgcaatacccttatgacgtaatagtgcatctaaggttggtttacgaccacggaagcgttcaaacaataccatcggttcttccgaaccgccacgagtcagaatattatctaaataagattgaccggtagctcggttgaaaataccgtcctcctcaaatttcgcaaaggcatccgccgataatacttctgcccataagtagctgtaataaccagctgcataacctccggcaaagatatggctaaagctatgtggggtacgcacccattcaggtgtgcgaaccaccgcaacatccgcttttaccgcttttaacgtatctaataccaagccttcacgaggttgagccaaatgtaaacggaaatcgaataaaccgaattctaattgtcttaatacaaacattgccgcttggaaatttttcgccttgagtaactgggttaatttatccttcggtaacggttcgccggtttgataatgccctgaaataaattcaagcgcttccgcttcccaacaccagttctctaagaattggctcggtagttctaccgcatcccacggcacaccgttaataccggcaacatcgccgacatcaatttgggtgagcatatggtggataccgtgaccgaactcatggaataacgtggtaacttcgtcatgcgtaaacagagccggtttgtcgccaatcggtttattaaagttacaagttaagtatgccaccggtttttgtaacgaaccatccgctaaacgtttttggttgatacaatcgtccatccacgcaccgccacgtttattttcacgtgcgtataaatctaaatagaatgaaccacgttcttcgttttgctcatcgtaaatttggaaaaaacgtacgtcttcgtgccaagtatcaatgccgaatttttcttcaatacgtaaaccgaaaatacgtttcattaattcaaataagcctgaaagtacacgatcttccgggaaataagggcgaagttcttcatcattgatcgcatataacgcttgcttttgcttttcgctatagaatgcaatatcccacggctgaagttcggttacaccgtattcttgttccacaaaagcatgtaattcagttaattctttttcaccttgtgcttttgaacgtttggctaagtcttctaagaaatcgacaacttgttgcgggttctccgccattttggtagcaagagaaagatccgcataggtttcaaagcctagtaactgtgccatttctaagcgtaatttaagtttctcatcaatatttgccgagttatcccatttgcctgcatttgaaccttgatcagaagcacgggttgcatactctttataaattgctgcacgtaattcccggttttcgcagtaagtcaataccggatagtaactagggaattctaaagtaaaacggtaaccttttttacctttgctttctgcagaaagttttgctgcttctaaggcagattcaggtaagcctttaagctgtgcttcgtctgtgatcacgatatcccaacccatggtcgcatccaatacattgttactgaattgagagctgagttcagataaacgagcagacacttcgccataacgtttttgtttatctgctggtaacgagatacctgaaagttcgaaatcgcgtaggctgttttcaatcgcttttttctgtgcaagcgaatagctctcaaattccggtgagtttttaagttttacatagccttgatataagccttggtgttgtcccgcccaagtactgtattcagaaagtagcggtaagcaagcctgataagcttcacgtaattccggcgagttttttaccccgtttaaatgaccgataggcgaccacgcacgcgcaaatttatcgccggcgatggcttgtggcatatagaaattttcccaggttgggttttcgatttgggcaacttgttcaatggtatcacgacattctttaatcactgcttctactgcaggttggatatgctccggtttgatttgtgaaaaggcaggcaaaccggtgtaatttaaaagaggattagacattgtttatttcctttttattggtcgaaatgagtaattagtcttagcatcatacaccaaagtttcatagaaaccgaaatcacgaggaattttttagttattttatatgtaacttgtttggtgaggataaatcatattcaataattatatataatttttttaaggttattattgcaaattagtgtgttttaaagtaaatttgcatccttaatttttttatggttttaggttgaataaaatgaaaaaaaatagtttggcgttgagtttattgcttttaatctcaaatacgctatctgcgtcagaagaaactctagatatgattaccgttgaaggtagtacgccggatacaaaaggtaatttgttaggagatggtctaaatatcaatgaaaaagtggtagatagccaaatactaaaacaacgaggagcgacattaggtaatgcattatcaggtgagttggggattcattccagccaattcggtggtggcgcaagtgcacctgttattcgaggtcaagaacgcaagcgtgcaaaaattttgcaaaataacggagaaatcttcgatatgtcagagctatctcccgatcatgcggttaccgtagattctttgcttgcaaaacgtattgaaattttacgaggacctacaaccttactttacagcgcgggaaataatgccgggctgattaatgtggttgatgagaaaattccaagtgctgtaccggaaaaaggatatgaagggcaggctggtgtacgttttagttctgcgaataaagaacgtttaacttatgtcggttctacttttgcattaggtaataatttcgccttacgtttacaagggttatataacaaagcttccgaatattatgcgccgaaattcaccattgaaggtaaaccttatcatcgggtaccggatagtgatcttcagtctcaatcgggaacagttggactttcttggattggtgagaaagggcatttaggtgtggcttacacggatcaacgtaataaatatggtttagttgggcatacgcatcaatatgatcattatacgattagtattatccgccaaggtgtgatgtttgagaaaggttatctccgcttttatccgcatttagctgaagaaagtgatattgattataacaatccgggacttcgtttagatcatacgcatattcccggcggttctcagtatggtatgcaagatcacccacatggtaagccttggattgatatgcactccaaacgctatgatcttgacggggaattaaagaatccgctaaagggcattgaatcactaaaagtcactgcgaattacgttgattattttcatgatgaaaaagatggcaatagaatagagaattactttaaaaataaaggaaaaaatctacgtctcgaattagtgcattcagaatggaatgggttaaaaggggcgattggagcacaatattctcatttacagaccagtgctttatcattagaagctgcccgtgtcgtgaataagcaacagctattgaataatccgaaaaccaagcaatttagtgtatttggtattgagcgcttaaatctcggcgacttttcatttgaagttagtagtcgtgttgaacgtcagaaaatttcaatggattatgatgttaagttaattgatcaatggtcaggttttaatacgccaatgccaaatttggagccacataaggaaaccggttactcttatggttttgcaaccaattggttttttgcaccggatcataaactgactttaaatacttctcatcaggaacgtttaccaaatgctcaagagctatatgcgcacggtaaacatattgcactgaatgcttttgaagccggtaataaaaacctaaataaagagcgttcaaatcatattgagttggctttagcttatatgggagagaagtgggattataaattcaatatttatcatactcattacgataattatatttatccacttacactgaatgataaccgtggtccgaaatctttgactgatgaatataatttgaaggtaaaccgttattaccaaggaaaagcgcgctttagtggagtagaaggcgaaatcggttatctctttacgccgaattatcgtcttgccgtatttggtgattatgttcgtggtaaattaactgatcttcctgatattccaaaaggctattacatttttggtgccaaaagagggcaggtttcaggttgggaaacacaacctgatatttcagcaccacgtgtgccgccattacgtttaggtgcaagatttaatgctgatttcaatcagaattggtcgggaatgttggaatattatcgagtgtttactcagaataaagtgtcgaaatatgaaaaagcaacaccgggctctcatcaagtgaatgtcggtttaacttataataaagtattgaatcagatggaatatcaagtattcctaaaaatggataacttgctaaatcagaaaatccatcagcatgtgtcttatttacctcatattccacaaatgggtagaaatgcgatgcttggtatgaatgtgactttctaataaaacttttagaataaataaaatccccaaagtatttaatcgtaccttggggatttttttattcttatgtgatggggttagaatttcacggtatgtccgtagctttcaataattttttgaatacgttcaagatcttcttttggcggtggcaatacaccgtctaattcatatttatagccaagcgtttcccacttgtgtgcacctaagcggtgatatggtaacaattcgactttttcaatattttgcataccttggataaattgccctaagcgatgtgcggaatcatcatcatcagtataacccggtacaacaacataacgaatccaagtgcgtttatttaatttttgcagatagcgagcaaaatcaagcgtacgtttattcgatacaccgattaaatcttggtggatttcatcatttagttgctttaagtcgagcatcactaaatcggtcacttcaagcatttcatcgacgactgggctatagtgacgaacaaaaccattggtatccaaacaagtatcaataccttccgctttgcacgctctaaaccaatctcgcacaaattccatttgtaatacagcttcgccaccagatgcagttacgccgccgccagtcgctttcataaagtgtttataggttaccacttctttcatcaaatcttcgacactgatttctttaccgccatcaagatcccatgtatcacggttgtggcaatatttacaacgcattagacaaccttgtaaaaatagaatgaagcgaattcccggaccatcaacagtaccgcaagattcatatgaatggtaacgagcaatagacatatatgattccttcgattaataaaataataaattcgttttcgttattttaacagaatatcaataaagaagcggtcagattccgcaaaaattttgcaaaatctgaccgcttaaagaactcaatgtgagtgattacattgattcagtaaatgtacgtgtgattacgtccatttgttgctctttagttaaagagttgaaacgtaccgcataaccagatacacgaatggttaattgtggatatttctctggatgctcaaccgcatctaataatgtttcacggtttaatacgtttacgtttaagtgttggccaccctcaacagttgcttcgtggtggaagtaaccgtccattaagcccgcaaggttacgtttttgtgcttcgtaatctttacctaatgcgtttggtacgattgagaaagtatatgaaataccgtctttcgcataagcaaacggaagttttgcaacagaagttaatgatgcaaccgcacctttttggtcacgaccgtgcattgggtttgcacctggaccgaacggagcaccagcacgacgaccatcaggtgtattaccagttttcttaccgtaaaccacgttagaagtgatagtaagaactgactgtgtcggagtcgcattgcggtaagttttgtgtgtttgaattttcttcatgaaacgttcaactaagtcgcaagcgatttcgtctacacggttatcgttgttaccgaattgtggatattcgccttcaatttcgaagtctaacgctacgtttgaagctactacgttaccatctttatctttgatgtcaccacgaatcggtttaactttcgcatatttgattgcagataatgagtccgccgcaacagaaagacctgcgataccacatgccattgtacggaatacatcacgatcgtggaatgccattaatgctgcttcgtagctgtatttatcgtgcatgaagtggatgatatttaatgcagtcacatattgtgttgctaaccaatccatgaagtgatccatacgatccattacatcgtcgaagtttaaatattcgtctgtaattggtgaagttttcggaccaacttgtgcaccagatttctcatcaataccaccattgattgcgtataacattgttttcgctaagtttgcacgtgcaccgaagaattgcatttgtttaccaacaaccattggcgatacgcaacatgcgattgcatagtcatcgttatcgaaatcaggacgcattaagtcatcgttttcgtattgtactgatgaagtatcgattgatacttttgcacaataacgtttgaaaccgtccggtaattgttcagaccaaaggatagttaagtttggctctggtgatggacccattgtgtaaagcgtatttaagatacggaagctgtttttggttactaatgtacgaccgtctaagcccatacctgctaaagtttcggttgcccacattgggtcgcctgagaataattgatcgtattcaggtgtacgtaagaaacgaaccatacgtaatttcattactaaatggtcgattaactcttgcgcttcttcttctgtgattttacccgcttttaagtcacgttcgatatagatatctaagaatgaagatacacgaccgaatgacattgccgcaccgttttgtgatttaactgcagcaaggtatgcgaagtaagtccattgaaccgcttcttgtgcagtttcagctggacgagaaacgtcaaaaccgtatgatgcagccatttgtttgatttgacctaatgcacggtgttgttctgcaatttcttcacgtaattggattgttgcttggatatcttcacccgcttctaaacgaggttgtaatgaagcaaattgtttttgcttgtctttcattaagaaatccgcaccgtatactgctaaacgacggtagtcaccgataatacgaccacgaccgtaagcatccggaagaccagtaattacacctgatttacggcaacgtaaaatatccggagtataaacatcgaatacaccttggttatgtgttttacgatattcagtaaagattttttctacttcagggtttaaggtacgacgataaacttcgcaagaacctttaaccattttgataccaccaaacgggataatcgcacgttttaatggcgcatcagtttgaagacctacaattttctctaaagcttgatcgatataacctgctttgtgagaagtaattgttgatggagtttcgcaatcaatatcgtacggttcgtgagttttgttctcaactttgattttttccatcacttcttcccataacttagttgtcgcagctgttgcgccagctaagaaagactcgtcgccttcatatggagtatagtttttttggataaaatcacgtacgtttacttcagtttgccagtcgccaccagtaaaccctgcccatgctttttgttgagcttcagttagttgagtcattttaagtcctctgtttgttagtaaattaagttttacaagcggtcttttttgcaaaaagttacacaaattaaaccgcttaaatcgaaattttattagtgtttacgaatgtataagaaccattgtactaagccgatgaagaacactcccccgacaatatttcctaatgttaccggaataagattcttaacaataaaatgatataaatctaagtctgcgtattgtgccggatcgacattaatcgctgtccagaattcaggtgatgcaaattgtgaaatcatcatacccatcgggatcataaacatatttgcaacacagtgctcaaagcctgatgacacgaataatgcaatcggcataatcataataaatgctttgtctgttagacttttaccggcatttgccatccataccgcaagacaaaccataatgttacataaaatacctaaggtaaaagcctccatccaagtatgatgaattttgtgttgtgccgttttaagaatggttaatccccattgaccgtttgccgccataatttgacctgaaagccaaataagcacaaccatactcaagccaccgacaaagttaccgccatacacaatgaaccagtttctaaacatttggaaccaagtgatacgatgcgtcgctttagcgacagcggttagtgttgatgaagtaaataattccgcaccgaatactacgcataggataacgcctaaagagaaaacggtacctccgacgagttttgccattccccatggtacatctgccgcaccggtttgtgttgtggtataaaagacaaaagcaagcgcgatgaaaccacctgctaaaattgccgagataaaagaatataattgatgtttagttgccttatagactgcaccgtcttcagcgatttttgccatttcagcaggtgagaacatttataatccttaaatataaatttgaaaaattacagaaattgttgagaattatagacctgttaatgcaatactcaaaataaaattgccattatattgaggtaaatcaaaagcgaattttgatgtaaatcaaattgaaacttaaatgaaaattttcgttaaaatacatcgatcattttcttaacaaaaatattacaaatcaacatgatagattattttacttcattacttagttttttcttctctgaagaaaaccaattaatctcaatgttcctcagtgcctttttaagcgctacggttttgcccggtaattctgaattaatttttactgcattagcatcaaaaaatttattggcggaacaaacgattttttctgcaagtatgatgtggttagctttgattgccacattaggcaatagcctcggcagtatcgtcacttatgcgatgggattattaattcctaagccggttaatttgcaacatcgttccgcaagattagcactgtctttatgtgaaaaatacggggtgtttgcgcttcttttgacaagtctgcctgttattggggatgtgttatgcggcatagctggttggctcagatttaatatttggcaagcggtgctgtttattacgttgggaaagttagcacgctatttattattactttttacgctttacccttttatgttttagtcgtaataaaaaagcggtctgttcttgcaatttttttgcaaaatcagaccgcttgtcgattataagtttcttaacgcttcgatacgtttttcaagtggtgggtgactcataaataattctttagaacgtacgccgttaatcataaatgctgcaagagaaccttccatttcttgtggctcatgtacgtgttgtaaacgttgtagcgccgcaatcattttctctttgccgactaattgtgccgaacctgcgtccgcacggtattcacggtaacgtgagaaccacatcgcaatcatggttgcgattacaccaaagatcatttgtaaagcgatatccacaatccagaaaaccaaggtgttttgagtgttattaccgttttcatctttaccgcttgcaactgcggtcgaaataatgcgagataagaagataacaaaggtattcaatacaccttgtagtaaggtcatcgttaccatatcgccgtttgcaatgtgtgcgatttcatgcgctaccaccgcttcggcttcatcttcggtcatattgtccaataaaccggtacttaccgccactaacgaattactttttgttgcaccggttgcaaatgcgtttacatcggcagagtgataaatcgcaatatctggcattggaatgcctgcttgctgtgattgacgttgtaccgtatcaaataaccattgttccgcatggttacgaggttgttgaataacttctgcgccaacggaacgtaatgccatgctttttgacataaataatgagattaaagaaccagcgaaaccaaataaaagcgacatcactaaaatacctgcagtgctaccgccttgaataccggttacttggaaaatgatatttaacacaataccaagtacgaaggtaatcgctaagttagttaataaaaataagacaattctttttgccatagatagataaatctccaaaaaagagtgaggaaaaactggtcattaaatggggcaattttataagaattcaagcctttagcaacaattattcccataaatttaactgttttttaactttttccgttgggtaatgcaccgaaagcccgattaagcgtaccgaacgatgattcgtccgttgccaaacttgttgaagtaattcgataaaacgctcgagcgaaagcccgtcagtggtacgttccaaggtggtttgtgtaaaatcaccaaactttagtttgatcgctaattttttaaactcttgtaatgaacgttcgccccaatttcgttgtagccgaaaaaccagtttcttaaatagctcatctacaatttgctccgcttccgataaatgccaaatatcagtcggtagcgtattttcgaccgctaaggatttacgaggacgattgacttcgatttttcggttatcaattgcgtggctgaagtcccaaagtcgttgcccgaatttgccaaatgtcttgtaaataaaagctttatcgctgtgctgaatatcgccgcaggtgtgtaatcccagttgcgctaatttttcattagttaccttaccgacacccgggatcttttttagtggcaaatcataaataaaagcggtcatattttccggagaaatgacaaattgtccattaggcttgttttgatccgaagcgatttttgccaaaaatttgagcggggcaatgccggcggaggcggttaagcgcagctcgttccaaattgcctctcgaatttcttgggcaatccaagtggcagagccggagcattgctgacaatccgtcacatctaaataagcttcgtctaatgaaagcggttcgatgatattggtataacggcgaaatatttgatgaatttgttcggaaaccgctttgtataacggcatatttaccggcactagaatcagattcgggcagcgttttaacgcttgtgcggttggcattgcactgtgtaaaccgaattttctggcttcataattacaagtggtcaatacgcctcgaccttcaatggaaccaccaacggcaacaggcttgccgattaacgccggattttctcgcatttcaatcgcagcataaaaacagtccatatcgatgtgaatgattttgcgttgcattgccatatgatttcgattacttataatttggctgtatataaaaacagttttattttatgggagtaccgttaaaatttcaactcaaaaaatacataacgataaggaagatgaaatgttatacggtttagccattgtgctgattcccttgtttttgggctacttatttaaagtcggtaaaggcaaattgcaggttgttaatcaggttgtaaatatttgtttatatttgattttatttgtgatggggatttcgctcgggcaattagatgatattggtagcaagttaccgcaaatcggtgggattgcgctcggtttgagtttaattattcaattttcgaatattatcggtttagcgatttacgataaatggcaaccaatggttcgtgaacaagtgaatccgcaagaaatcccttctcgttgggtaatgctaatggattcgtttaaattaatcggtaccaccattgctggtgggctcgtcggttttgtgacgaaggggacattagattttccattacacgccagtacttatgtgttggaggtgatgatcttcggtgtcggtattcagttacgtaatagcggaattccgctacgagaggtgttttttaacaaacgaggaatctatacttcattagtgatgattgtcagtagtttgattggcggtattattgcggcattagtattgaatttaagtattgtccaagggctcacttttgcttcggcatttggttggtattcattatctagcgtattagtcaatgacgcttgggggccgatatacggcagtattgccttctttaatgacctttctcgtgaaattttctgcttatttaccattccgttttttatgcgagcatttccttctaccgcagtcggattaggtggggcgacgtcattagattgtatgttgccggtgattcaaaaatcgggcggtacgcaagttgtgccgctggcaatcagtttcggctttattgtgaatttggttgcaccattattattggcgttatttatcggcttagccggataaaacaaaatggcagggttatacctgccattttttgtttggcttaatccacttttagtaatttggctaatgccaacgacttccgttcaatttcttgccattccgattgcggttccgattcttcaacgatacctgcgccagcatagagtgtaatgcagttttgttcaatttgcgcagaacgcaaagcaacacaaaattccgcctcgtccggttgtaaataaccgaatgtgcctgcataccaacaacgtgagaattgttcatattcggcaataaattgttttgctgcttggcgaggtaagccggcaaccgctgcagtcggatgaatacgagcgagacaatcggcatcactcatattcggttttagctgcgcagagattttacggcgtaaatgttgcacattgtgtaggcgtttaatttcagcttggctaacggtaatttccgttgtgcaatcttccagatgtatctgaatatcatccacaaccaattgattttcatagatgtttttaggatcagtaagtaaccattccgcatttagttcggtttgtatcgcactttccgttaccggggcggtacctgctagtgcttccgtattaaattgaggaccttttcgatggtataaacgttccggacttgagccgacaaaggcggatttcgcattttccgcccaaataaagtgataacaacctaaattagtagtttgactcgctgcaagtagatcataagcagatagctcatgttcaaattgcaatgttttcgcatttgccagtaccactttgttaaagttgtgttgttgaatatgactaatggctcgttctatattttgttgccagccatcaaaatcgtaaacggaagtcagcgaaaggagattgttttccgttaattcaagcggtaaggtttggatgaaatttgcaaaaaattgttcaaaaataacctcttgttgggctaattcagcttcgttcaaatagaaataagcggtcagattttgctgattttttactaattgcaagcggggtaaaataaattggcaatcgccttcaaattgaatgccgccgactaaaccaagctgtgtttgttttacaaattgctgtgcttcttcaaggctggaaaatgattttgcggtaccgatactggcaatggtctgatcagtgtctcgagcctgccaaaaaaaatgcggataatgttcctgcgcctttaaccagttcaataaagcaacgttttcttcagaaaaaggcacggaggcttgatattcaatcaaaccaaaagctgttttgttttccgtaggctgttcgctaagttgttgttttaattgattaaaaatagacatttgcaaaatttctaaagaatttaaccgctagtttttagctattgtaaaaaaaggtggttattttagcttatttcctctttaaattcctaccaaatcagagtaaagttgaacaattttctacaataaacaaccaatttacctaaaacataacaggacaaacacaatggaacgtttccctaaatcagataaattagcacaagttcgatatgatatccgtgggccgattcataaagaagcacttcgcttggaagaagaagggcataaaattttaaaattaaatatcggtaaccctgcgccattcggctttgaagcaccggatgaaattttagttgatgtgattcgcaatttaccaaaagcgcaaggctattgtgattcaaaaggcttatattctgcacgtaaagcggttgttcaatattatcaatcaaaagggattcgtggcgtagatgtgaatgacgtctatatcgggaacggcgtatcggaattgatcacaatgtcgatgcaagcattgttaaatgatggtgatgaaattttgattccgatgccggattatccgctttggacagcggcatcaacccttgcgggcggcaaagcggtacattatctgtgtgatgaagaaaacgaatggtttccggatattgaagatattaaagcgaaaatcacacctcgcaccaaagccattttggtgattaacccgaataacccgaccggtgcggtttatagtcgttctgttttattagagattgccgaaattgctcgtcagcacaatctcattatttttgctgatgagatctatgaaaagatcatttatgacggtgcggtacatcaccatatcgcagcgcttgcgccggatttattatgtgtaacttataacggcttatcgaaagcctatcgcgttgctggtttccgtcaaggttggatggtattaagcgggccgaaaaaccatgcgaaagggtttattgaaggcttggatatgctgtcttcaatgcgtttatgtgccaataccccgatgcaacacgcaattcaaacggcattaggtggttaccaaagtattgatgagttcgtgttaccgggcggacgcttgttagaacaacgagacaaaatgtatgagttgttggtacaaattccggggatttcttgtgtgaaagcaaaaggtgcgctttatatgttcccgaaaattgacacggaaatgtatggtattaaagacgatgcgaaatttatttacgacttattacaagcagaaaaagtgttgttggtacaaggctccggttttaactggcataaaccggatcatttccgtgtcgtaaccttgccttatgcgcatcaaattgaagaagcattgggacgcctcgctaacttcttaaaaaattataaacaatcttaatcttttctctgccccatccacggggcagattacttttatctgtctagctattatatgcaactcggtattatttattcactttccgcttccgcattattcggcggaatgtattatctcgccaccttactacgcccgctttccggtgagagcttattcggcattcgtatggttgttaccttaccttttctatttttcgtgattttcgtgttgaagaaacaacatgaattttttgcgtttgcaaagcgtttgaaacaacaacctcatttaattctcgtcatattgatcacttcagcgattgtcggctcgcaaatgtggcttttcttatgggcgccaaatagcggcaaagcgttggaagtttcaatgggttatttgctgatgccgatcgtcatggtggctttcggacgtttggtttataaagaaagtctatcccgtgtgaagtggttggcgattatttttgcaacattaggcgtgttaaatagcgtcatttttgccggtggtatttcttgggaaggcgtttttgtttttgttggttatccggtttatttccatatccgtcgaaaattccagttaagtaatatctatagttttatctttgaaattatgttcctgattcccatttcgctgtattttatttggaataccgatatggattttatttatgcgcaaaatccgaatatttactactttattgcgattttaagcgtagtaagtggcacagcgctgctttcttacacattagccagcaccatattgccgtttaatgtacttggcttattaggttacttagagccgacatttatgatgataatttcatttttaatcggtgagcgattggatccaaattcctattttctgatgacctgtttggtgattgcggtatttttcttaattttagacggtcttttcagtatccgaaaacagcgtaaaaaagtgatcgcggagaattaaatgttaaagggcatcttatgctgtatgagcgccaacttcttatttggtttgggttattacttcgcaatcttattgcgcccgctcaatggcgaaagtatgtttggcttccgtattgtggtgctagcgccctttatcttattagcgattttactgtttaaacaaacggcgaaatttcagcagctttggcaaaaaatcaagcaaaatccaccgcttgtcttggtgctgttattgcttgctttgaataccggcattcagctttggttatttttatgggcgccgaataacgggcaagcgattgaagtttcgattggttatttattactgccgattgtagcggtagcattgggtaaaattgtgtttaaagaacattttactttattgaaatggttgtcacttggttttgctgtgatcggtgtggcttccaatatttggctgaccggttcgttttcgtgggcgaccattgtcgccggtgtcggttatccgctgtacattacgctacgccgctatttcggtattaatacgcttgccacctttttcgttgagctgctgttagtgatgccgtttgccggttattttattgcacaaaccgatatgcagccgattattgttggcaatcagtatatttattattttttggctttgttcggcttagtcaacggtgctgcatttatcttatatattgcctccagtaatttattaccagtcaatgtgcttggtttactcggttatgtagaaccgctggtaatgctttgtgtttcgtttatgattggcgaagtattggattccaaatcctacctgttaatggtttgtttagcgttagcgattactttattaactattgataactttagattgacacgtaagtgattgaatgtgcttttaagccagagtgacaagcggtcaaatttttatgattttttgcaaaacctccgaggacaatagataataagctattgtcctttcatttttatagattatgtcgaagctagttagagtggcattgcctgtgccgttacatcgttattttgattatttgctgccgccgtttttgtcggcagtcaaaggcgtgcgtgttgaagtgcctttcggtaatcaaacgaaaattggcgtggtggtggattttcccgaaacgagcgatgtgcctgaagagaagctaaaaccgattaaaacggtattagatttagaaccgatttttgacgatgaaatttggacgctgctcagttgggcggctcgttattatcacgcgcctatcggtgaagtggcgatcaatgccttgccggtgaaattacgtaacggcgatagcaccgaaagatcgcaaccggattactttgcggttaccgaagccgggcgggctgcattgctttcgggtgaaaacagacgagcgaaaaaacagcaagatttactggcggaactggcagaaattgcaaatttttttgaaaaaccgaccgcttgtagccaatcggcttggaaagggctattggaaaaaaactatatcgaaccggttaatgtgccgtttgagccgcaacattggcaaaaaaaattgcaaaatcgaccgcttgtaaatttgcagaatcgactggtattaaataaacagcaaaccttggtcgttagccgtttaacggtacaaaacggctttgaaacctttttattgaatggtgtgaccggttcgggtaaaactgaagtgtatctgcaagtgattgaagaggtgttaaagcgaggcgaacaagtgttggtgttagtgccggaaatcggactgaccccacaaacggtacaacgatttaaagcccgttttaatgttgaaattgacgtgctgcattcgaatatgaatgaaaccgagcgcttgaatgcttggttgcgagcaaaaaacggtgaaagtgcgattatcatcggcacgcgttcggcattgttcagccagtttgagaaattgggtttaatcattattgatgaagaacacgatagttctttcaaacaacaagacggctggcgttatcacgcaagagatttggcaattttacgggcgaaaaatttacatatcccgattattttgggttctgcaacgccaagtttggaaagcgtacaaaacgttcaaaacggtaagtttattgagctatctttaaccgctcgtgccggtaatgctcaacaggcgaaacagcaattgattgatttaaaaacacagcgtattaccgccggactttccgaccgcttattagcgatgatgaaacggcatttggagcaaggcaatcaggtgatgttgtttttaaatcgccgcggctttgcaccggttttactttgtcacgagtgtggctggatgtgtgaatgtgacgcttgtgaaaagccttacacttatcatcagaaacagaaaattttgcgttgccatcactgttcttcacagcgagtgattcctcgccagtgcggacattgcggctcaactaatctgattacaacaggtgtggggacagagcagttggagcaagtgttaagtgagcaattcccaacttaccaaattagccgtatcgaccgagattccaccgctcgtaaaggagcattggaaaatcacttaaatgatatccgagaaggcaaaagccaaattttgattggcacgcaaatgctagcgaaaggacaccattttccgaatgtaactttagtggcgattgtgaatgtagattcggctctgttttcgaccgacttccgtgcggaagaacgtttggcacagctttatgtgcaagtggcgggacgtgctggacgagcggaaaagcagggcgaagtggtattacaaactcattatccggaacatccgttgctcaagactttgttagaacaaggttatttggcgtttgcacaagaagcgttaaaaatgcgtaaagtgatggggttgccgccgtttgctgcgcaagtattgctacgagcaaccggtaaagacaatcagcaagtagtaaatcttttgcaaaatttgaccgcttacttccagcaaaaaagcacggaactcggtttacaggatattcaaattctaccgcctttttccgcaccgatggcaaaaaaagcagggcattatcgctggctgttattaattcagcatcgctcaagaggcgtattacaacagttgatcgatcaatttgatttggataaagccaatttaggcttacaaaataatattcgtttaaccttagatatcgatccgcaagaaatcggctaacagcggattcatacgataagcggtttgattttcctcgttttttgcaaaaaataacgaaaatcagaccgcttgttatgtaaggctagagggattcttttaggtagcccatccattctttcagtgaaatcatcacactgctcaacgctccggcttgcggaagataatagaaataattgtagtaatcttccggtgtaacgcctgcaccggtacttgccggtaacacttcaaaaccttgcttttcaaacaacattttagcgcgtttcatatgccattggttggtgaccaagacaattttattgatgccttctttagctaacatttcacgagaaaattgcgcattttctttggtggtttttgctttttcttccaaccattttgcttttacttggaagaattgttcaaattcttttgccatcattgctgcttcggaattgccgttcggactgcttccggtcactaaaatcggtagtgatgtttctttagttaaaaaagctccgtatcgcatacgatcaagagtggaatcaccggtagcaatgttgccgaataattcttggctgtcccgcataccaccgcttaataccacaatcgcttgagcagagcggtaatcatcaagagttaaattatcattggttactaatgaatcactgagcttggttgcaacaagaggagtgctgatcagatacaagacgataatgccgaatgcggctaggaaacggcttaattttttgtagtgaaaacgtgcgagtatcagagaaaggatccaaagtagcgcaatgctaaacggcggtaagataattgatgtcagcagtttggttagaaaaaacattgttgctcccgatagataaatattttgcgtattttctacgatttattgctaaaatgcacattctatttctctttgagtgaaagatacgatgagaaaaaaaattgtactaataggtgccggcggttacgctaagtctgttttagactcgttagatgagcaacagttcgagttctgtgggtttattgataattttaaaccaaccggttgttcgcatttaggctatccgattctggcacatacgatccaagaatttgaacagcgagatcaatattgctatttcgttagtattggcaataacgagcatcgcctcgaaaaatttttagcgttaactcagttgggctgcgaaattgtgaatgtgattgataaaaccgcaattgtgtccaatcgttctcaactggggaaaggcgtatttgtcggcaaaatggcaatcgtgaatgcgggggtaacggttggtgataacgtggttatcaacacgaaagccttggttgaacatggttgttttatcggcaatcactgcaatatttcgaccaatacgacactaaacggtgatgtgattgtcgaagattatgcctttgtcggcagctcgtctgtggtgaatggtcagctacgtatcggtgaaaaagcgatggttggctccggtgcggtggtgattcgtaatgtcgaacctcgtacggtggtggcgggtgtaccggctaaatttattaaagaacataatcattaagaaaagtctctataggaagcaaattaaatgagtaaagtatttatcgtggcagaaatcggttgtaaccataacggtgatcctgcgttagcgaaaaaaatggtggatgtggcgaaagaatgtggggtggatgcggtaaaattccaaaccttcaaagcggataaattaatttcaaaatatgcgccgaaagcggaatatcaaaaagtcacgaccggtacggctgattctcaattagagatgacccgtaaactggaattaccttatgatgaatttgtgaaattagaagcttacgcacgttcattaggtttagaggtgttttcaacaccgttcgattttgagtcgattgattttttagccagccagcagcaaaaagtgtggaaaattccgtcaggtgaattaaccaacttgccgtatttagaaaaaattgcacgtttaccgattgaaggtaaaaccattgtgatttcaaccggtatggcaacaattgaagagacaaaacaatcacttaaagttttggaagataatgggatggcgaaaaaagacatcaccattttacactgcaataccgaatatccgactccttacgaagatgtgaacttaaatgcattccatcaattaaaacaggaattcggcgaatacagtttaggtttctcagaccattcagcgggctactttgcggggcttgcggcagtaccttacggtattacttttattgagaaacattttactttagataaaaactttgaaggtccggaccataaagcatcggtcacgccggaagaattaaaattattatgtgaagggattcgtgcagtagaaaaatcactcggttcttcagaaaaaatcgtgaccaattcggaagcaaaaaacaaaatcgtggcgcgtaaatcaattattgccgctcgtccaatcaaaaaaggcgaaatttttactaccgataacattaccaccaaacgcccgggcaatggtattagcccgatgttctggtatgaggtattaggtaaagaagcgcaacaggattttgaagaagatcagctgattgccgacagtcgttttgaaaaccaaatgtaattctcgcccccatttgggggcatttttagcttagggtctgtttatctttcattaacagctgcgttgttgcctaaaatagccacaggctaggcgtaaacgtagtgaatagcagccctattaacaagttttacaacgatgcaggtggctattttaggcacaacccaactgggacgggcttattttccgccaactctgcgttaaaaaccgtttgtttagaataactaaacggcacgtttttctgccttgatttggcgaaaaatatgctccgtcgcagccgtttatgaaagataaacagaccctataagcggtcaaatttatgaaaaaaattgcaattatcacggcacgttccggttcaaaaggattgccgaataaaaatgtgttattggtcgaaggtaaaccgttaatggcgtattcgattgaagcggcgattgagtctggcgaatttgaaaaaattattgtgagtacagactcgcaagaatatattgatttacttgcacattatccgattgaatttatcaaacgtgcgccacacttagccggtgataaagctagctcatttgtggttattgaagacgtgttacaacaatatcaatcgaccgcatttgattactttgtattattgcaaccgacctcgccgcttcgtaccgcacagcatattcaagaggcttgtgccaagtttgaagcgcagtttgaacattttgatttttgtgtgtcggtctctgatgcgcataagccgaccacattaactcgctcgattgaagaagacgaaagtctaaaacatttccaattggattattccaattacgctcgtcagcaatatcatccggaatattcgccgaacggtgcaatttttattgcaaaaccgaccgcttatcttgagcagaaacatttctatggtgcgaaatcactcgcttattttatggataaggatgtttctattgatattgacgatcgtaaagacttcgaatatttctacttcattatgcaacaacgccagcaagaaaaattgcagttggagcgcatccgtattcgtatactaagtaaaaaagaactctttacacaaaatacagacattactttagtcggacattcgattttagatcagtggtcaattcaatcactaagcggcaaaagtgtgtgtaaccttgggttttccggtatttcagcgaaagaatatttagctgaaattattgataaaggcttaattaaaacattaggtaacgatgttgtcgtgatgttaggcacaaacgatctgactcgctatggtgagacgaatgagtctatttgtcatgctattcaagatttgattgctaaactcaaagcgatccgctcggatatcaatatttactttttagaaattactccggttgcttttagagcggaacgtagtaacgagaaaattatcgcactgaatcaattactaaaagcgtcattaaccaatgtgatttggatagatttataccaagcattttgtgaccaatacggcaaacttacgatggaatttactacggatggcttgcacttaaatgcaaaaggctatgaaaaattgaccgctattttggaacaagagatcaagtaatgaaacgaattgcgtatataacgggctcgagagccgagtatggcatcgtaaaacgcctgctcaaaaaattaaatgacgatccggcattggatttttcattggtggtgaccgcaatgcacctagatgcccagtacggtagtacggtgacggtgatcgaacaagacggttttgaaattgccgcacgtattccgcttacactcaatgctgaaaataaccaaacgattattcattcgatggcggaatgtttagatcattttggggcgcattttcaacagcataaatatgatgcggtgattgtgttaggtgatcgctacgaaatgctggcggtggcaacggcagcggcaatgcacaatattccgttgattcatttacacggtggtgaacaaacactcggtaattatgatgaatttattcgtcattgcattactaaaatgtcaaagctgcatttaactgccaccgaagaatataaaaagcgtgtaattcagttgggtgaagatccaaaatatgtgcataacgtaggttcattaggtgcggaaaatagtttattgctcagcttaccaagccgaacgcaattaattgaaacacgccagattccaagcggtgattattttatggttgtatttcatccagaaacactcactgaacaaccagtgttacaacaagtggagcaactgttagccgcattagatcagtttaaagaccgttatcaatttgtgtttatcggctcgaattcggacacaagtgcggatcaaatcttcaaccgtttccaaacttataccgcacaaaacggttattgcttcttcacctctgtgaaaccggaagaatatttagcactaattaaatattcgaaaggcttaattggtaatagctcatccggtttattagaagcgccaagttgtggtgtcggcacggtaaatatcggcaaccgtcagcaaggacgtgtacgtggagaaacagtgattgacgtggaaacgaccaccgaagcgattaaagccggcattgagcaattaatctcagcggattttcagcagcgtttaccgcagatgataaatccgtattatcaagaaaatgcaatggaaaaagcttataaagtgattaaacactttttaaatgacgttgaaaaagatcaaccgaaagctttttacgatcttccttaaaaattgaaccgcttgtttgccttacaagcggttaattttctttatttttttgcaaactatgaaagctgtaaaagatagtgttatttaccttggcggtgagttgatttcaaaagccgtgccttttttgctattgccttatttatctcgtaagctaggggttcaaggctatggtgagttatcgtattatcagacttatcttgttcttttcctgattttagttggcttaagtcaagaaggggcggtagcgcgttatttttatttttatggaaaacgttcgctgaatttagttgtctcaactggatatgcctatacgaccttggtcggctcgattattttggctatttgttggtactttaaggccgaaatcattgcttatttagctatctctgcggtgtttcaatcgtttttagcggtgcagttgagcgtccgccaatgccaaaaacaagcgattccgtatatggttattcaatcgctgacgagttttgtttctgtaattctgacagtggcgatgttggagttttatcaaacggatctggttgaaaaacgcattttagcgattttgtttggtaatttgattgtattctgtttagcgtactttctgtatttcagaaaaattaatagtcatagacgttttagcttacatcagcataagcttgggttaatgtatttattagggtttggtgtgccgctgttgttacatcaagcaagcttttatttaaaaggtcagttagaccgaatttttattttccatcaatttagccaaattgatttaggactttatgcgatgggagcgcaaattgccgcaattctaatgattttattgcaggcattaaataaagcgacgcttccttatttttatgaaggcttaaaacaaaaaacgattactttgaataaggtgcataaatgggcagcttattcactattatttgtgccaattccttcattaattatgtggatgattcctgagtccgtagtagtttggctattagggaatcaatttattggcacgaagtattttattatcttatttttattatcaacttcgttaacggttccctattttattttggtgaattatttgttttattacggaaaaaataaaattatttcactttcttcggtattatctaccgttgtatatgtaatcagcttattattgttagcgaagactaaaattgagtatgtgccttatgcgagtattattggcggagtaagtttactgccaattttatatagcatgactaaaagagtgagaacggaaacttaatgaatttaattatttgccatacccctttacaggtgcttgtggcggaaaaaattatgcagaaatacccagaacaggaatttttcggcatcatgtttacttttgaatcttataataatcataagtttcagaattattgggcacgatttagcaagttttgcaaagaggctttcttatttagctatccaaagtccggcaagctgaacttattaatcgcattattgcgtgctaagcaaaaagtaaaaaatttaaatgttgaaaaattatttgtagcaagtattgatgatcaattcgttcaattgatttgtagtacagtgagttttaagcaactacatacatttgatgacggtacggcaaatatcgtgccaaatagtatttattatcaagattcgctgaaaacattaaagcgtaaaatagtgaattgtttattaggaaaccgctatagcactcaaactttgcgagcattatcgagtaagcattatacgatttatccgaatttaccaaatattattgagaatgttgaagcggtttcttttgcaaaattaacgccaaatcagaccgcttgtcagcacgaaccgattaagttgttacttggccagccactttttgatgatgccaaggaaaatattgcgttagcagagcgagttattcaacaatttgggattacagcgtatctaccccatcctcgagaacgctatcgtttgactggggttgaatacatcaatacggatttaatttttgaagattatatttaccaagctgcgaacgaacagaaatatattatatatacttattttagcggcgctgtgttgaacgtaatgaatcacccgaatattgaagtgatttcaattcgacctcaattaaataattctgtgtatttggcttgttataatttgtttgaacaagttggtattaatattattgatatttaaaaaatgaaaaaatatttaatttctttagcaaaagatagtgcacgccgtgaactgtttttttctcaaccggatacggcgggttttcaagtatttgatgcaatcaatacgatgtcgcttgaatggcaagaacttgcacaaaaatatgatttaaccaaatttgagcaacgctatcagcgtaaagccaccaaaggcgaggtcggttgtacatttagtcatttgggcgtgtatcaacaaatcattaatgatgaaagcattactgagcatgaatattgtttggtatgtgaagatgatgcgctttttaatcaaggtttccagtacacgttagataagttggttcagcaagatttgacggcagatattattttggtcggtcaatctaaaattttaagttttgaagatccgttgttggaaattgaattcccagctaccttcaagcagcaaatgaagcccattgataatacgacttatcgtttggcgtatccttataaaaattattatgcgggtacggttgcttatttaatcaaaaaatccagtgctagaaaatttttaacaacgggagcattaccgttttggttagccgatgattttattttatttgagcagcagtggggattggatatcttagtggttcgccctttgatggcaattgaaaatccggccttaaccagtaatttggaaggcgcaagagcttcgcagcagcaagctacttttaagaaaattttaaaatatccgctgaaaaaattattagcaattaaacgtaacgcttttaactagagaaaatatgagcgcattaattaatttgttttatatctatgacccatgggtaatgcattttattcgaatggcattcgtggctggggcattttcttgtgtattacttgcctatcgttggtaccaaaaacgaattgacggtattcgagtgccggttgacagtattactgtgattttggcattgattgtactctcggcagtgcctcttctgattaacggtacgaaagatttttccgtattgattatgtattcgaaaaccttgattctatttggtttcggggttgtgatttataacctgttttatggacgagctgataaacagaatcaactggttaacgatctaaaatgggggattggcacacaagcgcttattggtattttaggtttaaccggaatcgctattttttcggacattgctttaggtacaaacatgagtttgtttttacctaagtttagaggatcagagcaagagtatcgtttatataacattacttccgctgcctttttccaattaagcgctttttatttgatgctgcttaattttatgctggcatacaatgcgaaacacaataatatgcacggtgttttcgtgttattgatcttatttatcggggtgatctccggacggacattttttactttttcagtgctaagtatcttgttgtattttaaatggcgttacctcccttacctgttgctctttgttgcaattgtattggggctagcggtttatttgcctgaacatccttatgttgcacatgccttagaaccggtgattaatattttatctggcgcggatagagtcagttcctcgaccgatactttggtaaataagcatttatttttaccggagattaaacagattttaatgggagatggttattactatacgccggagttacattattatggtggctcggattcaggttttattcgtcaaacattatatggcggactcggctatgtattggtttgctttgcctttaccgcttattttgtcaaacgtattgcggataactggtttgatggaagctggaaatttatgctttctacactgtttattctgagtgttttaaatattaaagctgacacttatgcttatccgggcattatgttagtgctacttatgtttttatcgctatttggcgataaaggtagacagatcgtattgttaagaagaaaagatggaaaaaatgtttagtattattgtgccgtcttataatcgtgcgaatgaaattccggcgttgctagctagtcttgagcagcagacgaaaaagaattttgaagtgattatcgtagacgacagatctacacaagcggtcgttattgagcaaaattttgcatttccggtcagggtaattcgtaatgagacgaataaaggggcagcaggtagccgtaatgttggggcggaacaagccaattatgaatggttgctattccttgacgatgatgaccgttttgcttcgcaaaaatgcgaagtgcttgctcaagttctggcacaacaccctcaagcgaattttgtttatcatccggccgagtgtgtgatggtaaatgaaggatttagttatgtaaccaaaccgtttcctccggaaaagttgaatttagatgcaatgttgcttgctaataaaattggtggaatgccgatgtttggtatcaaaaaatcattcttttttgaattgggcggtttagctacggatttgaagtcattggaagattacgagtttgtgctgaaattagtctctagttcaaactttacgccagtctttgtggagcaaccgcttagtatttgtggtttccacactaagcgttccagtgtttcgactaatactactaatactgaattggcattagctgcaattcgccaaaaatatgtgaaaacggatgtgcaagcagcaaattttgagatgaattcgctgtatattttatcttacccttgtgcgatgaatctttcccgccaagcggcaagttattattggcaaatgttccaacgtagccacagcttaaagcatttaattatcgcaatggttacgtttatctcgccaaaattggcaattaatatgaaaaggtttatttaatgaaattctctgttttaatgtctttgtatttcaaagaaaatccgcagtttttaagagaatgttttgaaagcttaaaagcacaaactcgaccggcagatgaaatcgtggtgttatttgacggaaaagtcactccggagttggatgcgattgtggtggaatatgaacaacaattgccaattaaagcggtgcgttttgagcaaaatcgtggtttaggtaaaacgctgaacgatggtttaaattattgttcgcacgaatgggttttccgtatggataccgatgatatttgcttaccagaacgttttgaaaaacaagtcgcatttattgcacaaaatccggatacgataatctttggcggacaaattgccgaatttggtgagaatattcaagatattgttgcttaccgaaatgtaccgaccaaagcggaagacatcgtcaaatttacccgcttacgttgcccgtttaatcatatgacagttgcctataaaaaatcagcggtacaagcatgcggtggctatcaagatttacaagaagactataatctttgggtaaaaatggtggcaaacggcaataatgtggcgaatttagccgatttattagtatatgctcgagtaggcaacggcatggtaagtcgtcgtcacggttggaattatttcaaaagcgaatggcgtttaatgaagctaaaaaatgaatgtaaaattcacgatccattaaccggattcgcaattttcttaatgcgaggtttaccaagaatgttaccgcttggcgcattaaaagcaatttacagcttaactcgtaaataagtcaaaggcgtatcgaatgatacgccttaattttttattgattacgtagaatctcattcattaattgcaaatcaatatggcaataaccatttggattcttatctaagtaatcttgatgatattcttccgccgggaaataatgttcaagtttggtattttctaccgcaagcggctctgcatattgtgcttgtaaatcggcaagtgcttggttgataacgggaatatcttgcggatcaacgtaataaatcccagtacgatattgaattcctttatcctctccttgttgattcacacttaccggatcaatcactttaaaatagtagtctagtaattttgccaagctgattttatctgcatcataagtcactttaaccacttccgcatgaccgctaccagcacacacttcttgataagttgggttttcagtattaccgtttgcataacctgattgtgcatcaatcacgccattaatgcgttgtataaaggcttcggtcccccaaaagcaccctccggccaaataaatttctcgaatgttcgccatatgtttctcccaattttggtaaaaattttgcggaattagaccgcttgtattaagtattcatagcatatagtgatttatttgagagtacaaggtgttagtttctatctggttaaaaggctttttcaatgggtaaaagagtatttgtaaagaataagattgccgtgtaaattaaagggtatagcgtgatttacctctcaaatttaaaatctcgtgtgcttaacaataaaattttagagattttttatgtaaaaaaaggtatagtggcgtaacttttttacatgtcattttcttttgaagtgatgttttcattccttttacttttgaggttttttcaaatgggtgcgttaaatagtatcttgggtattgttgtactcctgctgattgcatttgcattatcaaataaccgtaaagcaattagccttcgtacagtgttaggggcattagtcctacaagttgggattggtgcggtaatcctttattgggaaacaggtcgtaaaggcttattagctgcagcagaaggtgtgagtaaagttatcaattatggtaacgatggtatcagcttcttattcggtggcttggtaagtgataaaatgttcgaagtttttggtggcggcggtttcgttttcgcattaaaagttcttcctccaattattttcttttcatctctcatttctgtactttactacttaggtatcatgcagattgttattcgtatccttggtggtgcgttacaaaaagtattaggtacatcaaaatcagaatcaatgtctgcagcggcaaatatctttgttggccaaacagaagcacctcttttagttaaaccttatattaaatcaatgactaattctgagttattcgcagtaatgtgtggtggcttagcatcagttgctggtgcagtaatgattggttatgcgggtatgggcgtacctctaccatatttaattgcagcgtcatttatggcagcaccgggtggtttattatttgctaagattcttcatcctcaatcagaacagtttaaagatgaattaagcgcagatgatatcgacgaaaaaccgtctaacgtaattgaagctgcggcggttggtgctttctcaggtatgcaattagcaatgaacgtaggtgcgatgttattagcgtttattgcattaattgcaatgctgaacggctttattggcggcgtttcttcacttgtcggttatgaaaatgtgacattacaatcattattcggttatgtgttccaacctttagcatggctaattggtgtaccttggggaacagaatctcaagtggcgggctcattaatcggtcagaaactaattttaaatgaattcgtagcttatgctgatttcgtgaattacttaaaacctgaagcagccgttgcattaagtccaaaaacaattgcaatcatcaccttctcactatgcggttttgcaaacttaagttcaatcgcaatcttaatcggtggtttaggtggtatggcaccaagtcgccgtggcgatgtggctcgtatgggggttaaagcagttattgccggtacactctctaacttaatgagtgctgcgattgccggtttatttatcggtatcggcggagcggtaatgtaagcgttacacttttaagtaaataacaccactggaaacagtggtgttgttgttttgagcttaggtaaacgtttgcgtatggtttataagactaagcggtctaatttttctatatttttacaaaagtaaaacgggggctcatatgagtttaaaagattcagcaaaaatcgctttatccttaatggatttaactacattgaatgacaatgatacggatgagaaagtaatttctctttgtcagcagggtaagacggaattcggtacaccagcagcagtctgtgtttacccacgttttgtgccgattgcccgtaaagcattaaaagcacaaggtacggagcaagttaaaattgccacggtaacgaatttccctcatggtaatgatgatattgaaattgcagtaacagaaaccaaagcggcagttgcttatggtgccgatgaagtggatgtggtattcccttacaaagcattaatggcgggcaatgagcaaatcggttttgagctggttcaacaatgtaaggcagtttgccaagcatcaaacgtattattgaaagtgatcattgaaaccggcgaactaaaaacggctgaattaattcgtaaggcaagtgagatttcaattaaagcaggcgcagattttattaaaacctcaacaggtaaagtgccggtaaatgcaactttagaatcagcacgtattatgttagaaaccattcgtgacttaaatgtagcagataaagttggctttaaagcggcaggcggcgtaaaaacagcggaagaggcagaacaatatttagcgcttgcgcaagaaattttaggtcgtgattgggtaagtgcggcccacttccgtttcggcgcttcaagtttattaactaacttgttagctgccttaaatggacaggcaaaccaagaagtaagcggctactaaggtaagcggtttaattttattaattttttacacactaaatagcaacaatagaggaaattaacaatgactccacatattaacgcaccagaaggtgcatttgcagatgtagtaattatgccgggtgacccacttcgtgctaaatacattgcagaaactttcttagaaaatgcagaacaagtaacagacgttcgtaatatgttcggttataccggtacttataaaggtcgtcgtatttctgtgatgggtcacggtatgggtattccttcttgctcaatttatgcaaaagaactgattacagaatacggtgtgaaaaaaatcatccgtgtaggttcatgtggtgcagtacgtcaagatgtaaaagtgcgtgatgtaattatcggtactggtgcttgtacagactcaaaagtaaaccgtattcgtttccgtgataacgattttgcggcaatttctgactttgatatgacattagcagcagtacaagcagcaaaagaaaaaggtgtttcagtacgcgttggtaacttattctcagcagatttattctatacaccggatgtggaaatgttcgatgtgatggaaaaatacggcattttgggtgtggaaatggaagcggctggtatttatgcggtagcagcagaatacggtgcgaaagcgttagcgatttgtacagtttcagaccatatccgtactggtgaacaaacttcatcagaagaacgtcaattaacctttaatgatatgattacgattgcattagagtctgtgttaattggcgataaagctgaataagcggtcaattttccgaattattttgcaaatccttcgaggtgaagatctcggaggatttttttatatgcgtgtaatagcattaatttgattaattattcattttttatgaatttttattctgctttgtgtttgaaattacatctgaataagagtaagatatttaatgttttaacagcaataaggatttatgatgagcaaatataaaatttttgtggacggagcagtcggtacaaccggtttacgtatttttgatcgtcttgccagtgcgaaagatatagagctattaagcctgccggaagaattacgtaaagatcttaatgcaagagtagaaaaggtagcagaagcggatctaacttttctttgtttaccagacgaagcttctaaagaattagtagcacatgctccggcaaatgcaagaatttgtgatacttcaaccgcccatcgtgtgaatccagattggacttatggctttgctgagctttctgggcagtttgaaaaaattcaaaatgcgaatcgagttgccgtaccgggttgtcatgctacgggttatattgcgttagttcgccctcttattgaaaaaggtgcactgagtgctgattatccgctttcttgccattctctcaccggctattccggcggcggtaaatcgatgattgccgaatatcaaaatccagatcgtgaacaaaaatttaatgcccctcgtgtttatggactagctcttaaacataaacatttaccggaaatgcaagcgcttaccggttcaaaccattctcctattttcacaccggtggttgccgactattacagcggaatgttggtgactgtgccgcttcctgtttcagccctttcacaagcggtcaattctgccgaaaaaattgcaaatttattcagtgaatattatcaaaactcaaaattaattaaggttcacccagtttgtagcttacctgaagacggaatgttggcggcgaatgaatttagcggtaaagacagccttgaaatctttgtttacggtaatgaaacacagttattattgtgtgcacgtttcgataatttaggtaaaggcgcatctggtgcggcagtacaatgtatgaacataatgttaggccgtgaagaaacagccggactagacgtatagtcagcgtgagatattatttggggtttaaaatgttacaaaacgaagttgaaaattttgcaaatcttttagaaaaagcgaccgtttatcttgcaccgtttcgagaaaaaattatcgtggtgaaatacggcggtaatgcgatgatcaatgaagatcttaaaaaattggtgatgcaagatattttattgctgaaccaattaggcgtgaaagtggtattagtacacggtggtggcccggaaatttcacaaggcgtgaaattactcggcaaagagccgcaatttattaatggcttacgtgtcaccgaccaagatacgatcaatgtcgtattgcaaatgcttgccggtaaagtgaataaaagtttggtagcgttattgaaaggtaaaggtgtcggtttatgcggtattgacggcaatatgttgcaatgtgaaaagttacaaggcgaagtagattacggctttgtcggcgaaatcgttaaagtgaatacccaattattggatcttgcgttaaatgcaaatttaattccggtgatttctacggttggtgtggatgagcaaggtgtcgcttacaatatcaatgcggatacggcggcgagtgaaattgcgatggcgttaggggcggcgaaattagtcagtatgacggacattgccggcttgttacgagatcgctttgatgaaagtacgctgattccggaagtggaagtcagcgaagtacaaggcttagtcgatcagggcattattgccggcggtatgattccgaaaattgcttgttgtaccgattttattaacgccggtggtattgaagcgaatatcattgacggccgtgtgccgcacgccattttagtgtcattattcggtggcaaaaatggtacgcttttttataaaaataattaggaagagaaaatgaacagcaacgacatcaaacaattagatacagattatatcgctcaaacttacggcagatttaatctcgccctttcacacggaaaaggttgtgatgtatgggattttgaaggcaatcaatatttagattttactagcggtatcggcaccaatagcctcggctgggcggacgatagttggctgactgcggtaactactcaggcaggtaaattacagcatacttcaaatttattctttactgagccgtctggggtactggcaaaaagtttggttgaagcaagcggtctaaaacgagcatttttttgcaattcgggtgcagaagcgaatgaaggggcaattaaaaccgcgcgtaaatatagccatgacaaatacggcaaaggcagagcgaccgtactcagtttagtcaattcatttcacgggcgtacgatttcaacccttgctgcaacagggcaagatgtgtttcatcaacatttctttccgtttacgcaaggttttgaacatacaccggcgaacgatttaaatgccttacatacacgccttgaacaagatgatgtgtgtgcgattattttagaaatcgtacagggcgagggcggtgtttgtgcattagatactgaatatttacaaggcatacaagcgatttgccaagccaaagatatcattttgattattgatgaggtacaaaccggtatcgggcgcaccggaaaattatttgcttatcagcatttcggtttacagccggatattatcacgcttgccaaaggcttaggcggcggtttaccaatcggtgctttcgtattaggtgacaaatgccaaaatacactcggtaaaagcgatcacggttcaacctttggggcaaatccggtctgttgtgcggctgcaaatgcagtattagctaaaatggatgaaagattccttgccgatgttgcggctaaaggcgaaaaattacgtgtggcattactcacgttgccaaaagtaaaatcagtttccggtttagggttaatgcttggtattgagtttgaagatgaggtaaaagcggctgacgtggtagcgaaagcaattgaaaaaggcgtattgacgctcaccgccaaaactaaattacgcttattaccaccattaattatttcagaagaacaaatagaacaaggcgtagcagtgcttaaagaagtcttagaaagtttctaagcggtcgcattttctctcacctttttgcaataaaaatcccttttaagttatccagacttagaagggattttttattgatttattaacatatatagaaatttacaaataataagattattgctaatataaatgataattattttcatttataaaaggagaaagaatgaaatttaaaaaatcttacattgctacactattctctagcttactactagttgcttgttcaaacaataaaggtgacttcggtttagaaaatacacaggaaaaaccatataaatatacccctaaaaagccaaagccgattgaatatggcgatgacattacacaagtaaagtcgtatgaagaattacctgaattattacagcccgctttaggtgcagccaccgctattccccgccgtatcttcaaccccaaagcatccgaagaagcatttgttagtatattacctagagatattcataaaattgagggcaagttagatgaacttccctatcaagaagaaatgctaaaagacccagctgcgaaatccaaagttttagtccattcctatgatgaaaaaagaacgttaagtaaattaaagaaaccgaattatgtgcgagcgggttttgtttttgtcgatgagtcagggctggcgaagtatcaagatccaaaaacgggtaaagacgtatatcgatatggcaaaattggttatcttttctataaagggatcgagcccgctaaatctcttcctgtagataaagtgattgagtatgttggtacgtgggatttcactacggatgcacaaaaaggtcgccctccacaagggtttaatgacgcgccttctgctggtgaccgtgtcggtgcaatttcctttgatgagccgacaaatgaagatccaaataaaggcgatataggtcatcgtagtgaatttaccgttgattttggtaaaaaagagttaaaaggggcgttatatcgcaacaatgttgtttacggagatacagaaaagaaagcggataaagttaaacgctatgatatttctgcaaaagtttttggaaatcgcttcagaggcagtgcaacggcagcagataagcaaaccgtttattggaaagacgatgcaacgttagaaggcggtttttatgggccaaacgcagaagaattagcaggaaaattcttagctaataattattcactctttggtgtttttgcagcacaacaaaccggaaaaagtgaagcggaaacaaaatttgatgcggttcaggtagatctaaaagaggctaaaaaactgaagatggacacgtttggttacgctaaccaaattgtggtcgatggaaaagttattccattaataaatcaaggcagctcggaacatacagttgcaaataaatctgtaaaagtcaccgcttgctgtgaaaatttaggtgacgtgaaatttggttcactcaatatagaaggggaaaattcacgtatttatttagttggagagcgaacagccgttaaagatttaccgcaaaaaggcgaggttacttataaaggaagttggcaaggggaatttactcataaacaaaatggagaagtatggcatacgccggataaaagtactgctgaatttattgttaatttctcagataaaacgattcgaggaggatttggctctggacctgtaagttcaagcgttttatcgttggagcaaggaaaaattgaacaaaatggctttacaggcgaggttcgtactttaaaagatggattccgtatttctgatcaatctacggtacatatcaatgcaaaagtaaacggtgggttttatggctcaaatgcttctgagttaggaggcacactgttgagtgatgaagccaagaatgataaagccacaggggtatttggggcaaaacgtcaagtacagaaataattaaaaaaggagaaaatgacgtgaaaaaattcgatttcaattttacttatattgcgattcagtcagcactattaatgttctcaagtggtgtggttgctgatacaaatagtggagaagcaaccttggatgagatttcagtaaaagcaaaagctgaagcctatcgccaacaaaatgaagtaacaggattggggaaaatcacaaaaaatattcaggatcttaataaacaacaagtattaaatattcgagatctgactcgttatgaccctggaatttctgtggtagaacaggggagaggggcaacaaatggttattcgattagaggtgttgatcgaaatcgagttgcattaattgtagatggactaccgcaaattcaatcttacaagagccaatcactcaatgctaaaagtggtgcaattaatgaaattgaatacgaaaacattcgagccattgaatttagtaagggggcaagttcttcggaatatggcagcggtgcgttaggtggagcggtcggatttcgtacaaaaaatgcaagtgatgtgattaaagaagggcaaaattggggcttagatagcaaaacagcttatgtaagtaaaaaccaccagttaatggaatcattgagttttgctgggcgttcaggtggtcttgaaggacttatccaatatacacatcgtcaagggaaagaaacagatattcataaagacgcaacaaacattacacagagttttttccgagtagtgccagatgattttaatcttgataaaaaagcgagccataattggtttgttttaaaggaaaattgcccaacaggcaaaggcgacagagcaggttgtgtaccacgccctacttctcaaggtgcaaaagtaataaaagactctaccaaggcacaggattataccggcgatggtcgaattgttcctgatccaatgaaatatcgctcaggttcttggcttgttaaattgggttaccaattttcgcctaatcactcagtaaatacagtctttgaacacactaaacaacgttatagcatccaagatatgacagttcctaaatatggcagtttgctatataacggaaaaggacaacttgataagaaaaaaacagaagtggagtattctctatttggtcgaagttattatgataaagatccttcagaagcaataggatacggtgattggagcactttttggagtaagtcatcattttatgatgaatggcatactaaacgtcgtttaggaatggagtaccaatataagagtttgaatgataaggccatttttgatcgcattacagccaatttagatcagcagaatattcgtatcttaacggattggaagtctttacgttgtagcccgtatccaacagtggataaaaattgcaaagtaacagcagataagcgagattctcgagcgagtacagaacgaaatatttataaagagcagcataagcaagctaagcttacttttgagaaggatttatcgataggtaatacgctacatttattgaatttatcaatgagttatgaccgaatgcgttcaaatcataaacgagataactatggttctgattatatttactatacaaaagacgcaaaaagtttagatgaaacgaccgcttatcgtgatgttggttcagataaaataggcacttatcaatcaccattaattgtagagaaaaattttgcccgagtgaaacacgataatttctgcaaagaatatgggattgatggcggacggaataaaggcgttacagattgctctgcacatattatcaaaggacaacattactcaattggattaagtgatcgtattttctttggtgataaagtagatcttggctttggtggccgttatgactatcatcgctttaaatcagatgatcattggacgtcagcaggaagttttaaaaacttctcttggagtacaggtttaactttacgtcctattcaacctgtggcgctttcataccgcatttctagcggtttccgtgtgccatcatttgatgaaatgtttggctatcgtattcctggtgcagaagatagtaagtattgggacgaagatcaccgccgagcagattttgcaccagaaaaagcgttaaatcaggaagtgggtattgcatttaatggcgattttggttcacttgaggtaagctattttgatgatcgttataaagatttgattacttttgccaaaaggaaagggcttgatgggcaaagtggtttctacaatctgcacgctatcaaattaaccggaattaatgttgtcggtaaattgaattggaatggcatttggtcggcattacctgaagggctttattcaaatttagcttacaatagaatcaatgtgaaaaatgtgagcacaaaaccaggttatgtatttgttacgaacccattgttagattctattcagcctgctcgctatattgcaagtcttggctatgatgagccaaatggaaaatgggggataaacaatatttttacttactcaaaaggtaaaaatgcgaatgagcttgttggcactcgcttccattactcaggagatattccacagagtgcaactgttcaacgaaccaaatcttggtacacatttgatatgataggctattaccagctagcaaaacatttcacactacgagctggtgtatataatctaatgaatcgtaaatacaatacttgggaagcagttcgccaatcttcagtgaatagcgtagtacgtattcagaaccgtggacattcgagctatgctgcaccggggcgaaactatgtactaagtttagaagccaaattttagcgaagattagtataagaaaaaggcactctttcgagtgcctgtattttgcattatgaacgtttcattacttcgaagaattcttcgttagtttttgcaacgctaagtttatcaattaaccattccattgcagccacttcatccattggattcagtaccttacgtaacatccacgcattgcggtgttcttctggcgacattaataagtcatctttacgtgtaccagaacggttaaactcaatagccgggaatacacggcgttccgcaattttacgagaaaggtgtaattccatattaccggtacctttaaattcttcgaaaataacttcatccattttcgaacctgtatcaaccaatgcggttgcgataatggttaagctaccgccttcttctacgttacgagctgcaccgaagaaacgttttggtctgtgtaatgcgtttgcatccacaccaccggaaaggattttacctgaaacaggggtcacagtattgtaagcacgagcaagacgagtgattgagtctaatagaataaccacgtctttcttgtgttctaccgagcgttttgctttttcaattaccatttctgccacctgtacgtgacgtgttgccggctcatcaaaagttgaggcaattacttcgccgcgtacggtacgttgcatttcggtaacctcttccggacgttcgtcaatcagaagtacgatcaattcacattctgggtaattatgcgtaatactttgcgcaatattttgtagtagaacggttttaccagcttttggtggagctacgatcaaaccacgttgacctttaccgattggagatgctaaatcaagaatacgtgcggttaaatcttcggttgaaccgtttccacgctccatttttaaacgtgaatttgcgtgtaatggcgttaagttttcaaataagattttgctgcgagaaacttcaggtttgtcatcattaacaagatcaacttttaataatgcaaagtagcgttcaccttctttcggcgggcgaattttaccttcgattttatcaccggtttgaagattaaaacggcggatttggcttggtgaaacatagatatcatcaggaccagcgaggtatgaactgtctgccgaacgtaagaaaccgaaaccgtcaggaagaatttctaatacgccttggccaaagatatcttcaccgcttttagcgtgttgtttgaggattgcaaaaataatgtcttgtttacgtaaacgagctaagttttctaagcccatttgattttcacccatttcgacaagttccgaaaccggtgtattttttaattgagtaagatgcataggaaatatattgattatgaaaaaaatagattggaaatctgtatgatacggaatgccgtaatttgacggtcgaggattatacagcaaatagcctaattttgcaaattttttgcgaaatttaaccgcttgtaacgtgatattagaaatgaaatgccggcattttgccggcattttgtgtgaatagattaaatttctacaccttcaaataatagtgtacttaaatagcgttctgacgcagatgggagaatagcaacgatttgtttatcggcaaattccggtaattttgcaagacgatccgctgctgcaactgccgcaccggatgagatgccaactaaaataccttcttccgccatgattctgcgcgcagttacaatcgcttcttcacttgaaacttgttcaacgcggtcgattaagcttaaatctaagtttttaggaataaaacctgcgccgataccttggattttatgtggacccggttttacttcttcaccatttaaggtttgcgtgataaccggtgattctttcggctcaactgcgacagaaagaatttgtttaccttgatcttgtttgatgtaacgagaaatgccggtaatcgtaccgccagtacctacgcctgctacaatcacatccacattaccttcggttgcattccaaatttcaggaccagttgtttgctggtgaattgccggattagcagggttttcaaattgttttaaaatcacataacgattcggatcgctcgccacaatttcttccgctttggcaattgcacctttcataccttttgctccttcggttaatacaaggttaacgcctaaaccacgtaataaacgtttacgctcagtactcattgtttccggcatggtaagcgtgattttataaccacgtgcggctgctacgtaagccaatgcaatacctgtgttaccgctagttgcatctacgatttctttaccttcagttaaaataccatctttttctgcttgccataccatattggcaccgatacggcattttacgctgaaacttggattacgagattcgatttttactaataagttgccgttttgaccaaaattttttaaacgaacaagaggggtattaccaatagtataagaattgtctgcatagatagtcataattattaattcctttagtatgaataagaggttgaggtgagaatacgttattttggataaagatgttagtggtgaaaatttattttatataactgaaagatatatagactgtaccaccttcacataagcggttttaggacataaaaagcggtctaatcttacaaattttttgcaaaattagaccgcttgtaactaactaaattagcgggtaattatttcaactctcgtgcgccttgattatcgactttacaaatatggataaatccttcgttgttttgcagatattctttttcaaggtaagcaaccagtttttgagcgtgttccaaatccggagcgattgcatacattgtcgggccggaacctgaaatacctaccgctaatgcacctaaatctttgcaaccttggcgtacaactgggaagtttggcaacaagttttcacgataaggttcagcaatcagatctttcatcattgttgcagccaatacgtcttgatgcgtatggcaagcgtgcacaaatgagccaagatagcgtgcttgttgaatcatatcttgacgagtatagtttttcggtaaaatcgcacgagcttctgcagtcgaaacttccacgcctggataagctaatacccaataccactcatcaaagaacggaatggtttggcaaatattaccaagtgattgggtcattaactgcaaaccgcctaaataacacggtgcgacgttatcgtaatggattgaaccggaaatacgtccttctaattcccccatcatttctaacaattccatttttgagaacggttcgtcatggaatttatttaacgcaactaatgccgctacgattgaacaagcacttgagcctaaaccggaaccaatcggcatatttttttcaagggtaaggcgtaaatttttgactgagccacctcgtaatttcaagcgttcgctaaataatacgtaggcttgataaacgatgtttttttgtggctctttcggtaatttacgtacgaaataaccggcactttccaattcaaaggcggtttcgcaatcttcaatttgtaccacgtcaccgagtaacgaaccgtcaatcggtgagattgccgcacctaaagagtcaaaacctacgctaaggttagcactagaagcgggagcataaattcgtaacattgtcattagtttgcgcctccttggagtgtgcgaagaatatcggcaaaaatacctgcggcagttacatcagttcctgcaccataacctcttaataagagaggaatcggactgtagtaacgggttaagaatgcaagtgcattttcaccgtcttttactttataaagcggatggttttcatcgacagcttcaattgctacacggcatttatcgccggtaattgagccgacataacgtaatactttgccttccgcttttgctgcttgaacacgttgagcaaattctgaatcgacttccggtaatacttttaagaattcttccttgctcatgccttcagagaagcctttcggtaatacgccttcaacttcgatatcatcgaattccaatgctaaaccggtttcacgcgcaagaattaacagcttacgcgctacgtccgcccccgagagatcatcacgaggatctggctcagtgaaacctttttctttcgcaattaaagttgcttctgaaaggcttaagccttcgtctagttttccgaagataaatgaaagtgaaccggataaaatcccttcgaatttttctacttcatcaccggcagccagcaaattctgtaagttttcaattaccggtaaacctgcgcctacatttgtttcgtataagaatttatgctgaccttggcgagcggcatcacgaagctcttggtaatattgatagctacctgtattcgcttttttatttggcgttacgacgtggaaaccttcttttaaggctcgagtataaaggtttgctacagattgtgctgcagtacagtcaacaaataccgggttaactacatgatgcaatttgataaatgataacaatacgtcaaagtctgaaggttgagttgccgtttctaagtcgcttttccagttatctaaatttaaaccgttttcattgagtaacattttgtcggcatttgctaatgcacatactcgaatttcaatgtccttctttgctaaaaaatctttttgttgtttgatttgctcgattaattcgccgccaacaccaccgaccccaacgagaaagacatcaattgattttttattgctaaataaaccttggtgagtcgcttttaccgcttcaattgctttattcatcggaactactgcagaaattgaacgttctgacgaaccttgtgcaatcgcaacaatactgatatttgcttgcgcaagtgatgagaagaaacgagcagcaacacctttcgcggtacgcataccgtcaccaactaccgaaataattgaaagctcacgaatcatatcaatcggatctaaatcgccgtttgtaagttcttgagcaaattccgcatttaaacaagcggtcgctttttcggcaaattttgcaggtacacagaagctaatactgtattcagaagaagattgggtaattaagatgactgaaataccggcttttgacatggtagagaatacacgagcagccatgccgaccataccttgcataccagaacccgaaacgttaaacattgcaacgttatcaaggttagtaatacctttcacttttaagctgtcggttgctacgttaccgtcaattaatgtgccttttgcatcaggatttgcggtatttttaattaagcacgggatatttaacgggactaacgggccgatggtacgtgggtgaatcactttcgcaccgaagtaggaaagctccatcgcttcttggtaactcattgactctaaacaaatcgcttcaggcactaagcgagggtcacaggtataaacaccgtccacatccgtccaaatttcgcaacaatccgcttttaagcaagcagctaaacacgcagccgaatagtcagaaccgttacgaccaagtaatacgagttcgccattttcattaccagcggtaaaaccagccattaacaccacgtttttcttcggaattgaatctgcatcaacacgcttggtcgattcggtaatatctactgaagattctaaataactaccatgagctaataatttttcaacaggatcaatgcgagtaacttcataacctttggcttcgaaccaagcttgcatcattgcgattgataatttttcaccactgcagtgaatggttgccgctacattatccggcaatgcttttgtttttgccgcttcgctcgcaacatcttgaatttgggtcagttccgctgcgactaaagctaataaaccatcacgatccacattattatttactgcatagagaccattaataatgttgtggaagatttcagttgcttctttgagattggattcgaaagattcgccaataattgctttatcaacaatagcgacaagatgattggtgattttagccggagcggaaagtacacctgccgcttggtcttttaagtgtgccttttcgatgatatcggccgcttgcataaagcgttccgggttagcaagcgatgtaccgccaaatttaagaactcgcatagtttctcctgatgtttagtttgatgtttgcaaatttggatataaaaaaacccgcttataatgcgggtttggttaattctttccgttttactggtacagacacccgcactatgctttatacataatggtaatagtgctgccggtggtaatgataaaacgattcatattatctgtttctgtatagttaattaaaacggtgatgtatggagagaatgggggaaagcgtttgctttgtcaatggctttttgcggaaataatgttcagttataacaagaaaggagtaaaaagattaaaaaataacatttttttgatttagattaaaaatggtgcttttctaaacgctttttggtatattgcacctgattttaactaacctaacaaaaaggaccctaaaatggcatatcaattaccagaattaggctacgcttatgatgcgttagagccacatttcgataaagcaacgatggaaatccatcactcaaaacatcaccaagcatacgtaaataatgcaaatgcagcattagaagctcacccagagcttttagaaaaatgcccgggtgcgttaattaaagatttaagccaagttccggcagaaaaacgcacagcggtacgtaacaacgttggcggtcacgtaaatcacacgcttttctggaaaggtttaaaaaccggtacaactttacaaggcgcattaaaagatgcgatcgttcgtgatttcggttcagtagaagcattccaagcagaatttgaaaaagcggcagcaacacgtttcggttcaggctgggcctggttagtcgttgaagacggtaaattagcggttgtttcaacggcaaaccaagacaacccggtaatgggtaaagaaattgcaggcgtttctggttacccacttttatgtttagatgtttgggaacacgcttactatttaaattaccaaaaccgtcgtccggactacattaaagcattctggaacgtagtaaactgggacgaagcggctcgtcgtttcgaagaaaacggttcacactgcggttgtgcaaaataattgagtaaattactcaaagctatacaataaacaagcggtcgtttttgcaaaattttttgtaaaaacgaccgcttactatatggattacttatattcaaaaattacgcgaggtgtaagcttagtaatcaattcataactgattacaccgatatgttgtgcgacttcttcgatcaacagatctttaccccagaaaattacttcatcaccgactttatcttgactatccgcaccaaggtcaacagtcaacatatccattgaaactcggccgacaatcggcacaatacgtccgttgactaaaaccggcgtaccttccggtgcattacgtggatagccgtcaccatagcccatcgctaccacgcccaatttcgtatctttgtcactcacccaagcaccaccgtaaccgaccggttcgcctgctttatgcgttctcactgcaattaaagaagaagcgagcgtcataaccggcttgaagcctaaatcagtgattggcgtatagtgcggagaaatgccgtgcataataataccgggacgcacccaatcataatgagcctgtttccaatataaaataccgcttgaggccgaaatactacgttcatgcattgtgtaaggtgcagttgctgcttcaaacgtggcgatttgtttttcggtataaccgcaatcaggttcgtctgctcggctgaaatggctgacaaagctgatactttcaactaaaggacaggcttgtaaacgttgataaaatacatcaacttgttccggatgaacgccaaggcggtgcataccagtatcaatcttcaaccaaacattaaccggaaagtaaattttcgctttgcgcttccaaaagcctttctgttgttcttgctgccattcttgtgcaacttgttcaagtaattccaattgttctaaacaatgtacaaccgtatcaaaacggcgagagagcgtttttaacaattcttcacgatcaaaaaaaccttctaccagtaaaattttaccggtatagccggtttcttgaatttctaatgcttcacgtaaacgtgctacgccaaaaccatccactaaatcagttaatgctccggcagcaggtaacaagccttgaccataagcattagctttgatcattgcgagaagtttctgatgaggggcgaaagtcttgatgagttcaatattatgtcgaagcgcagactggctaatggtagcggtagcaggtttcatttgtttcactttttattggtaaatcgttaataatgagcggcaattatacgcccgatgagaataaatggacaatggataatgaaaattagataatttgagtatgtattcgttcttatttttatagcaatgttaacactcctcgaaacgcttaaagcggaaaatcatctctctgaattaaattatcaatttgccaaaatgattgcgcataagcagcaggcatacaattataatgaatcgcaacaaaacctcgctattctattagctgcattactttcatttcatgttatgcaaggacataccgcgttacgactcgattcaaatgcggcgcaatctttttttggcttggaacataaaaaattagaacgtgattttcaggttgagattttgcaaaaaataggcggaatctcaccgcttgaatggcaagatatattgcatgatcatattgcatttagccattctctgatgcaagtcgccccaatgctatttcagcatggtttactttatttttaccgttattggcaggcggaacataacatcgcccggtatttacaacaagcggtcgaatttccggaagaatttgcaaatactgatttggacaaacaaattctttctgagcttttcccagaaaaaacaacggaaattgattggcaaaagattgcggttgccaccgcattgcgtcaacgtttttgtgtgatttccggtggtccgggaacaggaaagacaacgacagttgctaaattattagttgccttacaaacccgacaatatcgtcagcagaaatctgcacttaatattgcgctggtcgctccaaccggtaaagcggcggcacgcttgaaagaatcaattagtaatagctttgaaaagatgcaacttacatttgagattcctacgtatgcctcaacgattcatcgtttactcggtgtgcgtcccaattcagatacaccgacataccatgcgataaatccgttacatcttgatttattagtcgtggatgaggcatcaatgatcgatttatcattaatggaaaaattaatgaatgcattgaagccgagtacacgtttgatcatcttaggtgataaagatcagctcgcttcagtagaagctggtgcaataatgggagaacttggtgagtttgtgcaactagggtatagctcggcacattgcgattatttatataaagtgacaggctattcgttgagtgaacaagcaagcgtattacctatttgtgatacgctttgccatttacaaaaaagtcatcgctttagtgagcattctggtatcgggcaattggctgcattagtgaatcagcagaaagagaatgagtcgtggcggatttttactaaattccaaacggatttagtttgtatcaaatatcctagtactactcaatttactgaaaagcgccaatggattcagcactgtgtcaatttagtggttgagaaagcggtagagcactatcaggtatatctaaaattggtacagcaacgtatgggcaatccggataaagtctcagtaaatgaaatttttgaagcgtttcagaaagtgagatttttatctgctttgcgtgtgagtgaattaggcagtgagcgtttaaatcagagcattgcggaagcattaagaaaagcctgtctacttaatttcacttttagtcgtgacagttatgcgggaaaaccgattttaattacgcaaaattcgcctgaaaataatatctatagtggcgatatcggcatcattttacctgatgaacataatcagctaagagtttattttgatacgaaagtagaaaatacccacttaagtttgtcgcttagtcgtttacctgagcatgaagtcgcttatgtaatgacggttcataaatcacaaggttctgagtttgaacatactttctttattatgccgttaaacagtgcaccggttattacaaaagaactgatttatacggcagtcactcgagcgaaacagacatttactttatttagtgaagaaaaagtctggaagataggagtaagagcaaatgtacaacgccaaagtggcttgcgagagcaattaaaaaacatgtttagctaatttaatacacgaattgtattaaatgtgttctcttgatcactttttcaagatttttttgcaaaaagtgcttgcaaggatttcatatttctctataatgcacctcacacaacgacgcactgttgtgaacgatttaaaattgattgccagtgcgtcgtttctttttgttctttaacaatttatcagacaatctgtgtgggcacttgttgattgacttaattgaaaaaatatttttgattttgaagtcttaataggtgcttaaactagaaattcatttttacttttgaagtaatatgtaaactttagctaagcagtttattgagcgattaaactttttgaattgaagagtttgatcatggctcagattgaacgctggcggcaggcttaacacatgcaagtcgaacggtagcacgaaggagcttgctccttgggtgacgagtggcggacgggtgagtaatgcttgggaatctggctcatggagggggataactacgggaaactgtagctaataccgcgtaatatcttcggattaaagtgtgggaccgcaaggccacatgccatgagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactttaagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttaccaagaattaagcgactgcaagtgttcacacagattgtttgatgaatgaataagcgtttgcgttagatggagagaaaagttattgaaaaataacggaatttaacgtagaataatgcgctcaaatggcaaagtggagagcatctttaaatgttgtccccatcgtctagaggcctaggacatcgccctttcacggcggtaaccggggttcgaatccccgtggggacgccatttaaagatgacttttgttgtctaaattgttctttaaaaaattggaaacaagctgaaaaactgagagattttcgaaagaaagtctgagtagttaaaaaaatcttgactgaacaaaagcagtcaagtgtttagttgaataaaatacagcattgaatggatttgaataagatttgaaaacatttgaggttgtatagttaagtgactaagcgtacacggtggatgccttggcaatcagaggcgaagaaggacgtgctaatctgcgataagcttggatgagttgataagaagcgtttaatccaagatttccgaatggggaaacccactagatgaagaatctagtatttactactgaatacataggtagtaaaggcaaaccgggagaactgaaacatctaagtaccccgaggaaaagaaatcaaccgagattctgtaagtagcggcgagcgaaagcggaagagcctgttagtgatagcagtagacacagaagaacgagctgggaagctcgactataaagggtgatagtcccgtattcgaagtgtctattgtggtactaagctaacgacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcctctttgtggggtgactgcgtaccttttgtataatgggtcagcgacttatattttgtagcgaggttaactgaataagggagccgaagggaaaccgagtcttaactgggcgttttagttgcaaggtatagacccgaaacccggtgatctagccatgggcaggttgaagattgggtaacactaattggaggaccgaaccgactaatgttgaaaaattagcggatgacttgtggctgggggtgaaaggccaatcaaaccgggagatagctggttctccccgaaatctatttaggtagagccttgagcggacaccttcgggggtagagcactgtttcggctaggggtccatcccggattaccaacccgatgcaaactgcgaataccgaagagtgatactcaggagacacacggtgggtgctaacgtccatcgtggagagggaaacaacccagaccgccagctaaggtcccaaagtactagttaagtgggaaacgaagtgggaaggcttagacagctaggatgttggcttagaagcagccaccatttaaagaaagcgtaatagctcactagtcgagtcggcctgcgcggaagatgtaacggggctaaaactagtcaccgaagctgcggcatcagtcgaaagactgttgggtaggggagcgttctgtaagcggatgaagctgaattgagaagtttggtggacgtatcagaagtgcgaatgctgacataagtaacgacaaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtataactgcgatgtggggacggagaaggttaggttatcagactgttggatgtctgtttaagccggtaggtgggaattttaggcaaatccggaattccgttaacaccgagaagtgatgacgagtctctacggagatgaagtaaccgataccacgcttccaggaaaagccactaagcttcaggttatactaaaccgtactataaaccgacacaggtggtcaggtagagaatactcaggcgcttgagagaactcgggtgaaggaactaggcaaaatagcaccgtaacttcgggagaaggtgcgccggcgtagattgtagagatttactctcgaaggttgaaccggtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagatgacacgccagtgttgttggaggcgtccttgaaataccaccctttaacgtttgatgttctaacgaagattgcggaacgcggtctcggacagtgtctggtgggtagtttgactggggcggtctcctcccaaagagtaacggaggagcacgaaggtttgctaatcacggtcggacatcgtgaggttagtgtaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgttccagttgtctcgccagaggcattgctgggtagctacatgcggaagagataagtgctgaaagcatctaagcacgaaacttgcctcaagatgagttctccccgactataagtcggtaagggttgttggagactacgacgtagataggtctggtgtgtaagtggtgtgagccattgagctaacagatactaattgcccgagaggcttaactatacaacgctcaagtgtttttgagcactacactcagtagcagcttgtttcgaatttaagaagaaagaacaaagacaaagaaagaagacaaaagacatcaacagaatattctggcgaccagagtgctgtggctctacctgactccattccgaactcagaagtaaaacgcagtaacgccgatggtagtgtggggcttccccatgtgagagtagggcatcgccagattgaatttagggaccccgtagttagagattgctacggggtttttgcttttctacaacaggcaacgatgttgttttatccagagccttattcttaacctcaacctcatttttatctttatcctcttttctttttttcctttttgctgatttaaactgccttactaatgatttgcaaaacggcagggaaatttaaccgcttgtttcgaataaaaaacggctagaaattgtttctagccgttttatttccttatttcattattttactggggcttgagcaagcagtttggtcaataatttccaataaatctcaactgcagggatatgtactttctcatccggtgaatgagcgttacggatagttggtccgattgagactagatccatatttggataaacttttttaattaatccgcattcgagacctgcatgaatgactttaatttttgcttcatagcccaatacttcatcataaattttcttggttaatggtgtaatgagagatgaagtatcaggttcccaacctgggtaatcgccgctaaattcgacatgagcactagtaagcgccgctaaagaattaattttagctcgtacgtcagcttttccactttcaatgagagaacgagaaagaatcgttgctactaattctttattttcgatagttaatacaccgatactgagagatgtttcaacaacattttttactacatcgctattacggataatgccatttggcaagagattaagtaaatgaatagctttttgtgttatttcacttgttaaaatttgtgtaggaacgttagtttcttctacaagtaaagtgagatttggttcagcaagttttagctctgagcttaaaatttcggttaattgtgctaagcaagcggtaatttttgcttgattatttgcatggaatacaatcgttgccgaggcctctcgaggaatggcatttcgtactgagccacctttgatatcggctaattggaaattagcttgagcgagactttccgctaaaatacgagctagtaatttgattgcattgacacgagtagtatggatatcgcatccggagtgtccgccctgtaaaccttttaaggtaatggttagagctttatcaaattgagacgcttgatattccagtggaagtgctaaattgatattctcgccaccggcacaaccaatgtagatttccccgttatcttccgtatcggtattgatcataatatttgatgttaaccaattcggacgtaagcctaatacgccttccataccgacttcttcgctcattgtaagtaatacttcgatttctgggtgggcaatgtcatttgcttctaatacagccatgcaagacgcaagaccaataccattatctgcgcctagtgttgttccttttgctttaacccattcaccgtcaatataaggttggataggatcttttagaaagtcatgttttgttgcggcatttgcctgtggaaccatatctaagtgggcctgtaaggcgagagattgacgattttccatgccggcagtggcaggcttacgaattaatacgtttccggcttcatctcgttctgcaaataattgttttgatttagcccattctaccagtgtgttggcgagttgttcttcatggtatgaagggtgtggaattgagcacactttatcaaaccattgccatagtagagtaggagaaagatttgaaatttcagacataataacctcgtgaaaataatgatagcgtttaagttttggtaaaaaattgcaaaaaatagaccgctattgatgaagaataacggaaatgatagcacgaaagcgctttttaggttaaaataacgtaatttttttattcggtgccttgtcaccgcttttttttatctaggatattttgtatgagcgaaaaatacacaaacgaaaaatatgttgtaacttgggatatgttccacatgcatgcgcgtaaattagctgagcgtcttttacctgcatcgcaatggaaaggcattattgcagtaagtcgtggtggtttattccctgcagcggtacttgcacgtgaattaagtattcgccatgttgaaactgtatgtatctctagttatgatcatgatgaacaaggtgaattaaaagtattacacgcagctcaaacagatggcgaaggctttattgttgtggatgatttagttgatacaggtaataccgcaaaagaaattcgtaaaatgtatccaaaagcaaaattcgtcactgtatttgctaaaccagccggtgctccattagtggatgattacgtagttgatatcccacaagaaacatggatcgaacaaccttgggatttaggtattacatttgttccacctttagcacgtcagtaattaagaacgtaatgaaaatggataattgagaatctacagctcggttatccatttttccattttctgttgtctattattaattaaacattatgagtttaggtaatctttatattctttctgcacctagtggtgcgggtaaatcttcattaatcaatgcactgttagctgatctacctcgttcggaagttcagctttctatttcccatactacgcgtaatcctcgcccgggtgaagaagatggagtgcattactattttacaaatcatgcggaatttgaagcattaattgagaaagggcattttttagaatgggctgaagtgttcggtaattattacggcacgtctttgcctatgattgaaaaaagtttagctcaaggtattgatgtctttttagacattgattggcaaggtgctcgtcaaattcgtcagaaacttccaaatgtaaagactatatttattttgccaccttcccgagcggagttagaaaaacgtttgtttggtagagggcaagattctgcggagaccattgcaaaacgaatgggggaagcaatttcagagatgtctcactataatgagtttgattatgtcattgtgaatgatgattttcagactgccttaggtgaattaaaaagcattttaactgcggagcgtttgaagttagatactcagactctccgacatcagcagcttattgagcaattactctcagcataataaatggtcaatttttgtaaaagatttcaataatgaattgatctttatagtaactggcaagaaaaaagagatttctttaaaatattcatttttcttattgtcctcgtttcaaggaaattacatgaaactttcaaaattagctttaacactttcagttgcacttgctttatctgcttgttcaacgaatatgagtaaagacgggtctcttgagcaggcacaagcaacctatcaacaataccaagagataacaaaacaatttcaaatcaatgaacaatggtggagaggttataacgataaccaacttaacaccgttattgatcaagcgattgcaaataacttagatttagcgaaaagtgccattgcagtaaataaagcgctttataatgctaatttagtcggagcaaatttagtaccaacgtttagtggttctggctctacatcagcatctaaaggtgttggttcaacatcaaaccaagtttcaacaggtgtttcaactatctcaaataaggcggcattcaatttaagctatacacttgatttatggcgtcgtttagcggatacggcaagtgccgctgaatgggagcacaaagccacgattgaggatttaaaatctgcacgtctttcactgatcaactcagtggtgacaacatattatcaaatcgcttattacaaagatgctattagcgtgattgaacgtacaattaagaactacgaacagatttcacgcatcttaaataataagttagcagccggtgcaatcgaccgtttagccgtagagcaagcacagcaagcgacattaaatgcgcgtaataacttaattgcttatcgtacgaatttaaaaacagcggaacaaacgctacgtaatttattgaatctaaaaccgaatcaatcactaccttctcgttatccaagtattttagcagtgaaattacaaggtgtagatttaaatgtaccggtttctgcaattgcaaaccgtccggatgtaaccgctcgtttaaatcgtttacaaagtgcatttaatagtttaaccgctacagaaaaaagttggtttccaaccgttactctaggcgcatcaatttccggtaatacagcaaaagcatataatgtggcagataatccagtgggtaatggtgttctttcatttgacttaccattcttagattggaatcgagttaagaataatgtaaaaatttcagagtctgattatatgacggcgaaattaaattatgagcaaacgttaacaagcgcattgaatgaaattgatacgcattattatacttatgaacaagctcgtagtagctatgcaaccttacaaaaagcgtatgaacatgataagcgcatcagcacttattataaaaatcgttatgaacaaggtgcatcggaattccgcgagtggattgcagcaatgaataccgagcttagttctcagctttcgattttgaatcaaaaatatacgattctttcaggcgagaatacggtatatcaatcaatggcgggtaaatatattcgctaagaaaaataaagcacgaagagcattttacttttcgtgctttttttcttatttcttgttttgttctgctgctcgtttacggcgaatttcttttggatccgcaatcaatggacgataaatctcaatacgatcaccattttctaccatatcggttaattttgctggacgactaaagataccaactttattggttctcaaatcgatttcggtatatttttctaagataccagattgcaaaatcacattttgaattgttgttgcgctatcaagtgtcagctttttaagaaaataacgttcaggataggcgtaagcaacttcaacaataatcttttctgattcagacaccgtaaacctccttggctctctgtttaaacgcattgaccatttttatggtcatttcgttaaacaccttcccaaacaccataccaacaacaggatttgagaactcaaattcaagttgtaagctgattttacagctttgttcatcaaaaggttggaatgtccaaacaccttgtaaataacgaaaaggacctttaattaatttcatttcaatacgttcattcgggcgcattgtgttatgtgtactaaaagtttggctaatacctaatttttgaatatgtagctctgcttctagttctgtttcaccacgactaatggttttggaacctacgcaactggataaaaattgcgggtatttttcgtaatcattaacgagctgatacatttgctcagcgctataagcgacaagggatgattggtttactactggcatggtttctctctcaaataagcggtcgtattttactaaatttttgcatttctacaaagaaacgcttttgacttgtaaatagacatattgcccttcttttaatgccaattcatcaaatgaccataagctaatgctagcccatattgtgtcgttatcaactaagacggcaatatccactcgttcactttgctcaataatctgcataattttgccttgtaagatattgcgaatagaactttggttcggcttttctaagctgatagatacatctttgctggcaatagtaatgcgtaatttatcaccgatttgataatgcggtgtttcgttaatccaaatttgctgcgtgccaagatttaagccaaccattttgtaagtaggttggtaggaatgaatcgttaattctaataagctaactttttgtgaatccggttgccaagccataaaagcagggtggtgccacacgttagtaacactatcgaaaagcataactttaccttgttcgagcaaaataaggttatccgccaaacgaataatctcatctaagctatggctgacatataaaatcggaatttcaatttgggcggcaagtttgctcaaataattcatcaattcgtgcttgcgcggtaaatcaagtgcagataatggttcgtccattagtaataattgcgggtcacttaataacgctcgaccgatcgcgacacgttgcttttcaccgccggaaaggctagccggaaaacgagtgagtaaatgctcaataccaagtaattgtacgatttgcaaaaagtgagcggaatccgaccgcttgtagccgtatttgaggttcttttcaacggtatagtgtggaaaaagtcggtgttcttgaaatacatagccgatttttcgcttttccggagcaaggttgagcccttgctcgctatcgaataaggtttgttgattaagtcggatatagcctttttgtggcgtagataaaccggcaatcagattgattaaactggatttaccggctccggaacgcccgaaaatagcggtaacgcctttattcgggatatctaattttaccgctaactcaagttgtccgagtgtttgatgtagatttaattgaagcataagttaattcagtaagcgtttctgtttttcagcaaaccattcggaagcaaatagtgcaattaaggaaatcataatcgaaacggcacataaacgtgcggcagccagttcgccgcccggtgtttcgataaaagtaaagagtgcggacggaatggtttgagtttgattcggaatattggagacaaaggtgattgttgccccaaattctcctaatgaacgagcaaaaccgagtacggctccagcgataatacccgaataagaaagcggcagagtgagtgtaaaaaagacttttaacggagaagcacctaaggttctggcggcttgttccaatttcggatcaaccgcatctaatgtcaggcggatcgatctaactattaacggaaatgccatcaccattgaagcaagtaccgcacctttccaagaaaaactgaacgaaaattcaaaccatttccataaatactgaccgattacaccttttttggccattgaaaccagtaacaaataaccgattactaccggaggcaagactaacggtaaatgaacaataccgtttaataagtttttgccccaaaattgtttgcgagataataaccaagcgataaatatggcgaacggtagggatagcacaaccgccagtaaagccacttttaaacttaggaaaatggcatcaagttcttgtggggtaaaattgaacattgcttcaaccgtagataagcagaaaaggaatagcgttagctatcccttttgtcgaattaattaatcggataaaaaccggcagcttcaaatttcgctttggctttcggtgtttttaggaaatctaaaaatattttagcttgtactttatcactcactgtagcagccggataaattacttcaccatagctttcgtttggaaaaactgcgattactttcactttattagaaactttcgcatcggtagagtaaacaataccgagtggcgattcgccccgttcgacaaacgaaagtgcatcacgtacatttttggctcgggcaagtttaggctcaatttgctgccataagccgtaatgttctagcgcttttttcgcatatttgcctgccggtacatgagccggatcaccgaccgataaatagccatttgctaaaattttgtcaaaaccgactgcttgtatatcgcctgccattaatgaactgtcttttggtgcgatcaaaacaagatcatttttaacgagataacggatattttgcgtttttgcgggctgtttttcttttagatagtccatccatttcaggtcggcagaaataaacacatctgccggtgcatcttgttcaagctgtctagctaaaactgaacttgaagcaaacgaaaaaatgactttatcatcaggatattgtttagcaaaatcttgattgatttcttgtaatacattggtcattgatgaagcggcgaaaacggtaatatctgttgccaataccaaacttgatgaaaaaagcatattaccgattaggaaaagttttgttaatgttttcattgggtctccttttatataatcatgcgaaacaagcggtttaatttctcgtattttttgcaagtccacataacttattttaagaacgtaggccggtacctttctctatcaatgaaaaagcaaaccaatataaaataacgataaagctactcaatactgaaaaagtataaaccacagaaacatccgtaataccaaggaatccgtagcggaaaccgttgatcatatacacaatcggattgaacttggagacggcttgccaaaactccggtaatagcgaaatagaataaaatacaccacctaaataagtgagcggcgtaagtacgaatgtcggaattaaaccgacatcatcaaaggatttcgcatataccgcattgattaaaccgcctaatgcaaaggtgatggtcgtcattaatagcgtcagcaaaatgatcgcccatgaatgaatgtcgtaagagacgaaaaagagcgaaaccagcatgactaaaatgcctgccaatccacctcgaataatacttcccgcaacatatccccaaataatatcgtgactggaaagtggcgagacgagtaattcttcataggttttagtgaatttactcaggaaaaatgacgatgcgctattaacataagatgcggtaattgccgtcatcattacaagtccgggcgcaataaattgcatatagcttacaccgctcatatcgccgatacgaccgccgattaattttccgaaaatgaggaagtagagtgtcgtggtaataataggcggaacaagtgtttgtttccaaatacgaatcactcggcgtgattctttgccggcaagagtgaggaatcctgttaaattcattttaattcgccattttcataaacaattcttctaaacgattggatttgttacgcatacttgagacttcaaatccttgtgctgcaatttgttggaacaaattggttaaaccctgttctcgctgcacttcaacttctaaagtgttctcatcaagccatttaaacggatagctatggatgacaagcggttgattttccgattttttttgcaaatccagcacaaaagtttcggtttctaatttggcaagcaaggctttcatggaagtattttcaaccaataaaccgttttggataatcccgatatgacggcaaagattttcggcttcttccaaatagtgagtagttaaaataatggttgtgccttgttgattcagttcacgtaaaaagtcccataaactacggcgtaactcaatatccaccccagcggtcggctcatctaaaatcagtaatttcggattatgcattaaggctctggctatcattactcggcgtttcataccaccggaaagctcacgggtaaaatggcttcgtttttcccaaagatcgagttttttcagccaagtttcagctcgagttaaggcttctttatgtgagataccgtaataaccggcttgctgagtcagaacatcaatcactttttcaaactgattgaagttaaattcttgcggcacgagaccgatttgctgtttaagctgaattttttgcgtatcaagatcataaccgaagactttcacgctgccgccggttttattcacgagggagctgataatgccaatggtagttgatttacccgcaccgttatgaccaagcaatgcgtaaaaatcaccttgttcgacaataagatcgattcctttaactgcctgtacgccggtcgggtaggttttgataagatttttgatttctaaagctttcattattctttattctctgcaaccgctctaattgtgctttcgtctatttccgcatcaaatgtttggcgtaacagcattaatttttcatcattggtaagcgcttttttggcttcgagggttaagttttcaaaaatggcacggcgaatttctagcggtgttttatattccgtactttcgccaatactcaattcatagctaaagcctttttcttgtaaggcagttgctaggctttgacgagattcgggattatccaaatgtgccattgccggcttgaggatcaatttaagctgttcaccttgtttttcggctaaatagctatttaatgccacttgacgagataaaccaccgagttttaattcattcacaatttggcaccattcgtcttgctcgcaagataatgcgatggtttttgccactaattccggcgtacgttcttgtaagattgcttgcttgatatcggatggtttggcactttcgttttgggtttctaattcaggattgagccacgtccagcgataatcttcatcgcttaatagtttttctggttgctttgttggttgaagctgagcttgcgtttgttgctcagttgccaaattcataaaacgctcttgtaaacttggcgttttttgtgaatttggtctactcgccgatgaaatagccggtttagctaactcaggcttttttttttcgttttgagtaagttgtgcctgagtttgctgtaactgtttacgggcttgcattgctgcaagtgctggtgatactggcgctgaacctctttcaacaacgcttgcggcgggctgctgataagcgcttgaattttcctgttttgtagcaggttgtgttacaaaattttgagcagaattaaccgcttgcagtgcgtggttttgtgttagacgtgctttgagctgttcaatattttgctgtggtgtatgcgatacagttgctgttgtttgaacaacttcccttaccggttggcgattaatttcttcagcacgtttaggatggaaagccaatgctcgtaaaatggtcatttccacaccggcacgttgttccggtgcgaattctaattcttttttaccgctgagcattaactgatagaaaaattgtacgtcttcaggcgcaatttgttttgctaaaaaatgcagctgagtttgttcctgcccattatttttgagcaactgaagcatcgcaatttggtgtaaagtttgggcaatgtccgagagtaattgtgaccaatcaacccctttttcggcaacggattgaatgaccgacatcgctttttcaccgtcggcttgcgcgagagcggtgactaattcgattggctggtgatcatcaattaaaccgagcatttgctgcacgataggtaagctaatattcgcattacttaccgcaatcgcttgatcggttaaacttaatgaatcacgaatactgccttgagccgcttttgccaatttttcaatagcggctgactcgtaggaaatattctcctgttgcaggataaattcgagatggtttgcaatctgagcttgatccaacgcacgcaaatggaattgcatacagcgagataagatcgtgatcggaagtttttgtggatctgttgtcgccagtaggaatttcacgtattccggcggttcttcaagcgttttaagcaacgcattgaagctgtgacgcgagagcatatgcacttcgtcaatcaggtaaactttaaagcgtccgactgttggtttgtattgaacgttatcaagcagttcacgagtgtcttcgactttggtgcgtgaagccgcatcaatttcaatcagatcaataaagcgaccttcttcgatcgctttacaatttgcgcattcaccgcaaggcgttgcggtgataccggtttcgcaatttaagccttttgcaaataggcgtgcaatcgaggttttacctacaccacgtgtaccagaaaacaggtaggcgtgatgaagtctgccttcacgcagaccattttctaatgcagataaaacgtgttgttgtccgacaacctcagaaaaacgttgcggacgccatttacgggctaaaacttgataactcattgcgactcttatttattacggaatagtattccgtactaagaaatattaatgaccggcaaattcaactaatgtgaatgagttgatgccttctttttctagacgttctttaccgcctaaatccggtaaccaaatcacaaatgcagcatgttctactttaccgcctaagcgacgaattaattttgccgtagcgtcaatcgtaccgccggttgctaataaatcatccacaactaacacattgtcactttcttttactgaatctaagtggatttccagcgtatcttcaccatattctaaagaataagattgtgaaataacttcacgtggtaatttttttggtttacgaactaagacaaatggtacgcctaacgcaagtgcaaccggtgcgccaaagataaaaccgcgagattcggttccaacgactttagtaatacctttatctttaaattcagcaacgatcgcatctacggttgccttgaatgcttccggcacttctaataatgaggtaatgtcacggaaaataatacctgctttcggatagtcaggaatagatttgatagatgatttgattaaatctaattggttcatggttagaccttaaaaaatagcaaaataacctgaagaatttagcaaaactgagcaaaattacaagggaaatttgaaaaagaccggcgatttcctctaaaaatgagcaaggaaatagtaatttttcagcactttattcttttctaagcggttatttttgaagacttttttgcaaaaaacacagaaaaaaagaccgcttgtagcaattagagcatactgtagcagtcttttgctgtgatgcgtttatccaatatctttagcaagataatgtagtactccgccaaagactttttccagattttcggtagtaaaggtggtttcggttttcccggcagcaagtaaggtacgattgatcatcaatacttgatcgcaaaagctaggcacgctatttaaattatgtgttgaaactaaaactaaatgtccttcgctacgcagttgctgcaacaattcaacgatggcattttcagttttgacatcaacaccggtaaacggctcgtccagtaaaataatctgactttcttgtgccaatgctcgagcaagaaacactcgctttttctgtccgccagaaagctcaccgatttgtcggtgttgcaaatggcaaatgtccactcgttccattgcctgcatcactttttgtttatcaagaggtgaaggactgcgtagcaatcccatatagccataccgacccatcatcactacatcgtaaacggaaacaggaaattgccaatcgacttcttcactttgtggcacataagatactagattttgtttcaaagcttgttgaattggcatgtggtttaacaggattttgccggtttgaggtttgactaatcccattaaacttttaaatagcgtagatttaccaccgccattcacaccgattaaagcacaaattgtgccgtcttgaatctgaaaggatacgtcatgtaaggctaaatgcccgttattataacggacacttagcttttcaacagaaatagaggttggaatggatgccatattattttttgcttttttcaaaaccgtcaacaattgtgctgattgtcacttttaataaatccaaataagtcggtacagcgccgtctttggttgaaagtgaatcgacatataatacaccgccgtataatgcgccagtttcttttgctacttgtttagccggtttatccgatacggtactttcgctgaaaacaacagggatattgttagcttttacgccgtcgatcacctttttcacttgttgcggagaaccttgttcttcagcattgattgcccataaataaagttcttttaactgataatcttgtgctaaataactaaatgcaccttcactggttactaaccaacgttgtgcttccggaataacagataggcgttggcgtaaaggctctgcaatagctttgactttttcagcgtaagctttagcattttggttatagctttcggcatttttcggatcgtatttcactaatgcggcacgaatattttcaatatattgcagagcattcgctgatgacatccacgcatgcggattcggtaagtttttatattcaccttcagcaattgcaattggcgtaatgccttcggtcacaacaacagccggtttaccttttacgttttcaaagaaacgttcaaaccaacgttctaaattcataccgttccataagataaggtcagctttttgtgctttagcaatatctttaggtgttggttgatagtcatgaatttctgcgccaggtttggtaatagattctacaaccgctttatcaccggcaacgttttgtgcaatatcttggataacggtaaaggtagtaacaactttgaacggtgcagccattgagagggcggcactcatacctaatgtgaccacaaatgcttgttttaaaaatgaaagtttcatagtttctcctttttatcatgaattttcacttatgatgaaattgagaataaatctcaattaataataattataaacattttatgggtttaggtaaaccggcaattttggttgcttgttttgctgggccatcaggaaataaacgttgtaaataacggctattgcctttctcttcaccgaatttttgcgccatcgctttaactagcattcggattgcaggtgaggttttgtattcttgatagaaatcgcgtactagaaagataatttcccagtgttcatttgtcagaacaatttgttctttcttggcaatttcaatcgcaagtgcttctgaccaatcatcaaggttagttaagtaacctgaagcatctgtcggatatttttgttcgtttaattcaatgtaattcataaaaataaaaagtgccacaggtgtggcacttactctctcaaatttgttttagattaatcgtcactacctaagacaccaaagatttgtaataggcttaagaataggttgtatagagatacgtataaatccactgtcgcacggatataattcgtttcgccaccgtgaataatattacttgtaccaagtaaaatcgcaccgcttgagaacactacaaataatgcactcattgcaaggcttaatgccggaattgctaagaaaatatttgcgatgataccaacaagtaacactacgaataatgccatcatcatacccgataaaaatgacatatctttcttggtcgtaagtacataagccgaacacgtaaagaatactaatgcggttgcgccaagcgcaagaaccacaacgtcacctaaacccgcaccgatatagcggtttaaaattgggccaagggtataacctaaaaagccggttaaagcaaatacgcttaaaatacctgcaccgctatttgctgttgcattggttaggaataataaaccgtagaagccgattaataatccccaccatggtaatgccggtgcattcattgacattgccacaaaagcaattactgctgaaaaggctaatgtcattgaaagtaataaataagtattacgtaatactttgtgagtgctgagtaaggattcactgcttgctgcaccgttaattacacgattttccatattgtttcctttaagttgaacaaaattgcaatttatgtatggacaaacttccataaatcaagtgtaaattagcgacaaatttgcctaaagtcaattgactttatctatgcaatagttaaaaattttcttatgagtgtgatacacttaaacgactaaatatttactttgcaaacacctctatatgaaactaaattttcctacctatttaaccttatttcgggtaattttgatccctttgtttgtgattgccttttatttacctgccggttggtatgcacctgaaatttcaacacttattttctttattgcttctattacggatgcctttgacggttatttagctcgtaaatggaatcaaactacacgcttaggagcatttttagatcctgttgcggataaagtgttagtagctgtggcattggtttgtgtggtggaatattatcatacgtggtggattaccattccagcagcaattatgattgctcgagaaattattatttccgcattaagagaatggatggcagagcttggtgagagagcgagtgtagcggtttccgtatgggggaaatttaaaacaacagcacaaatgttagcgcttggtggaatgttatggcgatttaatttagcaatggaagttcttgcttggattcttctttatattgcggctgggttgacactttggtctatgattcagtacctgaaagctgccaaaggtagtttgctaaagtcataatgatagtctagatactagataaatgaggcaggataataccctgccttttgtttatgtatatctctctgttgaaatgataatcatttttgtttaaaattgaattgaaatttatttcaaaggagacaaataatgcataaatataaaaaaacaatctttcaactaagcttaattagcttagcccttagcggctatgtttcggctaatcaagctgatttagatacgattgaagttcaagcacagcctaccgtaaatcatactcgaaatattagtaatttacgtgaattactggcgaatcgtaccgatgttaatgtcggaggcggtagtgtttctgcacaatacatttcaattcgaggctcggggcaagatcgtatcggcatggttgttgataacacttcgacaaatactcagttatggtatcaccaaggtcgttttcaattagatccatcgatggtcaaatcaattaaagtagataaaggtgcgggttctgcgagtgcggggatcggagtaacggatggtgtgattcgtgcggaaaccgtttcggctaaagatttgctgaaagaaggtaaacctttcggagcgagaattagctcagaatataatagtaatcgaggtgttaacggctctctttcactatacggacaggcagataacctagatatcttgttattaggaagctggggaaatgataaaaattataaggctggtcgaggttattctgatgcagttaataccaatagcagagttgtaaataacacagctcgccgtcaagggaattatttggctaaatttggctatgatctcacagaacaacaccgaatcggtgcgagcttccgtcaagaaacttactatggcaacggacaagatcgttttgaaatgatttttaatagtcgtccggtaaatgcaaatacgacaacacgcacttacaacttagaatatgcaggtaaagatcttggtgtcgtgagagatattaaagcaaatgcattttatattgatggaagagataagcgtgaagattatcaaaaagataaacttaccggttatcaacgccattcaagaacagaaactcgtggtgctaatttagggcttacgagtgaactaggtggcgagcatttactaaaatatggtgttaatctccgtaaagaacaaacaggtagccaaaattcctttggttatattaaaggtgaacaaaaatctgaatacggtctatatgccgaaggtatttggtctttaggtaaaattgttactttaacaacgggcttacgctacgattattatactttagatactgcaggcaaagtagatcaacatggcactccaattgcaggtaagaaatcggtatctgataataaattgaatccgagttttggacttatttgggatgttacgccaaattttgttttaaatgctaagctaaattatgcaagtcgtagccctattttagcatctgcttatacagtaactgataatcgaggttcattagataaagcaagaggtttgcgttttattgatcctaatttaaagactgagaatgcacgtttagctgaaattgggtttgaatggaaatacgctgattttagtttaaaaggaagcgtgtttgagcaaagagtgaaaaacttctatcaaacaaaagatagtatcattagtaatgcgggaacattaaaaaccaaaggttatgatgcagaattagattatcaatggaatggtttaaaattaaccgcaggtatggcttatgcagatcctaaagcggattttgcactttctaacgatccgctaaatgttattcctcaaggtcgccaatggagtacaggcgtgtcttataaatttgcagagccaagtttagaactcggctggttaggtcgttatgcacaatctaaagaatatcaaactggctcaggtgcaaaagcagaaacgaaaagacgtatcggatacggtgtacatgatatttttgttaattggcagcctcttaaccaagataactttaacgtgaatttcacggtgaaaaacattggtaacaaattctatcgtagccatagccaaagaaatacagcgattacgccaccaagcccaggacgtgaatttaaattgggtatgaactatagcttctaagaaattagtttttggctaaatccatttgcaaaagcggttataaatataaccgcttttttgcttctatttggcgtactttataagcaagtaccctaatcgccaaatattggttatcatagacttaatttcttatttaactcgatactcaattttgtttatgtttgatgccaaatcctttcttgccgatgtaccccatcttcccggtgtttaccgcatgtatgatgcgaaaaataccattatctatgtcggtaaagccaaagatctcaaaaaacgcttatccagttattttcgtagtcaactcgccagtaagaaaaccgaagcgttagttgctaacattcatcatattgaaaccacgataacccattcggaaacggaagcgttattgcttgaacataattatattaaagagaatcagccgaagtacaacgtgcttttgcgtgatgataaatcctatccgtatattttactcacgaagcatcaacatcctcgaattacttcgtttcgtggtagtaaaaaaattgccggtgaatattttggtccttatccaaatgctggggcagtgcgtgaaacactaaacttgctgcaaaaactgtttccgattcgccaatgtgaagacagctactataaaaaccgttctcgcccttgtttgcaatatcaaatcggacgttgtcttgccccttgtgtagaaggttattactcgcaagcggaatatgataaccaagtaaatctagtccgtttgtttttacaaggtaaagacggacaagtggttgaacatttggtacaaaaaatggaaagtgccgcggaagatctggattttgaaggtgcagctcgttttcgcgatcagattcaatcggtacgagcggtacaagaaaagcaatttgtctctaacgaacgtttggacgatctggatattatttcgattgcttatcagcacggtattgcttgcgtacatattttatttgtgcgccacggtaaggtattgggcaatcgttcctattttcctaaagtgccgaataataccgatttaaccgagttggcggatacctttgtcggtcagttttatctacagatgaaccaacatcgcacgataccaaatcaaattattatcgatcagccgttaagtgaagcgactgcattagttaatgtgctgtcggaacaagcgggacataaagttagtattgccgataaaaatattcgtggcgataaaagccgctatttagcattggcgaaaaccaatgcagaagctgcgcttactttacaacttaaacaagatacgcatattcgccagcgttatgactcactcaaggcattactcaatttagcggaaatcagacggatggagtgcttcgatatttctcacacaatgggtaatcaaacagtggcttcgtgtgtagtatttgatgaaaatgggccgttaaaatcggattaccgtcgttttaatattgaaggcattaccggcggtgatgactatgcggcaatggaacaagccttattaaaacgctatgaccgtaatttggaagaagaaaaaattccggatattatttttatcgacggcggtaaaggtcagcttaatcgagctttagaaacctttgcttcgttaaatgtcagttgggataagcgtaaaccgttgttaattggtgtggcgaaaggagtagagcggaaagccggtttagaaaccttattgatcagcaaatgggataaggaaattcacttaccgccggacagtcctgctttgcatttgattcaacatattcgtgatgaatcacataatcatgcgattaccggacaccgcaaaaaacgccaaaaagcttttacggaaagtggattggaatcaattgccggtgtaggagcaaaacgtcgccaagcattactgaaatatctcggtggtatgcagggtgtgaaatccgccacgttagaagaaattcaatccgttcccggcatttcaaaacaacttgccgaagtgatttttgatacgttacaaaatagctaggtagcaagcggtcaaatttgcagaattttttgcaaatttaaccgcttgtttttactatatttacccaaagcaaacgtttgcgcaatcgtttgtgagagcgtataattcgccccaatttttttagtttgaggcatttatgcaaaatttacgttatcctgttgattccaaaccacctttcggattaacccttcttcttgcggcgcaacaccttttagccgcacttggcggcattatcgccgtgccacttgttatcggtaatgtacttaaactgccgattccggatacgattgtattagtgaatgcggcattattggtttcagggatcgtaaccatcattcaatgccaaggtatcggcccgattggcttacgtttaccgagtgtgatgggaaccagctttactttcgtggcggctgctttagcgattggttttagcgaacatggtgttgccggcattatgggcgcttcgttagtcggctcattagtgatgattatcggtagtttctttatgccgtatgtgcgtaaattattcccgcctgtcgttaccggtgtggtggttatgatgatcggtttaagcttaattccagttgcggtggattggttcgctggcggtcaaaaaggcgatgcgcattatgcggatccggcaaatcttgcgatggcgacctttgtacttgtgctggttgtgattttagtacaatgggggaaaggtattttctctgcagctgcgattgtgattggaatgatggtcggctatgtagtggcgttagcattaggttggatcaactttgatgcggttaaaaatgcagagagttttgctattccacagccgttgcatttcggattagcatttccaatttcaggtattatcgggatgtcgattgcttatttagtgacgattgttgaatcaagcggtaacttcttagctttaggtaatgctacgcaaactgaaattaccggtaagcatttacgtggcggggtattatgtgacggtttaggttctgcgtttgcggcaattatgtcaaccacgccattctcatcgtttgcccaaaatatcggggtcatttcgttgaccggtgtggcaagccgctatgtggtaacgattatgggcgtattattggttttagctggtgtattcccatggtttggagcattaatcgtttcgattcctagccctgttttaggcggtgcgggtttaatgatgtttgcgatgattattgcagctggtatccaaatgttggataaagtagaacgttcaaaacgtaacggtttaattattgccatttcgatcggttgtggcttagcggtgacgactcgtcctgaattattagataaattaccgagcttttttaaagaggtattcggctcaggaattacggtcggatcattacttgcattagtgctaaatctgattcttcctgaggataaagaataaataattagtgtaattggaaaaacttacttgaaattaggtaagtgaagccttatcttacgaaataacttaacgccacggtcaagtggcgttttctttttagattatcaattaaggaaacaaattatgacattacaagttactgacgcaacttttgaacaagaagttttaaaatcggacgttccggtattattagatttttgggcgccatggtgtggtccttgccgtatggttgcgccaattttagatgaattatcagaagagtttgccggtcgtgcaaaaatcgctaaagtaaacgtggatgagaaccaacaaatcccagcacaattcggtattcgttcaatcccaacattaattcttttcaaaaatggtgaagtggttgcaacgcaagttggtgcattaccaaaatcacaattaagtgcatttgttgaacaagcactttaatttttatttcgagaaagggcgaatttggttcgccctttttcatttgcaaaaaaattgttaaaaaagaccgctttaggctaataaagcctagcaatatcaagcacaaataggtacaatcttccagttacacttttttacaattggtaagagtagattcgagggcttagcccctattctttggagaaatttatgtcgtggaatgaaccaggcaatcaacaagacccgtggggtaagccgggtcaaaagaagcctgagcagcaaggttcacaacaagagccaaataagcaaaataatcgccaagagccgccggatttagaggaagcttttagttctttattaaagaaaatggggggtaataaagataataattctgctccttcgcaaaactttggtaaatttctaccgcttgctttgattttcgcagctattgtatggggcgtatcaggcttttatacggttaaagaggcggagcgtggtgtagtaacccgtttcggtaaacttcataacattgtgatgccgggtttaaactggaaaccaaccttagttgatgaagtgacaccggtaaatattgagcgagtttccgaattgaaaaccagtggctcaatgctgacacaagatgaaaatatggtacaggttgaaatgaccgttcagtaccgtgttgaagatccggctaaatatctatttagcgtgcgtgatgcggatgacagcttaaaacaagcgactgatagtgcgttacgttatgtgatcggtcatatgtcgatggacgatattttaactaccggtcgtgcgacagtacgtgagaaaacttggcaaaccttgcgtgatatcatcaagacttatgatatggggttattagttactgacgtaaacttccaatctgctcgtccgccggaagaagtaaaagacgcatttgatgatgccattaaagcgcaagaagacgaacagcgtttaatccgtgaagcggaggcttatgcgcgtggtcgtgagccgattgcacgtggtcaagcacagcgtatcgtagaacaagcaacggcatataaagatcaagttgtattggaagcaaaaggtgaagtagagcgtttctctaaacttttaccggaatataaagctgcgccgaaagtaatgcgtgagcgtttatatatcgaaaccatggaaaaagtgatgaaaaacacgccgaaagtgattatggacggtaatggtaataatttaaatgtgttaccaatggataaattattggctaaaccggctgcttctgaatcagtaagacaagtcgcacctattgttattcagcaaccgcaagttgttacgccggctcaaacacattctgtacctagttcacaaactagtacgcaaaatgcagaaccggtacgtaaagggagattttaataatgcgtaaattattattacctgttttagcgcttgcgggatttatcgtactttcttgtgtaacgattgtgccggaaggctatcgtggcattatgttgcgttttaataaagtgcatcgtgacgcagaccaaaaagtggtggtttatgcaccaggtttacactttaaagcaccgtttattgatagcttaaaagtattggatgcgcgtattcaaattttagatggtcaagaagatcgctttgtgacggttgagaaaaaagacttattagttgattcttatgtcaaatggcgcatcagtgacttcggtcaattctatactgcaaccggcggtgatgcacaacgtgcgtcggatcttttaaaacgtaaagtgggcgaccgtttacgttctgaaatcggttctcgtacgattaaagatatcgtatcgggttctcgtggtgaattgatggcaggcgcacaaaaagcattaaatgacggtgatgacggtgctgagaaacttggtatcgaagtggttgacgtgcgtgtaaaacagatcaacttaccgaatgaagtttcatcttcaatttatcagcgtatgcgtgcggaacgtgctgcggttgcaagcgaacaccgttcgcaaggtgaagaaaaagccgaaattattcgtgctgaagtagataagaaagtggttcttatcgaagcgcaagcgaagaaaaccgctgagactttacgcggtgaaggcgacgcacaagctgcaaaaatttatgcggatgcattcaaccaagagccggagttttatagcttcgtacgtagcttaaaagcatacgaaaacagctttgcgaaagatcaaagcaatatgatgctacttaaatcggacagcgagttcttccgctttatgaaagcaccgacaaaataactgtatctataaggcccgatctatatcgggtctttaatttttcatttactacagcgaaaacaccgaagggtgcatagtgagcaagcggttaaatttgcaaattttgcgagaaattaaaccgcttgtttagtgttttttggtattccgtagtagaaaatccattcatactaacaaaaagaggcaattcctatgggtaaaagtgttgctattctcggcgctcagtggggcgatgaagggaaaggtaaaatcgtagatttattaacagaccgtgtaaaatacgtggttcgttatcaaggtggtcacaatgcgggccataccttaattatcaatggtgaaaaaactgttcttcgtcttattccaagcggtattttacgtgataatgtaacctgcttaatcggtaacggtgtagtgctttctccggaagctctaatgaaagaaatgggtgaattagaagcacgtggtattaacgttcgtgagcgtttaaaaatttcagaagcttgcccattaattcttccttaccatgttgcaatggatcacgcgcgtgaagcggcattaggcaaaaataaaatcggtacaaccggtcgtggtatcggtccggcatacgaagataaagttgctcgccgtggtttacgtgtaagcgatttatttgataaagaagcctttgctgaaaaattaaaagatattttagattactataacttccaattagtacattactataaagttgagccggtagatttccaaaaaactttagacgatgtatttgcggtagctgacgtgattaaaggtatggttgcagatgtaacaactttacttcacgaagcacgtaaagaaggcgtgaatatcttatttgaaggtgcgcaaggcacaatgttagatatcgaccacggtacatatccgtttgtaaccagttcaaatactacggcaggtggtgttgcaaccggttcaggttttggtcctcgtaatcttgactatgtattaggtatcatcaaagcatactgtactcgtgttggtagtggcccgttcacaactgaattatttgatgaagtgggggcggaaatcgcacgtaaaggtaatgaattcggtgcggtaaccggacgtccacgccgttgtggttggtttgatgcggtagcagtgcgccgtgcagtacaaattaactcgatttctggcttctgtatgacaaaattagacgtattagacggctttgaagagttaaaaatctgtaccgcatacaaaatgccaaacggtgaaatcgtagaatacgcaccgatggcagcgaaagattgggaaggtgttgagccgatttacgaaacaatgccgggctggtctgaaaacaccttccgtgtaactaaacgtgaagagttaccacaagcggcattagattacatcaaacgtattgaagagcttgttggtgtgccggttgatattttgtcaactggtccggatcgtgtggaaacaatgatcttacgtgacccgtttgcggcgtaatttcgtttaaattttaagttgttttcttaccacggaaaacacggagttcacggaattttctgtgcattctgtgctttccgtggtaattgttttttgatacttgtctgagaagcagttaaatttgcaaatttttagcgaaatttaaccgcttgtttgggcaacttattttccgtagtgaaaccgaaaaatgaaatttattattaaacttttccctgaaattatgattaaaagcgattcggttcgtaaacgctttatcaaaattctgacctcaaatatccgcaatgttttattgcgtgaaactgaaaatgtggcggtgattcgtaactgggactttattgaagtacgagccaaagtggcggaagaagcaccgatggtgttggaattactgaaacgtacaccgggtattcaccacattttagaagtggaagaaatgccttttgttaccatgcacgatatttttgaaaatacattggcaaaagtacgtgatgaattggaaggtaaaacgttctgtgtgcgtgtacgccgtaaaggtaaacacgaattccgttcgttagatgtagaaaaatatgtcggtggcggtttaaatcaacatattgaatcggctcgtgtgaaattaaccaagccggatgtaaccgtgcgtattgatattgatggcgataaaatgttgctgatcaatgctcgtcacgaaggtttaggcggttatccgatcggtacgcaagaagatgtattatcgcttatttccggcggcttcgattcaggcgtatcaagttatatgctgattcgccgtggctcgcgtgtacattactgcttctttaatttaggcggtgcggcacacgaaatcggtgtaaaacaaatggcataccatatttggagccgttacagcacctcacacaaagtccgttttgtggcgattaattttgaaaatgtggtcggcgaaattttagagaaagtcgataatggtcaaatgggcgtggtgttaaaacgtatgatggtgcgtgccgcaagtaaaattgctgagcgtttcgatattcaagcgatcgtaaccggtgaagcgttaggtcaggtttcaagccaaaccttaaccaatttacgtttaatcgataaagcgtccgatacattggtattacgtccgttaatcacccacgataaagagcaaattattgccatggcaaaagaaattggtaccgatgatattgctaaatctatgccggaattttgtggcgttatttcgaaaaatccgaccgtgaaagcgattgaaagcaaaattgtggaagaagaaggacatttcaattttgaagtgttggaacaagcggtcgaaaacgcacagttccttgatattcgtgagattgctcaacaaacggaacaagaggttgtgtcggttgaaactacttccgaattaacggaaaacgatattattttagatattcgtagcccggaagaaaccgatgaggctccgtttagtttggatggcgtagaagtaaaattaatgccgttctataaactttcgagccagttcgcttcgttggatcaatcgaaaaactacttactttattgccaacgtggagtaatgagcaaattacaagcgctttatctcaaagagaatggctttagtaatgtaaaagtgttccgacactaattatttaggacgttaaaagcggtcatcttttgttaaacttttgcaagtttttaacagaaaatgaccgcttgtttattgaagtatgatgtgaatgaaaattaagcaaaagcttgtaattctgggttgattggggtttcagcgatattgttcacgtagttacataatgtcgctaagctcacacctaaaatcacatcaatcgcattttgttggttataaccggcagcgaagaattcatttagttgcgcttcggttaattttgctttctgcagcattaccgcaagtgtgaagcgtgctaacgtatctaatttcggatctgaaatacgtgcggttgcacgaatttgatcaacgatttcttttggcgcatttaacgcttttaaagaaattttggtatgaccggcaacacagaatccgcaaccgttaactactgctgccgtaatttgtaccacttcacgctcaagcggtgttaagctgttacgaccgttaataccacctaccgtacgataagtttctaacgcagtcggagcattagctaacacgccgattaaatttggaataaaaccattggcttgttggactgcttttaatgcttcttgtgcggcttccggtgcggtttcaatcgtatgaatttgaaattttgacatattataagttccttatagagagtaatctattttgttgaataataaaggttaaactcccttaaatgcaaagattttttaatattttatgcatataaatacctattttatataacaaaaaattctataacgaatgagagaaaggattgacgctaatgaaaaataaacatatttaccttgcatcaaatagcccgcgcctctgggaattgttacaaaatttagacttagatttgctccgtttatcaagtgaaattgatgaatcgccgcaagcagatgaaaaagcggatgagtattgcctacggattgccaagcagaaaaaccaagcggcacaagcggttagaattgcggaaaatcttgcagaacacccgatacttactgcggatacaacggtttcaattgacggcaaaattctcggtaaaccgaaagatgaacaagacgcttttgcgatgctaaaaatgttatcgggcagaacgcaccaagtatttaccgctgtttacattagttatcaaggtaaagaagtggagtgtttacataccagtgaagtgagttttagaagattaaccgatgctgaaatttgcgcttatattgcgacgggtgagccgatggataaagccggtgcttacggtattcagcagtttggcggggtatttgtcgagcggttatcgggaagctttaccggtgtgatggggctaccggtatttgaaactgccgaattattaaagcaatttgatttgcaacttttttaaaagattagaccgcttgtttgctctgttatcggcttacaagcggtctttttttgagattagattgctaattcaaatgcgtagaaagctactaacgcaatcgcaatgattaccgtaccgacgttgagttttttgaattcacccgaaatgatacgaccgatcactaatgcggcaaaactaagcataataccggttacgatattggcggttaatacgataaataccgcacacactaagcctgacattgcgccgacgaaatcatcgaaatctaattttgaaacgttacttaacattaataaaccgacgtacattaatgccggagccgttgcataacccggtactaagaacgcaagcggttggaaaaataacattaataagaaaccgataccgacaacgactgcggttaaaccggttttaccgccaaccgccgtacctgccgccgattcaatataaaccgctgccggtgccgtaccgaataaacctgaaagcacggagcctaatgagtcagaggttaaggctttatcaccgttaataatttgaccgtctttatctaataaattcgcttgacccgctaccgcacgaatcgtaccggttgcgtcaaagatagccgtcatcactaatgcaaatacgacaggtaaaatagccgtatttaacgcacccattacatcaagatttaagaattgagaattttctccgaagctcggcattttgaagaagcctgcatattttacgttcgggtcaaacactaaaccgatgatggtgatcgcaataattacccataaaatgctgcctttcacttttaaacgctctaagccgataatcgccgctaagccaagtaacgccataatgaccgggaatgaggtgaaatcgcccatttttaccggtaaaccggcttgattgccaaccactaagcccacgccgttcgctgcgattaacagtaaaaataaaccgataccgatacctgctccgtgtgcaatgcttgccggcaggttacgtaaaatccacgcacgaatgccggttaccgaaatgagtgtgaataatacccccattaagaaaattgcaccaagtgccaccggaatcgagataccttgactaagcactaaactgaatgcggtaaatgcggttaaagaaatcgcacagccgatcgccattggtgcatttgcccataagccgattaaaattgaacctaaacccgacactaaacaggttgcgataaataccgattcagccggaaaacctgcttggcttaacatacccggcacaacaattaccgagtacaccatagctaagaatgtggttaagcccgcaataatttcttggcgggtattggtgccacgttcttcaaatttgaacaaagacataaaatgaaaacctcaaataaatgaaataaaattttaaggaacgaattctacagaagtcagacctgataagcaaacgtttgcataacatctaataaataagcggtccgattttctttaagatttgcaaatctttcttaaaaagaacggacttcactaaaataatttttgtgaagcccgtgtattctgtggtcacaagttgcaaaattttagggaaatttgaccgcttgtaaacgaattaattagtgcactgatgcaagttgttctaaatctttatcaatgtagtataacgctttgccgtcttcgcctaacagtttaaatttatttaaaatcgaattaaataggaattcttcttcgtgctgttcagccacataccattgtaagaaattaaacgatgagtaatcttttgcttcaaaagtgacttccactaatttattgattgaatccgtcacgtgtttttcgtgttctaatacgatttcaaacaaagattttaacgaagcatattctgcttgcggtgcttcaattgcataaatctccgctaacgaaccggtttcgtttaaataggtgaataagcggcgcatatgttccatttcttcggtggcgtgcgcttttaagaatttcgctgcgcctgggaagccgttgttatccgcccatgccgacatttgtagataaacgtttgaagaataaaattctaagtttaattggtcgtttaattgtttgatgattgccggtgataacattatgcagctccttgttcgtgatctaaagtttctaagtctttatcgatgaagtagagtgatttattgccttcgcccgcgactgcgaatttatctaaaatctcaccgaataatttctcttcttcgtgctgttcagcaacataccattgtaagaagttaaaggttgaataatcttttgcggcaaatgttacttccactaattcattaatttttgccgtgacgtgtttttcatgcgctagcacttcgtcaaataattcttttaacgaagcgtattctttgcaaggcgcatcgattttaccgagcaacggtaaaccgccggtttcgcttacatagtcgaacaatttttgcatatgctccaattcttcgtcggcatgacgaagtaagaattttgccgcaccggcaaaactgttttttgaacaccatgacgacatttgcagataaacgtttgaagagtagaactctaggttaatttgttcattgagttgatcaatgattttttgttgtaacatttttacctccaatctaatattaaaagattttaaataatgagagctaatttcattacgaaatccggatacgacaaaggggcggaaaaattccacccctttgatatattttgcgaattatatacgatattttgataaaaaactatctgttaatgatcaataaacgcttgttgatccgcaccttctttttccactaccggtttaaccatgtgttcacgatttaaaccaagttgtaatgcgacaccaatcgcaatataaattgatgagtaagtaccgaagccgataccaatcaataatgcgagtgagaagctatgaatcgttgggcccccaaaccaatataatgaagcaactacgaataacgttgttaccgaggtcattaaggttcttgaaagcgtttgacttaacgaaatatcaacgacttcttgtgaacttacacgacgaattttactaaagttctcacgtacacggtcaaatactacgatagagtcatttaatgaataacctactacggaaagaattgccgcgacgaaagtcaggtcaatctcaatctgtaagaatgagaaaataccaatagttaccaatacgtcatggaataacgctagaataccgccaatcgctaaacgaatttcgaaacgagtaccaacgtaaagcaataacataccgagcgttgcaagtgttgcccaaattgcgccttgagtaagctcttcacccacattaggccctacgaactcaacacttttaatcgttgccgaagggtctaaatcttgatgtacaagatccataatcttgttacctaaagacatatcccccgcagatgccggtaagcgaatcatcagctctttttggctgcctgtggtttgcaccaacgcatttccataaccgttttgttccaataaaccgcgtactttgcctaaatcggctggttgtgagaaggtggtttcgattaccgtaccaccggtaaaatctaaaccccagttaaaccctttggtgacgatagagaaaatacataatgcggtgacgactaatgaaaagacgaaaccgacataacgatatttcataaatggaacaagtttgtacggcagtttaatctctgacgcatttttttctgtttgcatagttgccatttattccaccttaaatccaaagttttttcacacgtttattgccgccgtacacccagttaacaagcatacgagtaccggtaattgcggtgaacattgaaatcattaccccaagtgcaagggtaattgcgaagccttttaccgggcctgtacccactgcatataacactaaagaggttaaaatcgtggttaagtttgagtcgaaaatcgaagtgaaggctccattgtaaccttcgtgaattgcctgttgaactgaacgcccgttacgcaattcttctttaatacgctcgtaaattaacacgttagcatccaccgacatacctaccgcaagtacgataccggcgatccccggcatggtgagtgttgcgccaattaatgacattaagccgatggttaataccatatttactgtaagcgccgctgcggcaaaaagcccgaacactttatagtaaattaaacagaatgcgatggttaagattaagccatacataccggcttccatcccttttgcaacgttatccgcacctaatgaagcaccgatagtacgttcttctacgatgacaatcggcgcaattaacgcacctgaacgtaaaagaaccgcaaggttttgtgcttctgccggtgagttaataccggtaatttggaattggctgccaagacgtgaattaatggttgccacattaatcacttcttcatgtttttctaagattactttaccttttgcatctttacgaccagagtctttaaactcgctgtaaagggttgccatcggtttgcctactgcacttttggtaatttccgccatcatatggccgccttccgcatcaaggttaatgcttacttgcggtaaaccacgttcatctttacctgatgtcgcatcgataatatgttcaccgcctaaagacggtttacgacgtaatacaacagcgccgccatcacggctgaattttaattctgagtcggcaggtacaatacctcgagcagcagattcagggcttgcctcggcgttcactaagcgaaactcaagcgttgcagttgcaccaagaagttctttagcacgagcagtatcttgtacacccggcaattcaactacgatacggtctgcaccttgacgttgaatagttggctcagaaacacctaattcttccacacgtttacgtaagatcgataagttttgttcgattgctgtatcgcgagaagcagataagccttctgcggaaggtgcaaatgatacggtagtcgtatcaataaatgaggcttcgagcgaagtatgctgacggcgtacaaaacgagctgctttttcagccgtatccgcatcggcaaattcaattacagttgcaaaattttcgccttttttaaccgctttatactgtaatttttctttacgtaattcgctgcgtaagctgtcttgtaaactctcttgttgttttgttaacgccgtattcatatccacttccattaggaagcgcacaccgccacgtaggtctaagcctcgtttcatcgggctaccgccgatatcggttaaccaacttggtgttgccggcgcaaggtttagtgcaacagagaatttgtcacctaagacatcagaaattttttctttggcaggtaattgttgttcatcattttcaagtcgaactaaaatcgagccgttctcaagaacggctgatttcggtgtgatattcattgatgacaatgttccctgaacttgagcgagcgtttcgctcgtggcttcttgacctcgcgtacctgaaatttgtactgaggggtcttcgccgtataaatttggaagagcgtataaaccaccgatgagtatcacgatgataaccatcaggttcttccataatgggaaacgatttaacacaataaatcccctaagataggaaaattaagaaagggctttcatttgaccttttggtaataccgcaacaacatagttacgagaaatcaccacttcagttgtatcgtttaatgcgataacgatgttttcgttttccgcacttactttagtgatacgaccgattaagccgccgtttgttaatacttcatcaccttttgcaaggttagaaagtaaatcacgttgttgtttttggcgtttcgcttgtgggcgataaatcataaagtaaaaaataagaccgaataccgctaaaattacgatcatttctaatccgccgccttgttgcataaaagctccttaaatcaataggttagtgtttaaaagataaatttcccatataaatgggaaatttggtggttaaaatagcataaaatcaagtatttaacgagaggaaaatgttagtgccaagattttctttttacagtaagattcgaatattgcgttaaatttcataaaattcaactcacaaaggaaaaataatgaaaaattctcttaaattggctgcactttcttcacttttattcgcgaatatcgcttttgcgcataatgtacagttaaatgcggcattgccaaatgttaccgttgcaaaagacggtgaattaacgctgaatggtaacaaagtaagttataaaaattggcagtcatcaagcttagacggtaaagtgcgagtagttcatcactttgccggcagaagtagcgtaaaagacaaaaataaagcgttgattgaagccattaaagcggcaggttttgatcgtactaaatatcaaaccgtcaccattgtgaatgcggatgatgcgattgtcggcactggtgtgtttgtaaaaaatagcgttgaagacggtaaaattgaaaatccgcacagccaagtggtattagaccaaaacggtagtgtgaaaaatgcgtggggtttaaaagcgaaagaaagttttatcgcagtattagataaaacgggtaaagtacaatttgtttcggaaggtaaattatctccaacacaaattaagcaagtgattgatttagttaaacaattaactaccaaataaaaaactaagggcgttatagaacgcccttttttgttgcagaaaattatggaaatttgaccgcttatttggcggttaagaacgcaatataattgcagcttacatcattatttagccaaaacttttcggttaaaggattaaaatgatagcctttcatttcttggcagtgaagttctgcttgatcgcaccaattcaataattctgccggtttgataaatttttcaaattcatgcgtacctttcggcaacatttttaagacatattctgccccaataatgactagcatataagccttaaacgtgcggttaattgtggagaaaaacagtacgccgttcggtttaagcaatgctttacaactctgaataatagaaagcggatcaggcacgtgttccaacatttccatacaagtaatcacatcgaatttctcggcatgacaagcggtctgattttgcacaaaatcttcaattgtagcttgtcggtaatcaatggttaagccgctttcttcggcgtgtttacgtgcaatttcaagcggttcggtcgtcatatcaataccggtaacattggcaccggcttttgccatcgcttcacttaaaatgcctccgccacagccgacatccaacacttttttaccgaataaaccgtttgatttttgttgaatatagtctaagcgtaatggattgagcaggtgaatcggtttaaaactaccgttcggatcccaccaagtggctgccattttttcaaatttatcaagttcttgttggtcaatattacgcattacggcctctggaaagatagatagaaaagtcaaattgcaaaataaatggcaaatttgaccgcttccttacattttcagctttcaattttcaactttcaactgtttttttatgctataatcgtgtgaatttttcgccctctactttccaagtagtttggggcaatcttttttataaacgtgattaggaaatttcaatgagcgaattagccaaagatattacccccgtcagtatcgaagacgagttaaaaacgtcttatctcgactatgcgatgtctgttattgtcggacgtgcgctacccgatgtgcgtgatggtttaaaaccggtgcaccgccgagtgttattctcaatggatcaaaacagcaatacgtttaaccgcccgcatgtaaaatctgcacgtgtggtgggtgacgttatcggtaaatatcacccgcacggtgactctgctgtgtatgacaccattgtacgtatggcacagccgttctcacttcgttatatgttggttgacggtcaaggtaactttggttcgattgacggcgatgcgccggcggcgatgcgttataccgaagtgcgtatgcaaaaaattacgcaggaattattaacggacttagataaagaaaccgtggattactcgccgaactatgacggcaaagagatgattcctgatgtattaccgaccaaaatccctgcgttattggtaaacggttcatctggtattgcggttggtatggcaaccaatattccgccgcacaacttaaatgaagtgttggacggttgtttagcctatattgaaaacgagcaaatcagcattgaagaattaatgcgttttatcccaggtccggatttcccgacaggggcgattattaacggtcgtaaagggattgaagaagcgtatcgtaccggtcgtggtaaagtttatgtgcgtgctaaagcaagcgtagaaaccacggaaaaaggtcgtgagcaaattgtagtgaccgagcttccgtaccaagtaaacaaagcgaagttgatcgagaaaattgccgagttagtgaaagataagaaaatcgaaggcattagcggtattcaagatcactcggacaaaaaaggtatctcaatcgttatcgaagtaaaacgtgatgcagtgggtgaagtggtgttaaatcacctttactcattaactcaaatgcaagtaacgtttggtatcaatatggttgcgcttgatcacggtcagccgaaagtattgaacctaaaacaaattatcgaagcattcgtgaaacaccgccgtgaggtggtgacacgccgtaccatttttgaattgcgcaaagcacgtgagcgtgcgcatatcttagaaggtttggcgattgcgttagcgaatatcgatcctgttatcgaattaatccgtaactcaaaaacagcggatgaagcgcgtgaaggtttattagcgcgtgcgtgggcattgggtaatgttgcaccaatgttagaagctgccggcgtagatgcgtcacgtccggaagatttaccggaaaacttaggcgtacgtgacggtcaatactatctttctgaagcgcaagcacgtgcgattttagaattacgtttacaccgtttaaccggcttagaacatgaaaaaattgtggatgaatacaaagaattgctcaccgaaatcggcgaattattacgtattctaagcagcgcagaacgcttaatggaagtgattcgtgaagaattagaaaaagtgaaagcagaattcggtgacgaacgtcgtaccgaaattacagcggcttcgggcgatatcaatatggaagatttaatcgctcaggaagacgtagtagtcacactttctcacgcaggctacgtgaaatatcaaccgctttccgactacgaagcgcagcgtcgtggcggtaaaggtaaatctgcgactaagatgaaagaagacgatttcatcgagaaattattagtggcgaatacccacgatacgattttatgtttctcaagccgtggtcgtttatatcaattaaaagtgtatcaattaccgcaagcaagtcgtggcgcacgtggcacaccaatcgtgaacattctgccgttagtgaaagaagaaaacgagcgtatcactgcgattttaccgattccgaacggtgagtttagtgcggataaattcatctttatggcaaccgcaagcggtgtagtgaagaaagtaagtttagatgcgttcagcaacgtgcgttcaagcggtctaattgcattaaaacttcgcgaaggcgatgagttaatcggcgttgatattaccgatggcgagagcgagattatgttgttctcggcgcaaggtcgagtggtacgtttcgcagaaaaagccgtgcgtgcgatgggacgtaccgcaacaggtgttcgaggcattaaacttgctacgacagaaatttcaagtgaagaaattgaagatgcggaaatcgtagaaattgaaaacgaggaagcggatgagtcttcagtaagtcttgataccgaccgtgtggtatcgcttgtgattccacgtacggaaggcgatattctaacggtaacgcaaaacggtttcggtaaacgtaccgtgattggcgaatatccggttaaatctcgtgcaaccaaaggtgtagtttctatcaaagtgaatgagcgtaatggtaaagtagttgcggcagttcaagttgaagaagcggatcaaattatgttgattaccgatgctggaacgctagttcgtacccgagttgcagaagtcagcctcgttggtcgtaacacccaaggcgtccgcattattcgcaccgcagatgatgaaagcgtagtaagcgtagaacgagtctgtgaacctgatgatgaagacgaaaacagcgaagcgttagacaacgtagaaagcacagaaacttcaacagaagcctaaataaagggcgtaagaccctaaacaagcggtcggattttggtaaaattttgcaaaaatccgaccgcttttgattataaaaacataaagaaaaaaggagacagtaatgaacgagcttaaactttttgaaaatagccaaattcgttcagtatgggacgaagagcaagaagaatggttttttagtattgtggatattgtggcggcattaacgggcagtagtaatccacgtcgttattggagtgatctaaaacgaaaaattactgaagatgaaggtggaattgagttgtacgaaaaaatcgtacaactgaaaatgcaatcatcagataacaagttttatcgtacagatgcttctgatatgtcaggtattttccgtataatccaatctattccaagccctaaagctgaaccattcaaactgtggttagctcaagttggaaaagagcgaattgatgaaattattgatcctgaattaactatcgaccgtgcgctacaaacctacttgcaaaagggttacagtaaagagtggattaatcagcgtttacaagcaatccaagtacgtaaagaattaactgatgaatggcaatctcatggcgttcagcacggtgcggaatatgctattttgactaatgagattagccgtgcctggagtggaatgagtaccaaagagtacaaaacattcaaagggttaaaaaaagaaaatttacgagataatatgacaacgcttgagttggtgttaaatatgttagcggaagcgacaacaacggagctgactcgtcaaactaatccgcaaggtttggaagaaaataaggcggttgcgaagcgtggcggaacggttgcaggtaatgcaagaaaagagattgaagcacaaacgggtaaaccggttattagcaagcaaaatgcgattgattttgctaagttaattgaagatgtaacaaaaaataaataagagaacgaaatattttgcgctaagcggaaagcatcaaatttaaagattttttataatttggtatttatcagtttgatagataccaacacaaatataagtatcgagaaataatatggcactactaaatttatccaatgcctatttaggttttggcgatcatccgttattggatcatacggaattacatattgaaccgggcgagcgtgtttgtttggttggacgcaacggggcgggaaaatccacgctgatgaaagttttggcgggcgaagttcagttggatgacggtaaactgatttttgaaaaagatattgtggtgacacgccttgagcaagatccgcctcgtcatatccaagatacggtatttgattatgtagcggaaggcattgcgcatcttagcgacttattaaagcaatatcaccacatttcgcaacaaatgcagactgattatagcgatgagctattagccaaattatcgaatgtacaggctcaacttgagcataacaacggttggcagtttgagaatcgtatccaagatactcttaaattattagagctagatccagataaacgtttatgcgaattatcgggcggttgggttcgccgtgcggcattagctcgtgcattggttgcggatccggatattctgttattagatgaaccgaccaaccatttggatgtggaagcaattacttggcttgaggatttattgctcaatttcaaaggctcgatcatctttatttcgcacgaccgttcgtttattcgtaagatggcgactcgcattgtcgatcttgaccgaggtaagctagtttcttatccaagtaattacgatgtgtatttagaaactaaagcggaagatttgcgtgttgaagcattacaaaatgaactttttgacaaaaaacttgcgcaagaagaagtgtggattcgtcaaggtatcaaagctcgccgtacccgtaatgaagggcgtgtgcgagcattaaaagccttacgtgaagaacgccgtaatcgccgagaagtacagggtacggctaaaattcaaatcgatcaaaccgcacgttccggcaaaatcgtcttcgaagtagaaaatgcaagttatgaaattgaaggtaaaactttactgaaaaatttcacaactaccattcagcgaggcgataagattgcgttagttggggcgaacggctgcggtaaaaccacctttatcaaattattattaggtgagttgcaaccgacttcaggctcaattcgttgcggtacgaaactggaagtggcttacttcgaccaatatcgtgccgaacttgatcttgaaaaaacggtaatggataacgtggcggatggcaaacaagacgtagaagtaaacggggtaaaacgccacgtgttaggttatctacaagatttcttgtttccaccaaaacgtgcgatgactccggtaaaagccttgtcgggcggtgagcgtaaccgtttattactggctaaattattgcttaaaccgaataacttattgattctggatgagccgaccaatgacttggacgttgaaactcttgagttattggaagagttattggcggattatcaaggtacattgctgattgtgagccacgaccgtcaatttatcgacaataccgtaacggaatgttatttctttgaaggtaatggcgttctgaataagtatgtaggcggttattttgatgcgaaacagcaacaagaaaactaccacgccacacttgcacagaaccagccaaacaagcggtcaaattctgcagaaaatttgcaaaaaacagaagaaaaacaaccgcttgtaacgaagtcggaaccggcgaaaaaagtaaaactctcgtataaagatcaaagagaattagatgaattaccggcaaaaatggaagccttagaggcagaaatggaaagtttgcaggcagaagtaaatagtgcggactttttcagtaaagatccaagctatacgcaagcacaattacaaaaactggcggatgcggaaatggcgttagaagcctcttttgagcgttgggaagcgttagaaaatattcgtaacggtaatatttagtaattaatttcttgtttaattttttgattaaacgagaaaatcttatagcatcgctttgaggatattaaacagcttttgtttatctcgagttgaaaaaagatcgtgggcagaaccggggtaaagcataacgccgatttcttggtatttctgccaatctaagcggtcaaattccactaaatcttcgcgattaccgctggataaaaacagatgtaactgattacggaagccttgctgtttttgctgtaatagcgctaagtcggttagttcaaactgtgcaagttgataacgttcattgagtgcttctcgataagcgctcatatgaattttatcgaagacttttgtctgtggagaaaatgcaaaggtttgatcggcaaataagtaatgcccaaataaaatcgcggcatagcctccggcggagcagccggcagtcattatttttgtcggttgtaacgctgaaataagttgcatcaaataagcaagatagtattcaaagtgtagcaaataccacgcctgaaaattatctttcacacagatatagttatattcagggtgttgtgcaataaaagaagaaaaggaaaaatctagcgctgtttgattcagctgatttagattagttaactgtggatcttgaagataatagttttcaatgtgctgaaaatagaagccttgaaaaaagacaataagcggtgcgttttcttgattttttaccactttaaaagaatgctcaaatgaaaactcaggtttttccgggcggtttaattgcttatttaatagttcaagtaaagcatattcatcataatgcgcttgctgtgtaagatcgggagaaagtgggataaaagatgatgattgctggatatattgcatatagcgttgatatttttcagcatttaacataggaaagcctatttagttgaaattttttggatagtatatgacaagaattgataattatgaacaacgttttggtggaattgggcgactttatacgccggaaggcttagcgaaattacgccaagcgcatatttgtgtgattgggattggcggtgttggttcgtgggcggtggaagcgcttgctcgttctggaattggcaaaatcactatgattgatatggacgatatttgcgtgactaatatcaaccgccaaattcatgcgatgaccggtacggttgctcagttaaaaaccgaagtgatgaaagaacgtattgagcggattaatcccgaatgtgtggtggaaattattgatgatttcatcacatcggagaatatccccgaatatctgaatcgtggttatgattatgtgattgatgcaattgattcggtgaaaaccaaagcggcactcatcgcttactgtaagcgtaataaaatcagaatgattactactggtggcgcaggcggccagaccgatccgactcagattcaaattaccgatttaagtaaaacgattcaggatccgctcgcctcaaaagtgcgttcgttattgcgtaaggaatacaattttagtcaaaacccaaaacgtaagtttggcattgactgcgtattctcaacgcaaccgctcattttcccgaaaatgggagagggctgtgaagtatcggcaacaatgaactgtgccaacggttttggtgcggtaacaatggttacggcaaccttcggcttttttgcggtaagtcgagtgattgataagctgctaaaggcttagtgacaagcggttaaatttcgctgaaaatttgcaaaaaatagctgaaatttgaccgcttgttttaagcaaaagaaaagggctaacttttgttagcccttcgttcatttatcaatcaatcataataaggaatttggtgaacttatttaccgtagtaagctttagtcattagctcttccatatcttctaccattgcaagacgtgggtttgctggagtacattggtcttcaaaggcatttaatgcaagctcacgacgtgctgctaagaactcttgttcatcaataccttgctcacgtaaagacattttcacgccacaacgtaccgctaagtcgtgtacggcttttgcataggattccaccgcttcttccggagttgctgctggtaaacctaaaatacgtgcaatgtcttggaagcgtttatccgcaacatagtttgtgtatttcggccaagttgccactttcgttgggcgagtaccgttataacgaatcacgtgtggcaataaaatcgcattggtacgaccatgaatcgtgtggaatttaccaccgattttgtgcgccattgagtgacaaatacctaagaatgcattcgcaaatgccatacctgccatggttgaggcgttgtgcattttttcacgagcgacttcatcaaattctttcacggatttttctaagttttcaaataccagtttaattgcttgtaacgctaaaccgtcggtgtagtcgttggcaagaattgaagtataagcttctgttgcgtgagttaatacgtctaaacctgtatctgctgcaacgtgagccggtactgacattactaatgcagggtcaacaattgcaacggttggggttaatgagtagtctgctaaaggatatttaatatcgccgtcagtaattactgcaaacggtgttacttcagaacctgtaccagatgtggttggaataccgacaaattttgctttacgacctaattgtgggaatttgaacgcacgtttacggatatccataaatttttggactaaatcacggaaatccacttccggttgttcatagaataaccacattacttttgccgcatccattggtgaaccgccacctaatgcaataatagtatccggttggaagctgcgcattagctctgtaccacgttgtacggtttgtaaacttgggtttggttcaacatcggtaaatagctgaatcatcactttattacgacgttgacgtaactgatcagtaattctatctacaaagccaagatctaccattgagcggtcggtgacgatcatcactttttcagcatttttcattgatttgagatattggattgaatcgcgctcaaagtagatttttgatggaactttaaaccattgcatattgtttctccgtctgcccacacgtttaatattaattaagttcactgcacttacgttgttacttacagagtttttaccgtaagagccacaacctaatgtgagggacggtaggaatgagttatatacatcgccgataccaccgaatgttgacggtgagttccaaatcacacgaattgctttaacacgttcaccgaatgttctagctaattcggcattttgtgtgtgaattgccgctgagtgccctaaaccatggaaattcaccatcgcttcagaaagctctaaaccatgttcggttgagtttgattttaataatgcaagtactggtgataatttttcacgagtaagcggctcaccttctccaacaaaagcgcattctgcaagtaggatattcgtttttggtggcacgctgaagcctgcttgttcggcaatccatgcagccggtttacctactaccgccgcatttagttttgcaccggcacagttttcatcttttgctttatccacaccgaaaatgaatttttctaatagtgctttttcttttttatttacgagatatacgccgtaagattgcatttctttaacgaaatcggcataaatttctttatcgacaattgctgcttgttcagatgcacaaatcataccgttgtcaaaagattttgacattacaatgtcataaacggcttgttctaattttgctgttttttcaacataagccggtacgttacctgcccctacgcctaatgctggtttaccgcaagaatatgccgcttcaaccatagcattaccacctgttgcaagaatggttgcgatgccagggtgtttcattaatgctgaagtaccttccattgacggggtttcaatccattgtacgcaattttccggtgcgccggcagcaactgctgcatcacgaacaatttgcgctgcatgagctgaagatttttgtgcagaagggtggaaagcaaaaacgattgggttacgagttttaagagcgattaacgctttgaaaatggttgttgaggttgggttagttgttggcgtgataccacatacaacaccgacaggatcagcaatttcggtaataccggttacatcatcttcactaattacgccggctgtttttaaatgacgcatattattgacgacatattcacaggcaaataagtttttagttgctttatcctcaaatacacctcgacctgtttcttcataagcatgcattgcgagtatgccatgtttatccagtgccgccacagaggctttcgctacgatataatccacttgttcttggttaagctgacggaattcgtctaatgcttttaaacctttttcaacaagtacatttacttctgcttgagcgtcatatggttgtgcattttttgcattgttagccatagtttggttcctctaaagtttcaaattttaaatttttttaactgatgaaattattgcctaaatgtctgtaaatttcatttaaaataataactctttagaagtatttttgatttgaatcaaaaataaaatagcgtgaaatttattggaaacgaataaaaaacacaccgttaacagtgtgttaactttgcacagaaattttggaagttcgggcaattaatggtaggataacactacttatataaatagaataaagttgtgaaattacctatgaaagatattttacgtattgcaacacgccaaagcccgttagcgctatggcaagctaattttgtgaaaaaggaattagaaaaacgttttccggaactcctggttgaattagtcaccatggtaaccaaaggcgatattattttagatacgccattggctaaaatcggtggcaagggcttgtttgttaaagaattagaattagcgcttttagaaaaccgtgcggatattgcggtgcattcgatgaaagatgtgccgatgacatttccggaaggtttaggtttggcggtaatttgtgagcgagaagatccgcgtgatgcgtttgtttcaaataaatatcaaaatttagatgaattgccagccggcgctgttgtaggtacatccagtttacgccgccagtgtcaattaatggcaaaatatccgcatttggaagtgaaatctttgcgtggtaatgttggaacgcgtttatctaaattggataatggtgaatatgatgcgattattttggcatcggctggattaattcgcttaggtatgcctgaacgtattcgtagctttattgcggtggaacaatctttaccagctgccggacaaggggcggtgggaattgaaacacgtgtaaatgatgagcgagtgttaaattatcttgcaagtttaaatcataatccgaccgcttgttgtgttatggcggagcgagcgatgaacacccgtttgcaaggtggatgccaagtgccaattggtggctttgcaacgctaaatgggaatgaaattaccttaaatgcgttggttggtgcacttgacggctcaactattattcgagcttcaggcgtagctgatatagaagatgctgaacagcttggaatctctgttgccgaacagcttctagcacaaggtgcagataaaattctcgcagaagtatataaagacgaataatatgaatgtgttaattactcgccccgatcatcgagggcaggaattagttgagatgctgaatcagcatcaaatttttgcgattcatcagccgctatttacaattgaagcagggacagaacttcctcagttgccttcagttatggctcggttaaatactggtgattatgtatttgccgtttctaaacaagcaattgatttcgcttcggaaacgttggaacaaacaggttttcattatcgttctgacttaaattattttgcggtaggtcagcaatcggcacagtatttttcatctcgtagcgaacagccagtgcgttatccgattatttcggaaaatagtgaggggttgttgttattagatgaaatgcaagatctcaatggtaagaatttattgatactacgagcggaaactgggcgtgatttactggcggaaaccgcagtttctcgaggtgcggacgttcaatatttggaatgttatcgcagaaaatatgtcgaagaaaacgttgctgaaaaaatcagcttgtgtaaacgtgtcggtgtcgatacgatagttgtcacaagtggggatattttaacaactttatatgagcaaacagcagaagaagaccgcgtatggttatcagaatgccgtttaattgttgttagtcaacgcattgcaaaaatggcatataaattgggatgggagcagaataacgtgattctctctgaaaaagcagacaataacagtttgctggaaaccgtattgaatgtgatcgaaaagtcgaactaaggtgggcgtatgtcaaaagataaacaggttattgagcaagtggaagaaactgtggaaacagctgcttccacagtagataaagcggtcgattcagcagaagaatttgcaaaagattcggaaaaattaaccgcttccgatacggataaagaggatgtcaaagtgggttcaaaagtggaagagaaaacggttattgttcaaaaatctggtggaaaaggaattgcttttctggccttattagttgcaatggctgtaggtggcgcaggccactatatggcaaataaaaaatttaatgaggttgagcaacaaatcgcccagctttccggaaaaccggtagaagcgttaggtgatattccgacttttgaagcggagaaggctcagttgaccgagttaacggaaaattatcaaaaagcattggagcgaattactcaattggagcaagagcagttatcgtatagttctcaaattacgaatctacaaactcaactccaaaaagtgagtggtatgccgcagtcggactcggttgtttggaaattatctgatgctgattttcttctcaataatgctttacgcaagttagtgcttgataatgatattgatacgactaaaagccttttacaagaagcggatgctgtgttagcacaagtggctaatggtcaggttgataacattcgtgccgcaattaagaatgatttagctcaattggcgaatgtaaacaacgtagatcaaaatagcattatgcagcatttgaccactcttgcgaataatttggatgatttaccaatgttggcaaatgaatcagcggaagagccggctatggcgagtggagaagtgagtgattcgattcaagattggcaacaaaatattgagaaaagtgttgattcattcttagatcactttattcgtgtaagtgatcgcaatacagcggatgaaaaagcgtttgttgcaccaaatcaggaaatttatttacgagagaatattcgtttacgtttacaaattgcgattttagccgtgcctcgtcaacaaaatgaattatataaaaaatcattagatgctgtgagtacatggattcgtagttactttgatacgcaaaatgaaaatgtaaaaagtttcttaaaagaattagatgaattagcggaacaatcggtttatgttgatgcgccgactcgtttacaaagtttagaattactggaacaattattgaataaagcgcctcaaacggttgataaaatcgaaattaaagctgagaaagagctaacaaatcccgctccgatggaagaacaaaaagctatttcggtagaagaaaaaccggctgaaaataagcaggaacagtctgtagaacagcaaccggcacaacaacctgcggcaaaataggagataattgtctatgtttagagttcttttcttaatgcttctgcttttggcggggctaattgccggtccttatatggccggtagccaaggttatgtgcggattgaaacagcaagtaaagtgatcgaaatgagcttagttatgcttgttgtcttttttgtcattgcaatggcggtggtttatacggtggaatgggtggtaagccgtttctgccgtttaagtaaaggttcatataattggttctttaatcgtaaacataaaaaagctcagcaggaaactctcgaagggttaatgaaaatgagcgagggcgattattcgaaagctgaaaaattatttagcaagaatgcgaaacacgctgatgagccggtattaaatttacttaaagcggctgaagctgctcagcaacgaggcgatgatttcagtgctaataaatatttaattgaagctggggaattagcaggtacgaataacgttgccgttgaattagctcgtgcaaaaattctaatgcaacaaggtaaattgccggcggctcgtagtgcgattgacagtttaattgagttagcgccgcgtaatacggaagtgttgcgtttagcgattcaaatttacaaagattcaaaagcctataatgcgttggatacgattttagaaagtattggtcagcgtagtttcttatcagcagaagaatataccgcattagaacattttgttgatgacggcctattagatgagaaaatgaatgaagaaggtcaagacggtttattgacgtggtgggaaaaccaaccgagtcgccgtcgtaaatctatctacgtgcgtatcggtttgattaaacgtttaattgatacggatgatcacgattctgcacaagaaattgcgcttgaaacactgaaaaaatatgaagatgagcagctagtaccactcttcgaacagcttacacgcttgcaagtggcggaagatagtaaactggttaaagtgcttgtgaaaagagcagataaagccaacgagcaatatgcagatgattatgcaagagcattaggctatatctatactcgtgaaggtttgtttgaaaaggcgaaagcctattttgctcaactaatcgaacaccgtgaatgcgttgcaaatgaccgtatcatggcattgcatgttgcagaacaaacacatgatactgtgttagcgaataagattcgtgagattaatctgaagcaagtgagtatggataagaaagctgatactcaggaagtgacaacagcattagctgaaaaatcagcttaatgtattatatagaaaaagccgtttatcgagagataagcggcttttttgttgaggttaattagtgctttttagtaaatactttcattaacggtaaaataatgaggcagcaaattgaaccgataataatacctaccacaaaatcaacgaggcttgcgaattgtgcaggaatacctaaatgttcgacaaagtgatgaatttcggcaatattatgtgagaaaatgccgccaccaactaagaacatggcaatcgtaccgataactgaaagtgatttcataaaccacggcataatcacaagtagagctttaccgatagattgcgataagccgcttttcttctgcattaaccataaaccgatatcatccagttttacaattaatccaaccaaaccgtatacaaaaacagtgattccgatcccgatacttgaaagagaaagaattttgatcatcgttgaagattcttgtaatacacctaatgcgatgataataatttctgctgataagataaaatcggtacgcactgcgcctttaattttatctttttctgaaatttgttcttcttctgaaacggtatgatattcatcttttttgtggaggaatttatgtaataacttctctacaccttcaaaacataagtatgcaccgccaatcattaaaagcgggagaattgcctgtggtaaatagatagaaagaagtagcgcaagcggaatcaaaataactttattaatcagtgagccttttgccacactccaaacgataggtaattctcgatccggactaatatttttcccgcttacttgatttgcgttcagcgctaaatcgtccccgattacgccggcagttttctttgccgcaactttggtcatgactgatacatcatcaagcacagcagcaatgtcatctaatagtgtaaataatgagctaaatgccattgagatactttccttaaaaataaaagttatataaaaaaaccgagctaaatagctcggctcttctgatttcaattcgaaattagcgacgtaaacctaaacgtgcgatagtttctgaatatttagcaagatcagtacgttttaagtagtctaataatttacgacgacgtgaaaccatacgtaataaaccgcgacgaccgtggtgatcttttttgtgcgcagcaaagtgtgcttgtaagtggttgatttgagctgttaataatgcgatttgaacttctgatgaaccagtgtcttttgcatcacgaccaaattcagcaacgatttttgcttttgcttctacgcttagagacattttaatatccttttttgttaagggttgataatacatccttcgccgatctctaactcagcgaggacaggaagcccgaattctaaagataaagcggtcaaatttcaactaaaatttgcaaaattaatgcgaagaatgaccgcttggttgtaaatattcctctctgttcggatcgaccgttttagatttgcgaatcataggttccacggttgaaccttgcactaaaattgaaaacatcaccacggcataggtcatcaccagaattaaatcttttacatctacttcgccggcaaatgccactttacttggaattgctagcgccattgctagcgcaagcccaccgcgtaaaccgccccatgtcataatttttaaagtataagggttataggtacggaattgctgcatcgctttgaacggaatccataaactgagataacgtgcagctaagcaaaccggaatggccacaatcattaaaataacaccgtagatattgaaatcaactaatagcaaagcaaaaccaattaaaaagaacaacagtgagttaaggaagtggtcgatcatttcccagaagtggtcaagataacgttggctttgttctgagaagcctgaacggcgtgtccagttaccaatcataatgccggaaaccaccatcgctaatgcgcctgatacgtgcaaaatattactagcgaacataaagccggcagtaggaattgtaagggtgatcaacatctccatcgaaccgtcatcggtcgaggaaattaagatgtgtgcaataaaaccgagcacgaaaccgaataaaataccgccgatagcttcatgcataaacaatcccataataccggagaaagtggcttcttgcccgccgaaagcaacagcaaagactgtgacgaaaataaccaaacccacaccgtcattaaataatgattcgccttcaacttgcatagataagcgctttggtgcgcgtaaatttttgataattgctaatacggcaatcgggtcggttggtgaaataagcgagccgaagacaacgcaataaataaaatcaatcggtaagccgatcagatgagcgacaccccaaattaaactggcgataaagaaagttgaggcgagggtagaaaataaggcaaaggtggtaatttcccatttttgatcttttaaaatcggcagttttaccccaagtgatccggcaaaaagcaagaaaccaagaataccgttaagtaaaaagctcttgaagtcgatttgttccatcacttctttggcaatggtgtcgatattaaaccaacctagtgagcctaaaacccaaacgagtaatgaacaaaccatagctgcggctgtaatagcaatggttgattgtacttttgcgctaattttacttgtaatgaatccgagcaaaatagacagcgccgagaggaagcaaatatatgcgtaaatgcccataggtaatcctgtcgatatgaatataagaaatgagaaagccagacataggctgatgaaagagtgaaattaaaacaattttccgtattaatgtaaagggaaaaggcgaacttagagggctgcaagcggtctgatttgtgcgtaaatttaccaataaatttgtaaaaaagtgacgaatttcagatttgagaattgctcactttacagtataatcgacacaattttttgcattaaacttaataattaggaatctatcaatgatcgaaaaaatgcatgaacggacaaatggtcccgtctttaaaatcatttttgcgttagtctctttatctttcgttattaccgggatcggtaccggcttagcgggcgtagatacttcagccgctaaagtaaacggtacggctattgagcaacaagcattcaatgctgcaaaaagtcgccaacaaaatattttaaatacgcaaatgggcgagcgcttttgggatttattagatacgccggaatatgcggcgcaattcaaccagtctatcttaaatggcttaattgatgatgaacttctgcgtcaatatgctcagaacctcaaattaggtatcagtgcggaacaaatcaaatcagaaattgtaaatagtccgacattccaacaagacggaaaattcaataatcaattatatcaacaagcattacgtaataacggtttaagtgctgacggttatgccgcgatcgtaaatgaaggaatgttattttctcaaatccaagaagggattattggcagtcatttttccgtaccggcagaacaagaattattagctaaattattactgcaaaaacgccaggttcgtttagcaaattattcagttgcagctgaagcgcaaaatcagaccgcttcaggtgaagaattacaggcttattatgatgcgcataaaaacgcatttgttgagccggaaaaactggctgttgagtatgtgaccttaacaccggaaaatgtggcaaaaaatgttcaaattacagatgaacaaattgcaacatattatgaaaaaaataaagcggattatgttactcgtggtgagtctcatatcgcccacattcaagtagcaaatgaagcggaagcgaaagcacttgagcaacagcttgccggcggtgcggattttgctgcattggctaaggcaaaatcaactgacaaattatcggcggcacaaggcggcgatttaggttgggcgaaagcaggaactttcccgaaagcatttgaagaggctgcgaatggcttacaagtcggcgcagttagccaagcggtaaatgttgatggtgcttatcatattattaaagtgctggcgcgtaaaaatgagcaagcgattccacttgaacaagtaaaagacaatatcgcgaaaacgattcgtaatgaattgttattaaccgaatattcaagtttagcgcgtgaaatggcaaataaagcgtttgagaataacggttcattagaaagcgttgctcaagcgggggggggagcgattcaaaaaacagcgcaatttacccaacaaaatgtgccggctgaattaaataatgagaaagtattaaaagcattatttagtggcgaattacgtcaaagcggtcaaaactctgatgcattagatgttggtgatgaacataatccgaagacaatgttcgtccgtgtaagcgattatcaagctgagcgcgtaaaaaccttagacgaagcaaagacggatgttgaagttgcagtgaaacggcaaaaagctgagcaagcattaatcgctaaagcgcaagaaacaattaaagcgttggaaagcgatcaagcggcagatgttcagtttggtgcggcacaaacattagtgtatgcgcaagcgcaaggacaacaaccggtattagcgcaaactgtgtttgctatgccaaaatcggccgataaagcgacttatagtgtcgctcgtgatgagcaaggcaatgtggtaattgttgctttagataaagtgattgatggaagttcggaagagtttaaaccgcttgcggcgcaatttagccaagcagatcaattactattacgtaatgatttgttaaaagatttacgtgcgaaagcttccattgaagtaaatgcagattttatggaacaactaggatcagcatcacattaatttaaattagctattgttataaacgcctagaacattgagttttaggcgtttttattttgtcacaggatcgtatccccgatataatgttaatttagctgttatgtaaaagtaggtttgtgtggaaatagtcattaattttgccatttatcttcaattttttatcggtttatttgcgattgtgaacccgtttggttcattaccgattttctttagtatgacaagccatcaatacgaggcggagcgtaatcatacaagcctagtgacggcagtttctatcggtgtcattttattagtcagtttatttttcggaaaactgattttagatgctttcagtatttcacttgattctttccgtgtagcgggcggcttcttgattgtgagcattgcgatgacgatgattagcggtaagttaggcgaacataaacaaaataaagaagagaaaaatgctgatgtaagcgaatacgaaaatatcgccgttgtaccgttggctatgccgattatggcgggaccgggtgctatcggttcgacgattgtgtggggaacgcgttataatcattgggtggattatgtcggattcagcgtagcaatagctgcatttgctgcagtatgttacgtattattccgtttttcagcccctttagtgaaaaaattaggtaaaacaggttctaatgttgtaacccgtattatgggattgattttgatggcattaggtattgaaattattgtggcgggtttaagtaatctatttccgggtttaacagctattcattaataggattatacagatgctttttcttaaacaagcggtcaaatttttgcgattttttgcaatttgcacagtaggtgctgggttactgtctgcctgcgatcaaaaaagtaagcaaccacaagtcgtacaaacaaaatcaccggaaatgccaattcgtgatcgaagtatattgaagcgtgctgtgtatgcagagcgtttgaggctagatactcactttatccaaacggcagatgaagctgcgtttgctcgagatatttttgctggtttggttgagtttaatgaaaaaggagtggttgttccggctctcgcaaaaaattggtttagtgaaaataataaagattggctattcattcttgatgacagtgctaaatggtcaaatggtgaaagcgtaacggcagatgattttgtagctagctggcagcgtttagctgatcctaaaaacgttgctcctcttgcaccttacctaacttatatggggatagaaaatgctaaagaaattgctgaagggaaaaagccggttagcgaattaggtataaaagcgttaaattcgcatagcttacagattaagctaactaagccaaatgcgcaattagtgaaaatgttaggacattccgctttattgccaacttttaaaggtgaagcgccgaaacttaatactttggccacgagcggcgcttatcatattgcggaaatgagtgatagatctgcgaaattacaagcggttaaaaacggcttggattttgcgaaagtggagcattatgcgatcagcgatttgcaagcaattaagcaatttgatgtgattgaaaatccattgcagagtcagcagcataatatttgggaattccctcgcttatgtacttattactatgagtttaattttgccgatccgcaattgaagaaaaaagaagtacgccaagcgttgaaagcaatcgtgctttctgcacgtattccacatttatacggcgtggctaatttctctgtattaccaaggaatatgcaggcttctgtgactcgtcaatgggcgccggtagtggttgaaccattattagctcaagccggaattaacgtgcagaatccgctaaaacttacgctgctgtatgatgatcatggcagacacagcgtgattgcaaaccaaatggtacgtactttaggagagtctgatctattacagatccagccgcaaggggtaagctgggaacaatttttggcattaagagagcaaaaagcgtttcaattaagccgttccggttggtgtgccgagtatgcggatccgctaccgttcttattacatttccactcaaaaagtccggataataagagcaattatgctaatgccatggtggataaacagttagaacaattgcagaacgagaaattatcggaagagcagcgccaacaacttattcagagtattgttcagcaattagagcaagatgtagcgattttgcctatgttccaatatcatcgcaaagttgcgttagactccaccattttaggtattgatctacataacgatagcgaagtaatttatagtaaacatttatatcgaatgaagcccaaggattaatcgatgaatcaacttaacgaacagcaattaagtgaaattaaatttatcttacaaaatttcactcaccctaccttgcaaaaagacttaatcgcattgaatgcgtttaaaaaagcggaattaggcgcaggcattttgcgtttggaatttaccatgccgtttgcttggaatagcggttttgaagcattgaaagcggaaacagaagcaaaactcaaacaagttaccggtgtaaatgaggtaaaatggatcttaaattaccaaattgcaaccttaaaacgtgccaataaccatccggcagtaaatggtgtaaaaaatattattgcggttacttcaggcaaaggcggtgtaggtaaatcgaccacctcagtaaatcttgcattagcattaaaagcgcaaggcgcaaaagtgggcattttagatgcggatatttacggcccgtcaattccgcatatgttaggcgctcaggatcagcgtcctacttctccggacaacaaacacattaccccgattgaagtttacggtattcaatcaaactcaatcggttatttaatggcagaagataatgccaccatttggcgtggaccaatggcaagttctgcactaagccagttattgaatgagacgtggtggactgagctggattatcttgtgattgatatgccgccgggtaccggtgatattcagcttaccctttcgcaacaaattccggtaaccggtgcggtagtagttacaacgccacaggatattgcgttattagatgcaattaaaggcatttcaatgttccaaaaagtgtcggtgccagtattaggtgttattgaaaatatgagtgtacatatttgccaaaattgcggtcaccatgaagatattttcggcaccggcggagcggagaaagtggcgaaaaaatacggcacgcaagtattaggtcaaatgccgttacacattcgcttacgtcaagatttggatgccggtacaccgactgttgttgcggcaccggaacatgaaactagccaagcgtatatcgaattagcggcaaaagtcgcttcagaattatactggcaaggttcggttattccgtctgaaattatgattcgtgaagtgaaataaacccgttcactaacaaccacataaaataaaacaagcggtaggatttgcagaaaaatttgcaaatcctaccgcttgtcttattatagttagaaatagctctcgatagggctaatcatgatttaaaatataaaaaaagcactcgacggagtcgagtgccagttaagagagtaattcagacctgttattgacgaggtcatcttcagtctattttcgtcgttaaactaacccaccactaaatcaaatctcacactaaacttgttttccattaaacggtattgctcttttaagttcgggccgcaagagttggagccgatgccactcattttgtaatcgatacatagcacgctgtaatcggattcttgtagctcgtagcaatgttttttcgcggttaattcttcttgcgtatatggcgagagattaaagctgaacggttggcttgcacgtacaaacagattttccgatttgagatattcgcaaccgtaatggctgccgttctcctgcggtttaacataatcggtatgattttgttttgccgtggtatggtagatgcctaacttcgctaaatggtgtttatccacatagctttcttgctcgccataaccgaaatattcgaccgtattttccgctttagcaagccagaaacgtaaaccgaaacgaggtaaatacggtaattcggttgggcggattgcgttgatttccaccgaaatctgtccgtcattgaagatacgataaccaatatccagtgttaaaatgcgaccgcgagaaatcgatacaatcgcagattttactgaaaattcgaccgcttgttcgctttgctgccactgaatttcatacgctctggtataggctttatcgtagccggcattttgccatgcttcacgaatgagacgatcattatcagtcggcgcacgccagatattaaaatctaacggttgctgaataatcgctttaccggctttttcaatacgactgaaaatccctttctgtttatctaattgataactaaattgcccgttgtgtacgttaatgtggaagcgatcttcctgtacttcaaatgtactgttctcaatcgtgaattgtggcaatcctaatttattttcgctaaataaattgagctgctcgaaaccaagtgaatgtgcttcgtctaataattcaaccacggtatttaagcgataatttaaattcaatagccataaatgcccgttattttttggtaactcaatcggtaatactacgctactgtgcggttggcaagaaacggataaatttccaccgcttgtaaccacgccgttttcgacaaattcataatcaatcatcagataatcagcaagatcggtgaaatccaaatagttgtggagcacaatttggttatcgattaattcggcacgtgcagggcgattcacatttttaagctctaataagttactgtgcggaatacgatccggtgaaaccaaaccgtccatacagaaatttccatcgtgcgggctgtcgccgaaatcaccgccgtaaccgaattgaccgttagcacggtaaggggcgtgatcactccattcccacacaaaaccgccgcatgattgcggatgacgatggaacgcttgccaataatcttccgcatcgccgtttgagttacccattgcatggctgtattcacacaacacgaaaggtttggcttgcgcagtggcacaatagcggtcgatatcttcggttgagccatacatttcactataaaaatccaaattcgacagatcattgttatcggcagaatgttggtaaattgagctttcgtaatggactaaacgagatttatcgcgttgtttaatccatgctactgccgcttcaaagtttgcaccgtagccagattcattacctaacgaccaaatgataatcgaagtacgatttttatctcgttccacgttggcttgttggcggtctaaaatcgcttttttgaacagcggatcacgggcaaagtagcagaaattatcgatcgtatcttggcggatacgtgcggtttgcaaatcgttttcatggtttaagaaaatactcggttctggtgttttgaccgttaacattgaagcaccgtgcgattcaacatcactttcgccaatcagataaaaaccgtattgatcgcataattcgctaaaccaaggcgcattcggataatgggcggtgcggattgcattgatattatgttgcttcatcagctgtaaatctttatgcgcttgtgcgtagctaatcgcataaccggttttcggatcgctatcgtggcggtttactcctttaaatttaatcggttgctgattaaataataaaatgccgtctttgatttccacttttctaaaaccgattttttgcacaatcacttcttccgcagtacgcaaaattaaggtgtaaagttgtgggttttcggcattccataactgaatatcttcgacatcaatattaagctgcgtatcggtttgattgaaaacggtaaagcctttcgggtcgagtaattggtattcaatcgcttgcggttggcggctaaaaagcgtttccactttcagatttgcgtgacgtaattcaccatccaattcatattgaataaagaaatcttgcagataattttgttcacgctcaagcaaatagacatcacggaaaatgcccgacattctgaatttgtcttggtcttctaaatagctaccgtcacaccatttcaataccactacggttaaatggttggtgccgacttgtaaataatcgctaacatcaaattcggaggtgttgtggctgatttggctatagccgataaactgtttattcacgtaaacaaataaacaagagtccacgccttcaaaattgagcaaataacgcttattgcttttcggagtaagttgcagagtacgatgatacacgccacatggagtttgatgcggtacaaatggtggatcaaacgggaacgggtagttaatattcgtatagtgatgatgatcgaagccgtgattttgccaatttgccggtaccggaattttatgttcaaacgcaacatcaaggaaattatccggtaggtcatgatagctttggaagtaattaaaatcccattgaccattgagcagggtaaagtaatcggattgctcacgtttaccacttaatgcggtttcattttgtttatgcggaataaaataagcatgatgatcaacagtatttacgtggagtatattcggatcttggaagtaatttggcagtatcatgataatttcctcgatgtttacaaattaaaagtgaaaggtataacgaatatcgtgtttatagtgttcgcccgctttggtgatgccaccgaattttgccagttcagcttggtttggcgaatcagggaaaaactccggttctaaagcaacgccagcatagtcttgatgagttgaaccgttcagattcggttgcccgccaagccaattccctgaataacattgcaacgccggcattgaggtattgagttcaaggctaagatcttcaacggttaaacaagcggtcggttttgaggaattttttactaatttgaaagcgtgatcatagccttttaccaactgttgatcggtatctttcagcaagtcttgcccgataggtttaggcgttgaaaaatcgaagccggtgtgagccaccgctttaaacggtaaaatcgggataccgtctgcgccgactggtaaatattcgtctgcattaatcatcagttgatgcgaaagtacattatcgctaccaagtaaattgaaataagcgtgattggtaaagcagagtggggtatcttgattggcggttgcgtcaatttcaatttcgacttcttttccatgcaaacgataagtaacaacggcatgaacttcacctccgaacccttcctcgccatctgcaaaaactcggctgaatttgaccgcttgcggatcaatttgctccgcttgccaaacttgcttatccgccccttttacaccaccatgtaagctatgttcgccattattttttgccaatgtgtaggttttgccgtcaagccgatattcggcattagcaatacgattggcatagcgtccgcaggttgcaccgaaataagcggtctgattttgccaattttttgcagaggtagtgattaacacttctcgttcgcctttcgggtgtttaactacacaagaaagccaagatgcacctaaatcggaaagggtaattttgaggaatgagttttcgagggtaaatgttttcatagttcatatcccaagcagagggaaagtcacggaaaatcttccgtgatttccgtgaattaaacattaaataagatgaacgccgtcacaagcggtacaaaggtggaaagtttctttaataccggtttgtttttcataattatcggcaatgagttggcgtaaatgttctactttttcatttggtactaaacaaacaatacaaccaccgaagccaccaccagtcatacgtgcgccgccatttttaccgatcgccacttgtgccagttcgactaagtaatcaatttccggaatggtaatttcgaaatcatcacgcatagagtcgtgagacccggccattaattgaccgagtttgaccatatcatttgcttttaaagcttcaaccgcttctaatacacgctgattttcgctgatgatatgttttgcacgtttataggcaagctcattttctgcttgtagctccgccgctcgctcgataaattgcgcaggtgtgacatctcgtaatgctttcacaccgaagaatttagcagcaaattcacattcctgacggcgactgttatattcaccggtcactaaatcgtgtttgacgttagaattgatgatcgcaatcgaatagccgtgcggtaccggtgtcggggtaatgtctagcgaacggcaatcaatcataattaattgatctttttgtccgagcgccgaggtgagttgatccatattgccgcagtttgcgccaacgaatttattttcagcttcttgtccgattaaggcgattttcgccaaactaagtggcaaatcacctaacacttgtgcggttttaccgattgaaatttctaatgcggcagaagaacttaaaccggaagacatcggtacgtcactggtcattgctaaatccgcaccttgtttaaactccggacatttcgcctgaatatatttcaccacgccacgtacgtaattcgcccatttgtgttcggacggttcaatcggttggctaaggtcgaactcatcttgttggttaatatcgatcgcatagactcgccaaaccgaatcgtcacgtttactaaagctggcagccataccgtagttaattgcacaaggcattacaaagccgtcattgtaatcggtgtgttcaccgataatattgactcgtcccggagcaaatacggtttgagcagccgaatagccgtaatgctcggcaaatttttgtatcgcaagttgttgtggtttcatagtctcggtctcttttctatttatctttatagtgaacgctgtcgctcaccgcatttaatctttctgccgcttgttccggtgtcaggtctcgctggctttccgccatcatctcatagccgaccataaatttacgtacagtggcagaacgtaacaacggtggatagaaatgagcgtgtagctgccaatgttcattatcactttcattaaacggtgcaaaatggaaacccattgaatacgggaaactgatattaaataagttatcgtagcgagtggttagctttttaagtgcgagagctaaatccgctcgttcggcttcgtttaaatcggtaattcgcttaaagtacttacgttttggtaacagtaaagtttcaaacggccaagccgcccagtaaggcactacggcaatccaatcttcagtttctaccacaatacgttcttttttagttaattcacggtccgcataatccagtaataatgggcggccgtattgagcaaagtaattcgcctgacactcgtcttcaatcgcaatttcgtttggtaagaaattacttgcccaaatttgaccgtgcggatgtgggttagaacagcccatcatcgcccctttgttttcaaaaatttgtacccattgataacggctttttaattcattagcttgttcttgccaaacttgtacgacttgctctatttcagccaccgaaagttgcggtaaggttttactatggtcgggtgagaaacaaatcacacggctttcgccttgagtatgtgaaatttggaaaagcggatcagaattggtttccggagcaggagtatccggcaatagtgccgagaaatcgtttttaaatacgaaaggttttgtataagcaggattttgctcgccggtaatgcgtttattgcttgggcaaaggtagcaagtcggatcataacttggtttatcgtcagcaaccgtttcttcttgctgaccttgccacgggcgttttgcacgatgtggtgaaacgagaatccattgattttttaatggattaaaacggcggtgagggtgatcatttaggataaattgctcgctcatgtagaattgctccaatttaagttttgttatcggagtataaccgacaatttgaactaaggatgtgattctgatcacagaagccgattttagcttactgttttctttatcttaattgaatactcaaatgttaacgttaccatttggttttttaaagaaaaaattctaaaaaatgtgagaaagatcacgctttttttgcaagtgtaaatagtgtgtaaattatagagaatgatttatttttttgtaggaaaattggtctaagcctgatcggttcaagatgtaccagtagtggtcaggctggcgttttgcataagtattctatacagtgcgagcgttcttattccactttatacataaggagtgtatatggctttcgatatctttaattactggggtaattttgatccgatcagacctaatagacctgtagttgatgaatcaaatgatcccgtaggccctgttcagctgttacaacaatttgtgatcgatgatgatcaggctacattagtattaattaatgaatgggtagcaccgccgagctatcgtgatcgtattgtgtttgatgatattagcggtggtcgtttactacttgtaaataacgacggtagctatcgtgaaatcaatgattcagataataacaactgggcattcagagaattaagaaatacagagcataaccgcctttatttcttaccggataatcctagctctgaagatacgagaatccatgtaaaacttcatgtggaaccgaataactcaaatgttgtggatgttcatgacgtttataatacgaattattcgatccattttgatgttcaggatatcgcttcaagcagtccggttaaatttggtacggattatgcggatagtctgtatggcacacgtgaaagcgatacgatccatggcttaaatggtaatgattttattatgggcgaagctggtgatgatgtgatcaccggtggtgctggtaatgatcgtttattaggtggctatggtgatgatacattatatggctcagagggtgctgactggctaaatggtggtaatggtaacgacttcctttatggtggtgcaggtaatgatacttactacttctataaaggcgccggccgtgatgaaatcttcgatgttgaaggtgaaaataccttacaatttgcgaatggtattcgccctcaggatatcactattgatgcgacaacaaatgatttaggtaatgtaagttggcatattcgtgtgaatggtacggatgatcaggttttcatttatgatcaatattcaaatggcggtaaaacaatcggtgtgaacaaatttatcttcggtaatgatttcttcacaacggaagagatctccgatatgttcggtttaccggaagtacctgtattagaagcggaaaatccagaacctaactttgttattgaagtagctggctataacgatctcatgattccaattgcggaaatctcaccgatcacttatccagaatatgctaactcattcatgttctaattgtagctatgtaatatagttagtcatataagaaagcggtctaatttcgcgaagaatttgcaaattcttgctgaaactagaccgcttgttatttggaaatgactgaatttgcttagaagaaaatttcagcctttaacccacccatttcactacgactcaatttcaatccaaaacgatgtaattcgacaatgcgtttaatgattgaaatacctaagccgctacctttttcatcttgactggattgaatcggacgatcgaccggacggtaaaacggctgacccagtttagccaaatcttcatcactcaccccattgccgttatcttctacgacgagactattcgttgataacgtaatcttgatgagactttgttccggcgtatagttaatcgcattatcaatcagatttcgcagcactaaattaagcaataatatctttcctaactgcgcttgaggttcagcttgcaaatcaacaatgatttccgaccgcttgttttcagcttgttggtaaagctgactaacattagtttctatcaattttcgccaattaatcggttccaattgatctagttcggttaaattttccaaacgagaaagcgtgagtaactgctcaatcaattgcgcaatacggtcgatactatttgtcatattttgtagcgctttaccgtgctcaatcggatcgtctaatgtcatttgcgctatctcggtttgaattcgcaagccagcaagcgggctacgcaattcatgtgctgcatccgaagtgaaacgtctttcccgattgaacattgtttgcgtgcgctcaaaataatgattgagattattgaccaacggaataatttcactgggtaattgtgccgtactaatcgctttgagctcgtccggcttacgcaatgcaacatcattttccagtcgttttaagctgataaattcacggtgaataatccataaaatcgctaagattgtcatcggaaaaccgaataaccagctccaagactgcgagataatcgttttattaattaaatcgtttcgataatcaatttcttgccctactgcaatataaacatcattatcttttagccaataaatgcgccaaatatcaatatcttgttcatcatcaatctcatcatctgcttctgtcagctgaatgttctgaaaaccttctaccggtgtgaacgtaaaaaattgtccatcacggccatcattaataatttgctcgcctttatcagtaaaaattgcaaaggccagcgcatcatcatcgacatctgcttgataaaatccacctttattctggacggtatgaaagccttcggcaatatttgatgaagctaaacgttcggcaaagaaaatttgctgcgagtcgaataattcattaatttctttatgtaacacgcgccattcaatcatcgcagaaataagccaaatcagcagtgatatcccagaaagtgcaacgagcaagcggtattttaagctacgattttttaatactttagccatcttcagctcctaaacgataacccacaccatggacggtttttatccagcttttacctagtttcttacgtaaattatggatatagacttcaagcgtgttactgccgacatcgttgtcccagctatataatttttcctcgattgaagaacgtgttaacaccttatccttattgctcacaaaaagttgcaataactgaaattctttggcggttaaaatgaccgctttttccgctagcgtgacgctatgggtattattatcaattcgtaaactgccaatcacaatttcacttgagctttgttgataacggcggcgaaccaatgcttgtaagcgcacaaccacttccattaatgcaaaaggtttacaaagataatcgtctgcacctgaattaaagccaagaatgcgatcatcgagcgtatctcgagcggtcagaattaacaccggtatgtcttgattttctttgcgccagcgtttcaaaatgtctaaaccgtccattttcggtaagctgagatcgagtaccaccgcatcgtattgcgtggagaacagcgcatcaaaaccgagttttccatcttgaaaccaatcaaccacaaaattttgtttggtcaatccaagctttaagccgtctccaatgagtttgtcatcttcaataagcaatatacgcatttcgtatcctttaaataagcaaacaagcggttgaattttgcaaaaaatttgcagaatttaaccgcttgtaaggagtaagagtcgttggttaactttactttgcaattccgcctaatttggacaaaattttaccaactatttaaaactaaacaacacacaatacttcaaaaagtgagtaagcaattattgtgctttctcaaccgtataaacatcaatcgatgaatggaaagtttctttatctaacttaccttgaatacggattttatcgtttggggtcacgtttaaaccgttccatacgtgatcatcaatttcaattttgatatcaccagttgcatctgcaaagatatattcgtcgttatccacttgacgaagaattttaccttctaatgttacacggctgtcatcgtgtgatgatttcgcttgtgcaacagtaacgatactggttgtattagcaccaaatgtttgattttgagaagtcggttgagaacaggctgctaataatgttgctgccgctaatgttgagagaacagtcaattttttcatgtaaaactcctaatataaaagtggaggggcagaaatagtcgttaaataattaagcattattttttaatgctatatacatcaatgctggatttaccccagtcatttttatctactttaccttcaatggtaattttgtctttcggggtgacattttgtccgttccaagcgtgatcttccacttcgatcttaatttcaccgctagcatctttaaaatagaactcatcgtgatcgatttgcttggtgatatagccggttaattttaccggtgcatcgtcccacgcttcgagtgcttgtgcaacggaagtcggaggtgtttttgttccttcaccgctaaaaccgccttgctgtgcggcagggccttcaaaatttgccactgaagttgcagataaagagagaagcgtcgttaaaactaatacttttttcatcgaaaattcctaattaaatttttattgtttatgtttattagattattttaaaacagtgatgttatttacatctaaagtcactcggccgtcatcaaggtcaactttgcctgaaatacgcacacggttatttgcatttactgttttgccttgccatgcaccgtcttcaacatcaatatgtacagaaccggttgaatctttgaaggtacaatcatcgttatcgtagcaattgataatgtttccagtcattgaaaaatgtgcgttatcacctgctttctttgcttgtgctacgttcttgattgctgcagcttgaacgtttgtgtggttagatttaaagccatcgttattcgctgaggtggtgttttcaaatccagccattgccggtgaagagattgcgaaaattgcagttaaagctaaaagttttttcataaatttgctccgagtaaaagtcgttaaataaccaagataaaaatcaaagaaataaaaaattaaaaaataaacagtcgttaaataaaacacaaatgtgaagtgcgtgccttatcgatgtgtgtattaaatcaaacagatcttaacgaaatcttaagaagtaaaaattttttacctttttgctaaaaaatgatggggaaagctgattgaactcggtgagcattaaagaataagaagcccaaatagggcttcttacttgagagattatttcggataaaccggtaagcgggcgcagattgctaagactttttgtttggttgcggcaatcacactttcttcattgtcagtacccattgcatctagcacatcgcacatccagccggctaattcacgcacatccgcttcattaaagcctcggcgagtaaccgatggtgtaccgacacgaatccctgaggtgacaaacggtttttgcggatcatttggcacggcatttttatttaccgtaatattggctttacctaaagctgcatctgccgctttaccggttttaccttgtttaataaagctaactaagaataaatggttttccgtaccgtttgaaacgacatcgtaaccacgttgtttgaacacttctaccattgcttttgcattcttgattacattttgctgatagactttatattctggctctaacgcttctttaaagcaaaccgcttttgccgcaataatatgtactaacgggccgccttggttcgctgggaaaaccgaagattgaagtttcttataaatttcttcatcgccacaagcagaaagaattaagccgccgcgagggccaccgagtgttttatgagttgtagttgttacaacatgagcgtgcggtaatggattcggatataaacctgctgcaattaaacctgcaacgtgagccatatcgacaaataaataagcaccgacttcatcagcaatttcacgcattttcgcccaatctacgatttgtgaataagcagagaaaccggcaacaatcattttcggtttacattcaagcgcttttttgcgcacatcttcataatcaattaagccttcggcggtgataccgtagagtaccgaattataaattttgcctgagaagctcacttttgcaccatgcgttaaatggccaccgtgagctaagtccatacctaaaatgatgtcgttcggttgaattaatgcgccataaacagccgcattcgcttgagaacctgaatgcggctgtacattcacataatccgcaccaaataattgttttgcacgatcaatggctaattgctcaacgatatctgcatattcacaaccgccgtaataacgtttacccggatagccttccgcatatttattagtaaattgcgaaccttgcgcttgcattactcgaggacttgcatagttttccgaagcgattagttcaatatgttcttcctgacggcgattttcgttttcaattgcttgccataaaatagggtcgtaatcttgaatgttcatgtttgctgtaaacatatgaaagtcctctgtgtgctagtaaagaaaattgcgcaaacgtttgcgcaatatgttttacaagcattctacacatttattatgctctatggtagtgcttttttaataaaacaattgcatattaatttgtgtaaataatgaatgcaattcatgttacctgggtaagcggttgaatttagataataatttgcaaataaaaaggcactctgaagagtgccaatatctagattagaataacttgctagaccagccaagcttagaaccaagcaccgtaaaataattataattgttaaggtgtagcaggtgtaaggtatccggacttttggtaacgataatgcgatcttccggtgtaaacggcaaatcatattgtccgtcacaacttacttccaaactaggttgattatattgcgcaaagcgtaaagagatttggctgtctccatcaatcactaacggtcgggaagagagcgtatgcgggtgcatcggtactaatgcgatcgcattcatattcggcgttaaaattgggccgcccgccgataatgaataggctgtcgaacctgtcggtgtactaataattaaaccgtccgaacgttgtgagaatgcaaatttaccgtcaatatatacttcaaattcaataatgcgagccacttggctggggtgaattacaacttcgttcagggcattattggttgcaataattttgccattacgctcaatacgagcttcgagtaagaagcgttcttcaatcacaaactccccacgctcaatacaattatgtaattgttcaaaagcagattgcggtgcaatatccgtcagaaaacctaagttccctcggttaatcccaatcagcggaacacgatattttgctaattgacgagccataccgagcatattgccgtccccaccgataacaatgaccagattggcttgctgaccgatttcttccaaacttttgccatccggaagattgagctgacgagcaatattttcttctaacaacacatcatagcggcgatctttcaaccaattataaacggctaaatgcgtctctaaagcaatatcgtgacgaggtttacctacaatcgcaatacattcaaaaaatcgttctacagatttcatcttttttactcacaaaataagaattgctaaattctatcctttttttcaccgataagatatgtaaaaaatttataaaaaatgaccgcttgttactacacataagaagttgagagcgtaatatctttttatgaagtgcgtacaacaagcggtctattttcagagaaattttgcaaattgagcgagaaatcagaccgcttgttgagattttgtgataaaattcgtccgttttgctcttcatccatggttggggtgatgtaaaacaaattgtaaaaaaagattcaaatcagaccgcttgtcagcggtttttatttttaaactaacaagtcacctctcgtatgggtgaccactgtaacaaggatataaaaatgcctattatcactttaccagacggctcacaacgccaattcgataatcccgtttctgtaatggaagttgcgcaatcaatcggtgcaggtttagcaaaagctacgattgcagggcgtgtaaacggcgaacgccgtgatgcgtgtgacatcatttctgaagatagctcacttgaaattattactgcaaaagatgaagacggtttagagatcattcgtcactcatgtgcgcacttattaggtcatgcgatcaaacaattattcccagatgtaaaaatggcgattggcccgacaatcgacaatggtttctattatgacgtggatttagatcgctcactcacacaagaagatttagatgcgattgaaaagcgtatgctggagctggctaaaaccaactatgatgtggtgaaaaaacgcgtaagctggcaagaagcgcgtgatacgtttgaaaaacgtggcgaaccgtacaaaatggcgattttagatgaaaatatcgaacgtactgcaacgcctgcgttatatcaccacgaagaatatattgatatgtgtcgtggtccgcacgtaccaaatatgcgtttctgccaccacttcaaattacaaaaagttgcaggtgcatactggcgtggcgatagcaaaaacaaaatgttgcaacgtatttacggcacggcttgggcagataaaaaacaattagcggaatacttaacccgtttagaagaagcggcaaaacgtgaccaccgccgtatcggtaaagcgttagatttataccatatgcaagaagaagcaccgggtatggtgttctggcacaatgacggttggacgattttccgtgaacttgaaactttcgtgcgtactaaattaaaagagtacgattaccaagaagtaaaaggtccgtttatgatggacagagtgctttgggagcgtaccggccactggcaaaattatgcggatttaatgttcactacgcaatctgaaaaccgtgaatatgcaatcaaaccgatgaactgcccaggtcacgttcaaatcttcaatcaaggtttaaaatcataccgtgacttaccaatccgtatggcggaattcggttcgtgccaccgtaacgagccgtcaggttcattgcacggcttaatgcgtgtacgtggttttactcaagatgatgcgcatattttctgtactgaagatcaaattgaaagcgaagtaactagctgtatccgtatggtttacgatatctacagcacttttggtttcagcaacattcaagtgaaactttcaactcgtcctgaaaaccgtatcggtgatgatgcgatgtgggatcgtgcggaagatggtttagcaaaagcattaacggcaaatggcttaagctatgaaatccaagaaggcgaaggcgcattctacggtccgaaaattgagtttgcattacgtgactgtttagatcgtgaatggcaatgcggtacgatccaattagacttcgcattaccggggcgtttagatgcgtcttatgtggcggaagataacggtcgccgtacaccggttatgattcaccgtgcgattttaggttctatcgaacgctttatcggtattattaccgaagaatacgctggtttcttcccaacgtggttagcgccgactcaagcagtggtaatgaacattaccgatagccaagctgactacgtacaaaaagtaacgaaagcgttatctgatgcgggtatccgtgcgaaatcagacttacgtaacgaaaaagtcggctttaaagtacgtgaacacaccttacgtcgagtaccttatatgcttgtgtgcggcgataaagaaattgaagcgggcaaagtatcggtacgtacccgtaaaggtgcggatttaggcacattcaccattgaagaatttgttgaaatccttaaaaaccaggtgaaagctcgtgaacttaaattattaggcgaagagtaatttcattatttgtaaaaaagcggtcaaatttgaccgcttttttgcatttgaagcgcacaaataatttcagcaaatcattgcactattttacaaaatcaattaaactcaaaacgtttttgtgcttggttttgctaagcctatatattcatatctctgctactgcagtcgatcgtagttaaattaatagaaggaataatactattaaacctgtaaaacgtgttcagtcgaatcgcgcacatcgtcttaatgatgaaattcgtggcgtgaaggaagttcgcctaactgatgaaaatggcgaacaagttggtatcgtatcaattcaagatgctttggcgagagcggaagatgctgaattagatttagttgaaatcagccctaatgcagaaccgccggtttgtcgtattatgaactacggtaagttcatctacgaaaaagaaaaagctgcaaaagagcaaaagaaaaagcagaaagtcgtacaaattaaggaaattaaattccgtcctggtacagacgatggcgattatcaaattaaattacgtagcattttacgtttcttagaagacggcgataaagttaaaattaccgttcgtttccgtggtcgtgaaatggcacaccaagatatcggtttagacgttttagaacgtgttaaaacagatacggctgaagtggcagtagttgaatcggcaccgggcaaacttgaaggccgccaagcggtaatggttattgcaccgaagaaaaaataatttattcttgcataaaacgggcggatcctataaaatccgtccgttttctctttcgtaaaaaagagaaacaaaagcgatctacaggcacatttcgcagcctgatttgctttttaagctgcaaagcttatgagcggtaacgctctttcgagataattagcgctttccaagtaaaaatatgattagcaataatcgcatttttcgcctaattattgtgtattatgtaaaacaatgcggagtttataaaacaatgcctaaaattaaaacagtacgtggtgctgctaagcgtttcaagaaaacagcttcaggcggtttcaaacgtaaacaatctcacttacgtcatattttgactaagaaaaccactaaacgtaaacgtcacttacgccacaaatcaatggtagcgaaagcagaccaagtattagtagtagcgtgcttaccatacgcataagcgttgagtcaagttaaaacgtactttagtgaattttagttaattatatacattaggagatttaataatggctcgtgtaaaacgtggtgttattgcaagagcacgccataagaaagttcttaaggctgctaaaggttattatggtgcgcgttcacgtgtttatcgcgttgcgttccaagctgtaattaaagctggtcaatatgcttaccgtgaccgtcgtcaacgtaaacgtcaattccgtcaattatggattgcacgtatcaacgctgcagcacgtcaaaacggtttatcttacagcaaattcatcaatggcttgaaaaaagcttctgttgaaatcgaccgtaagattttagctgacatcgctgtattcgacaaagttgcattcgcagctttagttgaaaaagcaaaatctgctctttaattttaaagaatagagattaggacgccttcgggcgtccttttttatatgatgcgaaaattaatcattattcgagggcattccggttcgggcaaatcaacgtttgctaagcaaaaaatagcggagtttgagctgcattttccgaatggcaaaatttttcatattgagaatgaccaatttctatatgaaaacggtgaatatatttggacgaaagaaagatttcggtccgctaaaatgttagctgaacagaaattagcattagcttgggaatttgccaaaagtcatccgcaacttcccgtattcattgtgatcagtaatgtgaatcttagtttacaagcggttgaaaaataccaaaatattgcaaattcattacagatgaagatagaaaagtatcgtttgatgaatttctttaagaatcaacatcatgttgatatttatacggtattaagtatgtatttggcgttagaacagcagccgttagtagatgaagttattgtcagaccaatcaagaaaatgccttattttatgcgtataatattagaaaaaatgcgtaagcgtagggataaaaaagacatacaagcggtctaattttcgcttatttttacaaagaggaaaaataatgaaaaaagtaatgttacttgcgttgcctttcgttgtagcggcttgttcggcaccggagcagcaaagtacggttccgatggatatgcaagtagttgcggaatatcaacaacgtgtcgcaagcgggaataccgtttcggaaaaacaaaagcaacgtgttgctcagcaaattgaaccggatgaaccgcttaatcaaagtgataagcgtccgaaagtagtcagacaggttgtaagagagccggtgatttatccaagcattggcattggttacggttatcacagacatcgtcatcattggtaacaaaaaaagctccgattaaggtcggagctttcactatgctagtttgcgatatctttacggaaagaaaccattaattggtcgattttaaaattctcggtatcaataatttcgaatttatattgatcataaagaacaaaatcggttttctttggaattttacgtaacatatacatcataaaaccaccaatagtttcatagttttccgcattcgggaagctttcgatttctaacgctttcatcacgtcttcgagcggtgtagcaccgtcaattaaccacgaatcttcatctcggcggacaatttgttcctcttcggttgaaaccaattcgcccatcacgatactcattacatcattgagggttagaatccccaccactaatgcgtattcatttacgataaccgcaaaatcttcaccggcagatttaaacagctctaatacttcgtaaagtgacagagtatccgggatgaaaagtgattttttcagtaatttcgcatctgttagcgacacgttatcgttttttaggtactgtgtcagtagatcgtgcgtttcaatataacctaaaattttatccaatccgtcatcgcagatcagtactttggaatagggatcttcacccaatgtttccagcactttttctcggttatcggtgcgatttaaaaacacaatattttcacgggtggtcatcgttgatgttacacggcgttcctgcatttcaaacacgttttcaatgagataatgttcttgtgcttttaaaataccggctttcgctcccgcatcaactactgcaacaatatcttcggaggtcatattgtcttggcgaacagtagaaacgtgaaataacttaaataatgtgttggcaatccaatcgaaaaacagtacaagcggcttaaataatgcaatacaaaacatcataatgccgatggttcgtactgctactttttccgggtatgtcatcgcaatacgtttcggcattaagtctgcaaagagaacaaatgccgaagtgacaatgataaaggcaatccaagatgctgcactatcaacccattccgcttgtgtatatttggcaagccattcgctaaagtaaggattaatcgcactttcaccgaccacaccaccaaggatcgccaccatatttaatccgatttgtaccacggtaataaagcgtcccggctgttcctggagctttaaaactttttcggcacggaggtcgccctcgttaatcattgcctgtaatttcagttttcttgcaccggcaagagagatttctgaagatgagataattgcactggcaataatcagtaataagataatcaaacttgcttcaaataagctcataaaatcctctgtttgataagttatgatgtataaaattatagcattaaatattttttacagattcagcattgcaaatttttgcccaaaattgaccgcttgtcggtggactttggatacaaaaagattcgccttgatattcaaattttagctgataagcatgtaagtaaacccgatccgcttctgtgccggcatagagttgatcacctaaaatcgggctgcctaaacttttcatcgctacccttaattgatgtgttttaccggttttcggttgcaaaataaaatggcgtaaatttggttcaagcgagtatgaaataaattgagtcacggcaggattctgtttgctatggcacaatttccacgcgccgttacggcttttttgcatatcaccgctaattttaccttgtttctttttcggtttttgatcgctcaatgcccaataggttttttcgattttatgttgttcaaataggtgataaaagtgtacggctgcttgtttattcaaggcaaaaatcaataagccggacgtgactttatctaagcgatgtaccagccatacttgttccacttgtaattgtttagcgagtttttcggttaatccgaccgcttcctcgtctttgtgtacactcacgccgaccggtttatcaatcacaacaaagtcgtgatgttggaagcaaatagtcaatttttcagtcattttttgctatactccgataaattttgtctattttaacagggaattgaatatggcactcaacatttatttagtccgtcacgggaaaactgtttggaatttagaagggcgtttgcaaggctccggcgattcacctttggttgaagaaggtattgaaggggcgaaaaaagcggggagagcgttaaaagaggttaaatttgccgctgcttattcgagtatgcaaaaacgtgcgcaagataccgcaaattatattttggcagaaaatagtgagaagaacattccgcactttcaccacttcggtttaaatgagtttgattttgggctttgggaaggtacgaaatcggtagatttatactcaaatgatgaatattggacgatgaaaaaaacaccggcggaatatcgtgcggaaactaatggcggtgaaacttatgaagatctttataaccgagtgattaaagtgtttaatcaaattgctcagttgcaccaagataatgaaaacgtattaattgttgcacacggtatgacattaaccgttctcacagcggtattacgaggcttgcattggtcggaatgtcgtgatgaaactaaacacagttttgtgattaacaccgctattaaccgagcggttgttgagaatggtaaggctgaattagttgagtttaatcgcgtggaacatttggcttagacttgcaaaaaaatcccaaaattagaccgcttatttgcgttgttcaaattagcggtcttactcttttttattgggcttcaaaccagctttctaaaattaagcaggcggaaatcgaatccactttatctttttttaaggctttgtaaccgccccgttcaaaaatttccgctttcgctgatactgttgtgaggcgttcgtcttgtaactcaaccggcaaattaaaacgtccgtttaagcgattcgcaaattttttcgctctttgggtaagcggctgttcgctgccgtccatattgagcggtaagccgaccactaagcgttccggttgccattctttgatcactttttcaatttgatcccagttcggaatcccgtcttgcgctttaaaagagggaagtccctgcgccgtaccggtaatatcctgcccgactgcacagccgatgctgtaagtaccgaaatcaaatgcgagaattgttcttgccatattatccttttgcaaaaaattgtttattttcgaccgctacttaagccatcattaggctctgccggcacgggctaacacacctgaaataccgagcatttcatttgcttctacccaacgttctaaataaccggtttcgaataaggttttgtcgttcgcatcggataccaaccaataattgcgtgcgatttcttgttcgagttgttccggtttccacgtggcacaacctaaacagacaataaatttttccggcgcttctggtttaccaaggctatccagcacatcgcctgatgtagttaacaaaatattatcggtaacacgatagctatgtaaaaattcttgttcggttttggtgtgaataataaagccccgatcttgactgaccggcccgccgcttaagaccatctgatctttatggtaattacgttgattcgccatttgaaaatccatacgggtaatcaattccaaaacggataagtcggtcggtgtattaattactaagcccatcgcgccattactgttatgttcgcagatataaattaccgtgcgatcaaagtagtcatcatcaatttccggcgttgcaatcaaaaatttgccttgtaaattttctaacattaaatatctccaaaacaaacctgtagggcggtaattgccgcaagggaggcggtttccgtacgcaagactcgtttgccgagtaaaacttcggtaaagccttgagtttcagtcatcgcgatttcttcagcggataagccgccttccgaaccgattaataaacgtacgccagcttcaggcacatttggcagctggcgaatggtgtatttcgcacgaggatgcagatttaatttcagcatatcatcttgttctttgcaccagtcggtcagtttcataatcgggcgaatttcaggaatttcattacgtccgcattgttcacaagcggcaatcgcaattttttgccattgctgtagttttttgtcttggcgttcatcgttaagttttaccccacagcgttcagaccaaagcggagtaatggtttttacgcctagctcaaccgatttttgaatggtaaattccatccgatcgccgcgagaaatcacttgccctaaatggatcgctaaattggattcacgattatccaattcgctgctatcaatttttgcaataatttgcttttttccaaccgcttgtaatgtcgcgtggaaaatgtggtttgatccgtcaaataaaataatttgatcgccttccgccatacgtaatacacgaccgacgtgattagttgcatcttcacttaaaatacaactggtttgattcgctaataattcaggatggtaaattcttggaatgcgcataagatattctttcattaacaataatatgcttattgtaatggaaattgcctgttaaataaatttttgcaaaatatttctagaatttcaccgcttgatggcgtaaattgatagagattcattctttcaaaaggaggctaagttatggattttatttatgtcgcagtgggtgttgcgctgattgctattttagtgctttcattggtaattgcattgctatttcgccgagtggtgaaaaccaatgaagtacacattgtacagtcgggcggaaagaccacctcttatggtaaagataccggaaatggtaacgtttattatgcgtttccttcatggttacctgtgattggtgtgagtacgattgtgctgccggtttcggtcttttctatcaaaattgataactacgaagcatatgatttagaacgtttgccttttgtggtggatatcaccgctttcttccgtgtatccgattcaaatcttgccgcacaacgtgtgtcggatttccatgatatgaatattcaattggttgatattatccaaggctcggtgcgttcgattctttcaagccgtaatttaaacgatattttacaagtacgttcggaattgggtgatgattttacccaagcggtcaaagaacaattgaaaaattgggggattgagccggttaagaatattgaactgatggatattcgtgatagcggcaattcaaaagtaattttcaatattatggaaattaaaaaatcatttattgaaaaagagagccgtgtcgaagtcgctcgtaaccaaaaagaagcacaaattgcggaaattgaagcgaaaaaagaagcggatgtaaaacgccaagaggcggaaaaagaagtcggcttaaaaacggtagaaaatcaacgagaagtggcggtgtctaacgaacaagcgcaacagttggtgaaagagcaagaaaaaatcactaaagaacgcgagatggaagtcaaacgtgttgcggaagtaaaacaagcggaaattgccaaagatgttgaaattgtaaaagcggatcaggaaaaacgtacacaagaaattaaggcggaagcgaataaaaatgcgttgattattgattctgaagctgaaaaacaacatcaaattttagtagcggaaggtgaaaaacaaaaagcgtttttagctgctgaagcattgcttgaaacaaaagataaagaagcgcaaggtattgcgaaaatcggttcggcagaagcagaagcgaagcaaaaactggagatttcattagtatccggtcaaattgaattagcgaaagaaatcgggggtaatgaaggttatcaaagctacttgatcagtattcgtcaaattgaagcaaatcaggcgattggtattgaacaagcgaaagcactttcaaattcagatatgaaatttatcattaatgatgaaaaagtggataaaggtattcagcgcgtaggtgagttattcagttcgaccggcggcacgaaaattgctgcaacgttggaaggattaaaccaatcagacttaggtaaggcattaattggtaagtttttaggtactaacggctcggagcctaaaacatcggataaataggttaaacaagcggtcgaattttttctattttttgcaaaaaataatggaaaaacgaccgcttgtttttatttagagttcaaaactgtcaaaatcattcgtatcgactttagcatcgatttgcccaaccaaataggagctgacttcgacttcttgcggtgcaacttgtacgttatcagacaccaaccaagcattaatccacggaatcggatttgaagcggtggcaaaagggcgaggtaatccgaccgcttgcattcgaatattggtaatatattcgacatatttcaccaaaatatcttcatttaaaccaatcattgaaccgtctttaaataaatacgccgcccattctttttcttgttctgccgctgccacaaaaagctcataagcttcttgtttacattcttcggcaatttgtgccatttccggatcatcttgtccggctgccataatgttcaacatattttgtgtgccggttaaatgtaggtattcatcacgtgcgataaatttgatgattttggcattaccttccattaactgacgctcggcaaacgcaaaagaacaagcgaacgacacgtaaaaacgaatcgcctccagtacgttcacactcattaagcataaataaagttggcgttttaagttacgtaaggtcacttggtattgcttgccgtccaccgtataacaaccttctccgtagagtgtataaagttgcgaatctcgaattaaatcatcgtagtagcaagaaatatctttcgcacgtttaataatttcttcgttagttacgatatcgtcaaacacaatcgacggatcattcacgatattacggatgatatgcgtgtaagaacgtgagtggatcgtttcggaaaatgtccaggtttcgatccaagtttccaactccggaatcgatactaacggcaaaaatgccacgttcgggctgcgaccttgaatagaatcaagtaatgtttgatattttaagttactgataaaaatatgtttttcgtgttccggcaatgattggtagtcgatacgatcttgcgagacatcaacttcttccggacgccagaaaaatgagagttgtttttcgattaacttttcaaataattcatatttttgttggtcataacgggcgacattgacattttgcccgaaaaacatcggttcttttaattgattatttttattttgtgagaaagtggtatatgccattttgtatcctttttgaattgcccaagcacggcaagccgtacgtggttatgatcagccttcggctgagtgagccacgctgtggctcttaatattctccgaattatttctgtattctccgtgtattccgtggttagctaaattcatgctagacactaaattttgcaggcgccgccggcacaaccgtcatttaaatcttgttgggcgtcttccgctccgtctctggtattttggtaatagagcgtttttaatccgtatttataagcggttagtaaatcggcaagtaagcgtttcatcggtactttgccgtcttcaaatttttgcgggtcataattggtatttgccgaaatcgcctgatcaatgaatttctgcataataccgaccagctgtaagtaaccgctcatatcggggatatcccataatagttcgtattgtgaacggagcttttcatattccggcacaacttgttttaagataccgtcttttgaggctttgatactcacgtagccacgcggcggctcaataccgttggttgcattagaaatttgcgaggaagtttctgacggcattaatgagcttaatgttgagttacgtaaaccgaattgcttaatttctgcacgcaagctttcccaatcataatgcaacggttctgttgtcaggttatccaattcttttttatagctatcaatcggtaaaatgccttgagcatagctagtctcgtcaaataacttacaagcaccttgttctttggctaaattgagcgaggctttcagcaaataatattgcatcgcttcaaaggttctgtgcgtaagcgcattggcagaaccgtctgaataacgcacgccgtttttcgctaagtaataagcgtagttgatgaccccgatgccaagcgaacggcgagctaatgcggcgtgttttgccgctttcaccggataatcttgataatctaacaaggcatctagcgcgcgtaccactaagtcggcaagcggttcaaattcatctaaattttgcaaagtacctaagttaaatgctgaaagggtacagagtgcgatttctccgttttcatcgttaatatcgttcagtggtttggtcggcaatgcgatttctaaacacaaattggattgtttgatcggtgcaacttgtggattaaacggcgaatgcgtattgcaatgatcgacattttgaatataaatacgaccagttgaggcacgttcctgcataagtagtgaaaataactcaaccgctttcacactgcgtttgcgaatagtcggatcttgttcatattgcagataaagttgttcaaatttgtcttgatcagcaaaaaacgcttcatacaaaccatcgacatcagacgggctgaataaggtgatttcgccacccttaattaagcgttgatacatcagcttgttgagctgtacgccgtagtccatatgacgacagcggttgtcttccacacctcgattgttttttaacaccaataaactttctacttccaagtgccatagcgggtaataaaccgttgcagcgccgccacgtacaccgccttgagagcaagatttcaccgcactttggaaatgcttataaaacggaatgcaaccagtgtggaaagcttctccttgacgaatcgggctgcctaaggcacggattgcaccggtgttaatgccaatgcccgcacgttgcgacacatatttaataatcgcagcggaagtagcattgattgaatccaaactatcgccgcattcaattaatacacaagaactaaactgacgagtcggtgttcttacccccgacataatcggggtaggcaatgaaattttgaaggttgaagtcgcatcgtaaaagcgttttacataatccaaacgtatggctttcggatatttcgaaaacaagcaggcagcaactagcagatataagaattgtgccgactcatagatctcaccggtcactcgattttggactaaatattttccttcgagctgtttgaccgccgcataggaaaaatccatatctcggctgtgtacgaggaactcattcattaactgccattcttgttcagtatagtcggttaacagcgcttgatcgtatttaccgagtgcaaccagctttttaatatgagtgaataaatgaggtggggtgaagtccccgtaagcttttttacgcagatgaaacatcgctaaacgcgcagcaagatattgataatccggcgtttcggtactgattaaatcagcggcagctttgatgattgtctcgtgaatatcagcagtgcgaataccttggtaaaactgaatatgggcgctcagttccacttgtgataccgatacattctgtaagccttcggcagcccaagtaataacacgatgaattttgtccaaatcaaacggctcttgttgcccgctacgtttggttaccatcaatgttttctgcataaaatgtgtctccttttatcttattgtttaaccactatatgttgtggttttgaaattcctatatacaagatattgttttattcaaacggatgcaagcagaaaattttgtaaaaggatattgacaaaagataagtgattgaagatatggcaattcgagaaatgtaaaaaaataaacccctgaaaatcaattcaggggtttgcataaaaaaactaaggttatttaccttttacgtcaataataaagacttcagattgcgaaccaagccgcatcggtatgccccaaaagccgtaaccggaggtgacaaaataatgtcctaaaccaattttttcatagccatagtgcaggcgataaatcacgttagtcattaaatttgccggaaaaatttgtcctttatgcgtatgtccggacacctgtaaatcaatcggtaattgcgaatgttgctcgatttgcgttgggcgatggtcaagtaaaaacaccggtaaatccgaattgactgccgttaataattgagcggcactcggtcggttttttacgaggtcatcgttacgtccgataatggtaaattttccgttaatttcggccgcttgatcccatagtacttggatacctgctttttgaatttcggtggcaatcgcttgttgctttccgaagaaatcgtgattacccaaagtggcataaacccctaaaggcgctttaagcttagcaaaatgcggttgcatattttcagctacataagcatcggtattgtcgtccataatatcgccgggtaataaaatcagatcgacattttgctggttaaagatctccgctaatttatctaattgctttgcaccaaaccattgccctaagtgcagatcacttgctaccccaatacgcagcggttgatcaagcggtttatccaattgtacggaataatgcactactttcggagtgtaagcgttatataaggcgaacccaacaataccgaaaaatgcgaaaggataggtaatttttaaggcaaaattgaccgcttgtttgcctttaaataagcggtaaatcaccgcacaagcaaggctaacgaataatgcaaacagcaatagggcgagcattagcgccgtaattctaaaaccgttaaatgttcgtgtgacggtaagaatcgctaagccatttgctgctaaatagctaataaatgttacgatcttgcgtgatttggtagataagttgaatagccaacctacggtacgagaaaagttaaatacgaggcattgcaaaacaagaatggcaattcccgtagtgatgtaataacgatattccaaaagctttcctttttgtttaaaaataaaaaacgtgggaattgtaacgcagattgatttttcaaacaaaagaaaagccctatcgtgtagatagggctttgatagagcaaatgcatttatgtaaggaggactactgtgtgcgattatctcgcgggtttttgaacagttgcatttgctaatttggtgacttctaaattagaagttaggttttaataaacctggttgacccattgccggatcagtgttgtatgcttccattgcatctgcaacggtcatacctaatgcttttgctacaccttcaccgtaagccggatcacagaagtagcagttacggatatggcgatatttaataaagtctaacgcatcgcccataccagcagctgtattcttgaatagcgcttctttttctgagtcagtcatattgttgaataacacacgtggttggctgaaataatccgcatcgtcttggcggaaatcccagtgtgccgcatcaccgttaattttgagtggcggttctgcaaattgtgcttgttcttgccattgaccgaagctattcggctcataatgtaaagttgaaccgtagttaccgtctacacgaccttgaccgtcacgcgcattgctgtgaactggacaacgaggcgcatttaccgggatttggtggtggtttacacctaaacggtaacgttgtgcatccgcatagttaaataaacgagcttgtaacatacggtccggagatacgctgatacccggtactaagttgctcggtgcaaatgcagattgttcaacatctgcaaagaagtttgctgggttacggtttaattccattacccctacttcgattaatggatagtctgattttggccatactttggttaagtcaaacgggtggtatggtactttttccgcatcagcttccggcatcacttggatataaagcgtccatttcgggaaatcgcctttttcgattgcttcatataaatcacgttggtgtgattcacgatcatttgcgataattgccgccgcttcttcgttggttaagttcttgataccttgttgggtacggaagtggaatttcacccagaaacgttcgttatcagcattaatcatactataagtgtgtgaaccgaaaccgtgcatatggcggtatgaagccgggataccacgttcagacattacgatcgttacttggtggaatgcttccggtaataacgtccagaaatcccagttgtttgtcgcactacgcatattagtacgagggtcacgtttaaccgctttgtttaagtcagggaatttacgaggatcacgcaagaagaataccggtgtattgttaccaactaagtcccagttaccttgttcggtatagaatttaaccgcaaagccacggatatcacgttctgcatctgccgcaccacgttcaccggctacggtggtaaaacgtgcgaataattcagtttctttacccacttcgctaaaaattgctgctttagtgtattgagtaatatcgtgcgttacagtgaatttaccgaatgcgccagaacctttagcgtgcatacggcgctcaggaatcacttcacgtacgaagttagctaatttttcgtttaaccataaatcttgtgcaagtaatggaccgcgaggaccggcagttaaactattttgattatcaacaaccggcgcaccgttgttcatcgttaatgatgtatgatggaatggacatttagacataataattaccttggaatgttaataggtttgatgtatgaatgttattattattgattggttttattttgtaaaactatcgatttgataaaatttaacaatcaaattagattttttaatagaaaataactttgaatctataacttgaaaagttagctacttttccccatttactaaagcatttgaaagcggtgaaattccgcttattttttgtagattaaagaggataagatgagtacaaatcaagaaacgagaggctttcaatcggaagttaagcaattacttcagttaatgatccattcactttattcaaataaagaaattttcttacgtgaattaatttccaatgcgtctgatgcggcggataaactgcgttttaaagcgctttcgaatcctgctctatatgaaggtgacggcgaattacgtgtacgagtgagttttgatgaaactttaggcacactgactatcagcgataacggtatcggtatgaaccgtgagcaagttatcgatcacttaggcacgattgctaaatcaggtaccaaagagtttttaaattcgttaggtacagatcaagcaaaagacagccaattaatcggtcaattcggggttggtttttattcggcatttattgtagcggacaaagtgacagtgaagacccgtgctgcgggcgaaacacaagccgtactttgggaatctgccggtgaaggcgattacaccgtggcggatattgagaaagcaacacgtggtacggacgttattttacatctgcgtgaggatgaaaaagaatttttaagcgaatggcgtttacgtgaaattatcggtaaatattcggatcatatcggtttaccagttgaaatccaaactaccgaatacgatgaagaaggcaaagcaagcggtcaaaaatgggaaaaaattaacaaagcgcaagcactttggactcgttcaaaaaacgaaatttcagacgaagaataccaagagttttataagcatttaagtcacgattataacgactcgcttatttgggcacataataaagtggaaggtaaacaagaatataccagcttactttatgtgccggcaaaagcaccttgggatatgttcaatcgtgagcaaaaacacggcttaaaactttatgtacagcgtgtgtttattatggacgatgcagaagtgtttatgccaaattatctccgttttatgagaggtttactagatacgaatgacttgccgttaaacgtttcacgtgagattttacaagaaaataaagtcaccgcttcattgcgttcggcattaactaaacgagcattacagctattagaaaaattagcgaaggacgatcaagataaataccaaaccttctggaatgaattcggtttagtgctaaaagaaggcgttggtgaagattttgcgaataaacaacaaattgcgtcattattccgctttgcttcaacccaaactgattctagcgaacaaacagtaggtttggcggattatatcggcagaatgaaagaaggccaaaaagcgatttatttcttaaccgctgatagttatgtggctgcgaaaaatagtccgcaccttgaactgttcaataagaaaggcattgaagtgctactattatctgatcgtattgacgaatgggtagtggggcatttaactgaatttgacggcaaaccgttgcaaagtatcacaaaatcggatctggatttaggcgagcttgccgataaggaacaagaagagagccaaaaagcgcaacaagtggaattcggatctttccttgaacgtgcgcaaggctattttggtgaccgagtgaagaaagtggtattaacgcatcgcttaaccgacacaccggcagtggtttcaaccgataatgatgaaatgacgacgcaaatggcaaaactgtttgccgcaatgggacaaaaagctccggaagtgaaatatacatttgagctaaatccggatcatcgtatggttaagaaaatcgcagatcttactgatgaaacagaattcaatgattggattgaattattgtttgaacaagcattgcttgcagagcgcggttcattagaaaacccggcagcatttatcaaacgtatgaataaattgcttggttaattgctagaaatataaaaaaggctatcgaaagatagccttttgtttttagctaaaaattgcaattttttctggaaatttgaccgcttgtcacacttattttaaacgctcaaaacctttttctaaatcggcaatcagatcttcaaccgcttctaaaccaacgtgaatgcgaatcagtgtaccgttgagttttctttcgatcgccgggcggatgcgagtaatttcttccggttggttagctaaaatcagtgattcaaagccaccccaagaataagccatggtaaataattcgaagtgatctaaaaagttagctaattgttcatcgtttaacttttggttaagttcgaatgaaaacagaccgcttgcccctttaaaatctcgtttgaaaaattcatgtcccgggcagcttggtaacgcagggtggaagactgcttttacttccggacgttgtgctagccattgtgctacttgaattgaacgttcttggtgttctttcaagcgaataccgagtgtacgtaaccctcgtgccgtggtataagctgaatccgcatcaaccatttgccccatcaaatatgaacgttcacgaagctgatcccaacaacgcgcattagatacggctgtgccaatcatcacatcagagtgaccgactagatatttagtaccggcttgaatcgaaatatcaataccgaattcaagtgctgggaacaatacaccgcctgcccaagtattatcgatcataattacgatatctggattgacttcacgagccactcgaaccaaagtcggaatatccggtacttccattgttagtgagcttggcgattctaaaaatagaactttagtattcggctgaattaaggcttgaatcccttcgccaatgagtggatcgtaatacgtagtgcttacgccaatattttttaagataacgttacaaaaatcttgggttggttcataagccgcaccggtcattaacacgtgatcgccttgagaaacaaacgctaagattgagttagtcacggctgccgcgccacacggataaaggtaacagcctgttccaccttctaattcacacattgcatcttggagagcgaaatgggtaagcgtgcctcgtctgccgtaaaataattcgcctttatagcgattgcgagtagcattctttttttgtgccactgagtcaaacactaaagaagaggcacgttgaacgacaggattcacagaaccttgagtataacgagatttacgtccgacatggacaaatttggtttccagttgagagaaatttgacattgtgtttccttattgtagttataaaaaagcggtctgatttctgcaaaattttgcaaaaattcgaccgcttgtaaggttatctgaatacgctacgatattgtggtttggcacgtttgaattggctgataagtacgataacaaaagcaagtgcgaacattgcgaaggcaacgataagccattccggcatgcctaagccaagcatttcccattgtttctcactacaatttaccgggccaggtgcaaaaatgcttgggaaccattgatcaaacggcattgtctgtgggaattccggtttaaactcacattgattccaaggagaaggatttgcttgataatcatggtgtttgactgctaatgcaagccctttaaaggcactgaagccccaaatgaataaagcaagccagcgagtaagaaaaaagcgaggggagatagaagcaagtaaaccggcaatgataagtcctaaaatcgcaagacgttcatagacacacatgacacaaggaactaatcccattccgtattggaaataaatacccgttgcttcgagagcaaatgcaataaaagcaagtaatagccatgctgtgcgatttaatgatagttgtttgaaatagctgagcataagagttcctttagtttgaattatatatgcattgtacctgattttactcagctttcgtaaaaaaatctccctaaaagtagggagattttttagcgtttagcgactgataatccagccccaatctgtcatgatttctgtaaacggaggaagtaaatattccaatgtgaagaaaccgacagtcgacaatacgatagtataaggtaatgccatatacaacattctgccgtatgagagtcggattaacggcgcaaacggtgaagtgagcaagaataagaatgctgcttgtccgttcggtgtcgcaacagaaggtaagttcgtaccggtattgattgccaccgcaattaagtcgaattgttcacgaccaataatgcctgaggttagcgcattttttgcttcgttaatataaaccgttcctacgaatacattgtcggataccatagaaagtaaaccgttaaatacatagaacaaggctaattgagaatgtgcatccgcagagagtacgaattggataatcggttcaaataatttaagatccacaattaccgcaaccacagtaaagaatactacgattaacgcagtaaacggcattggttcttggaatgaacgaccgattacgtgttcatctgtgatgccacagaatgccgtacaaatgatgataatcgttaaaccaatgataccaacatcagcaagatggaatgcaagcccgataattaaccaaataccggtaagcgcttgaatccccatttttacacggtcttgctgtgtcatacgctgttcttttaataaattataacgtgcgaggacaccccatacacgacgtggtaaacgctcaccgtaaccgaataatttaaagtgttctaatgataaacacgtgatgacaccgaaaagtaagacaggtaagcttaccggtgcaacacgtaagaagaattcaacaaagccccattcggcttgacctgcaatgattaagttttgtggctcacctaccattgtcattacgccacctaatgcactacctacagccgcatgcatcaacagactacgcaaaaatgctcggaattgttcgagaatttgtttattggtaacgattttttcgtcattagtaatatctgtagaatcctcaaagctattacctgaagccactttatggtaaacgccataaaagccagtaccaacactaatgataaccgcaataactgttagtgcatctaagaatgccgataaaaatgtggcactgagacagaaagcaagagaaagaacttttttagaatgaatagcaataagtaatttagtaaaaacatataataacaattgcttcataaaataaatgccggcaaccataaacattaacaataaaataacgtcaaagtttgccattatttcttcttttacatggtgaggactggtcatgccgataataactgcctcaatcgctaataaacctccgggctgaagcgggtaacattttagcgccattgacaaagtaaaaataaactcggcaactaatacccatccggcaacaaaagggctaataaagaaaaagacaagaggattaataactaaaaaagccaaaatagctaatttataccattccggcgctttacctaaaaagcttttaaatatagcgttcgagctattcatttaaagttctccttgtaaataaaaaatataagctaattgtaatctagtttagattaaaggataatagcacttatcccatatttctgtgggtgttttttgattttggataagaatcgtttctttatttttatttttgcgccattttcgcaaattatgttatggaggcataaacatgatggacagatcttatattttaaaagctcagagtccagctgctcttgcagaagaatatatcgttagaagtatttgggataataaattccctgcaggaacagatttaccggcggagcgagagcttgcagaccgtatcggggtaactcgtacaacgttacgagaagtgttacaacgattagcccgtgacggttggttacacattcaacatggtaaaccgactcgtgtgaatgatgtttgggaaacagcaggtccaaatattatcagtacgattattaaattagacaaatcgtatttacccgtcattattgctaacgtggtttcattacgtacccgtatggcagagtcttatatccccgaagccgtcaaattaaatccagaagaatgtgttcagtattttgcacaattagattccttacaagattcggctgaagcatttgccaaatttgactatacattatttagacagtttactttttcggcaaataaacctgtgtacgccttgattttaaacagttttaaaggaatgtaccatcaagttgcgagcattttctttgcagatccggtttgtcgtcaacttactcttgctttttaccgagaattattaaaagcctgtgtagagaaagatgcggagaaagcagctaatgcaatggctcaaaatcgtcaatcaagtagcgaaatttggggcaaacttttacaaagtatcccagaaaattttggtgaactaaaataggatatgttttgaacgaaattctcttaactttagaacctcaaaacaatgcacgcctgcaatcgctttgtggcgcgtttgatgaacatttaactttaattgagaaaagttttaatgtcactattgctcgtagcggtttctctttttcgattcaagccgatgacgagaaccattattcggtgacattaatccaaaatgcggcaaagctcttaaaacagctttacattgataccgcaccaattaaaggtaaaatcaaagaattggatttggaagatattcatttagctattcaagaaagccgaatgttacttcaaaatcaatggaatgttgggggacaaggagagatttcaatcaaaacgaagcgaggtgtgattaagccgagaggtgaacatcagcaagcttatttaagaaatattcttagtcacgatattagtttcggtattggaccagctggcacaggaaaaacatttcttgccgttgctgccgcagtagaatcgcttgaacgtcaagagattcgccgaattttattaactcgtccggcagttgaggcaggtgaaaaactcggttttttacccggcgatcttgggcaaaaaattgagccgtatttaaggcctttatacgatgctttatttgaaatgttaggttttgaaaaagcacaaaaattaatggaacgtaatgtgattgagattgcgcctcttgcttatatgcgtgggcgtaccttaaacgatgcgtttattattttagatgaaagccaaaatactacgacggagcagatgaaaatgttcttaactcgtattggttttaattcaaaagcggtaattacaggggatgttacgcaagtagatttacctcgtagccaaaagtcaggtttaaaacacgcaatggaagtgttgaaagatgtgcctgatttaagttttaattattttgatagccatgatattgtccgtcatccggtggtggcaaagattgtacaggcttatgatgtttgggaagcagaggatgaacagcgccgtgagcaacgtcgtttggaaaaacttgctctagaacagcaaaaaattttagaacaagcagaacagttataagagataagcggttattttggtaaaaaaatttgcaaatttgaccgcttatttattaatagaaaaaaggcgagaagattattctcgccttttgtgtttttaagtgaaattataaaatttctttcgctttcgctacaacattctcaaccgtgaagccgaatagtttgaataactgatcagccggtgcagattcaccgaagctattcatacctacgatacgaccttcaaagccaacgtatttataccagaagtcagataattgtgcttcgatagctacacgttttgttactgaacgtggtaacacagattcacgatatgcttcatcttgtttatcaaacacatttgtgcttggcattgaaaccacacgtacttttgtaccttctgctgctaatacatcagccgctttcattgctaaatcaacttcagaacctgttgcgataagaattaaatctgggcaaccgcctttttcacagcattcacgtaagatataaccaccacgtgctacatttgctaattgttcagcagtacgttcttgttgagcaaggttttgacgagtgaaaattaatgcacttgggccgtctttacgttcaaccgctgctttccacgctaccgctgattctacttggtcagccggacgccatgtttctaagtttggaatgaaacgtagtgatgcggtttgttctaccggttggtgagttggaccgtcttcgcctaagccgatagaatcgtgtgtatacacgaataatgaacgttgtttcattaatgccgccatacgtaccgcattgtgcgcatattcatagaacattaagaaggttgcgccgtaaggaataaaaccaccgtgtaatgcaataccgttcataattgcagacataccgaattcacgtacaccatagttaatgtagttaccgtcaacattgtgatccgcacggattggttttgaaccagaccataaagttaagttagaacttgctaagtctgcagaaccacctaagaattcaggtaagatatgcgcataagcttcaattgcattttgtgatgctttacggcttgcaatcgctgcagggttagcttgtaatttttcgataaatgctttgctttctgcttcccagtttgccggtaaatcgccagccatacgacgtttaaattctgccgctaattcagggtgtgccgcttcataagccgcaaatttcgcattccattctttttctactaccgcaccttgtgctttagcatcccagtctgcatagatttctgccggaatttcaaatggagcatattcccaattaagcgcttggcgagttaatgcgatttcatcgttacctaatggtgcaccgtggcagtcgtgtgatgccgatttgtttggagaaccgtaaccgatgatcgttttacagatgattaatgttgggcgatctgtttccgcttttgcattttcaatcgcaaatttgatttgttccgcatcatgaccgtctacattacggataacttgccagccataagcttcaaaacgttgtgccgtatcatcagagaaccaaccgtctacgtgaccatcgattgagatattattgtcatcatagaaagcgattaacttacctaagcctaaagtacccgctagcgaacaagcttcatgtgaaataccttccattaaacagccatcacctaagaatgcataagtgtagtggtcaacaatttggtggccttcacggttaaattgtgcagctaatgttttttctgcaatcgccatacctacagcattggtgataccttgacctaatggaccagtagtggtttcaacgcccggagcataaccatattctgggtgaccaggggttttagaatgtaattgacggaattgttttaaatcttcaattgaaagatcatagcctgttaagtgtaataagctataaattaacattgaaccatggccgtttgaaagtacgaaacggtcgcgatcagcccatttaggattggttggattgtgctttaaaaagtcgcgccataatacctcagcgatatctgccatacccattggggcacccgggtgaccagagttagctttttgtactgcatccatacttaagaagcgaattgcattcgctaatactttacgttctgccatgtgtttactcctagacaagaaagtgacaaaaactctataaatagatagatttagttaatgagattaattctacactatttttgaagtaatactcaaaaaatctctagagaaatctgtgatcttcttcacaaaatatgagaaaaagttgattgaaaatgatttgttttgattaagttacataatggggatattttgtggaaaattatgttaattggtaaggctgagtattgatcttaatgactaaataccatagaatacgcactctttttggcgtcgagtaaatactcggcatattatttattcacatatggtacttatcagcggatatacgaatgtataacaagataagtggcgatatggcttcattagaggttttccaatgaaacaaggtattcacccagaatatacagaaattactgcaacatgttcatgcggtaacgtaatcaaaactcgctcaacagtgggtaaaaacttaaatcttgatgtgtgcggcaactgccacccattctatacaggtaaacaacgtgttgttgatactggtggtcgtgttgaacgtttcaacaaacgtttctcaatcccaagcacaaaataatttccgaattattgacaaaaccccgcgtttgcggggttttgttttttaagcactctgaattcaagcggtttgatttttaagtttttttgcaagttgctgatttaaccatttacttgcgtcttgcaaattaaatcccttagtttcattattatcattcgttacttttgttgcaataaccataaaagaatcaatttgtggttttggtctcggatgccagcgagctaagttcgctaagtgattggcatagaatgataataatggcttaccataagcgcaagccatatgaacaccaccgccatctacggcaaccactatatctgaagcattgactaatgcgcagtaatttaaggtatttgtttgcggggagatttccactggtacttttgtggtgttatttagtacttgaagatattgttcacttgatttggtataagtgagtaaaaaagcaatcttatctaaatattgaggatcaatattatttaatagacttgctaattcaatagctggaacctctcgcatacttccttgtggatttaataacactctaattttgtctgtgttatgccaataggtatcagcaagttctctgtattcggatgataccgctaaagtataatcattaggctctctgatgagatatggagctagtacagaatgatgtaagtaatctgcaatatgtgtattattcggaattagcgtagtaaagtcatagttttttacggtttctaatgaataatgcttttttttatctttaccgaaattaataagaattttagggttgagtaacgaatctaaaataattgatttagaggtaaaggtaggctgaaaatcgaggtataaatcccatttgcctcgttgtattaaataattcagtgggcgttcatcaattaattgatcaacagaatcagcttgtgcaaagagttgcttattacgctccgtaaccaatacggctgtttttacgttaggaaaggcttgcttgatttgcgctaaatgggcaatgtgtacaatagcatcaccaatggcatctccgattggtttcagtagtacactttcaatctcgtttaatttcgtttcattcgatgcaactcgtttgccaaatagcgatatgatcaatttcttcattcgtcaatttctcctttatatgacgaatataacatatttcaaagcttgaataattagcttttttccgtaaaatccatgcgcacattaatggatgtataagagaactctatgatagatgataaaatgcctattccgcctatttttgttattagcttagctaattctgttaggcgtaaaataatttctgctcgacttaacagtttaggattagcgtttgagtttattgatgcagtaaatgggcgagatttaacagaagaacaactttctcaagttgattatgatttttaccctcagcgttttggagggaaacatagactgaagctgggtgaaattggttgtgcgatgagtcatattagggcttatcagcaccttgtggataataatattaaagaagcaatcattttagaagatgatgcgatagtttctcactatttcagacgtattgttgcagatgcattacgtaaagttccaagtagaaaacaaattatattctttgaccatggtaaggctaaatattggccgataacacgttctcttaaagaaggttatagattggttcgttatcgttcgccttctaaaaattctaaacgcacaattatgattactaccggctattatcttactttaggtggtgcgaaattattattaaaacatgcatacccagtaagaatgccgtccgattccttaaccggtgcactccaaatgacagggattaaagcctatggtgttgagcctccttgtatttttattagtcccggttcagaaatcgatgaaatagaaaaacgtggttaaaatgagtaagctaacattaaaacaaaagcttcgaagaatcaggctcaaattaggtaaattgttgctagataaaaaagtagcatcgaatactttagaagcgattcccaaaaaaatcttattccttcgccaagatgggaaaattggggattacatcgtcagttcatttgtatttcgggagataaaaaaacaatcgccggcaacgcatatcggggtggtttgctctcgtaataatgcttatttatttgagcatagtccttatattgaccaattgtattttgtacgtactaaaaatattggcgattatttagcctgcggtaagcaactggcaaaagaacaatatgatgttgttattgatcctactgtcacattacgtaatcgggatctactttttttacgcacgatcaatgccaaaatgtatatcggatatgataaatcagactataagctttttacgttaaacgtacagaatgaacagcaacattttgctgagatctataaacaggcactggaacttgccggttttaccaatattgatatccagtatgatataccgagagatgaaaagagtgtgaaagctgtacaagattatttatcagaaaatcagcttgagcattttattacgctgaatttgtttggtgcaggatcagctcgccgttttagtgatgagaaaatgatggaattagtgacttacctgtgcaaggttagcacaaagcccatccttttactcacatttcctgaagtgacacctaaattgaagcagattgccgctcagcttgagaatgtctttgtttatgaaaacacgcaaactgtgttcgatacgattgaactgatttatcattcggacatattgatttcgccggatacttcaacagtacatattgcctcgggtttatctaagaaaattattggcttttatagttcggatgaacagaattttattcattggcatccgaataataaggcagagacttatgttttacactttaagcaaagtgtgaatgatcttgattttaatcagattaaaccggaatggttaaattagatggaattccaatcccttaaattgtttttagatattgcgcaaacccgaagttttattcgttcggctgaaaataattatatgagtgcgtctacactgacgcgccatattcagcggattgaagaagagttagggcagccgttatttattcgggataaccgacaagttcgcttaacggaagcgggtgaaaagttcttagtatttgcgaaacaaagttggtctgattggcagcaattacagcatcagctttcaccgatacaaggtcagttagaaggcgaattaaaagtgttctgttcggtaacggcggcttatagccatttaccgcaaattttggagcattttcgtcaggcacatccgaaggtagagattaagctgagtactggcgacccggctcaagcggtgcatacggtgcattctttcgaagcggatatttccttaaccggcaaaccggagcatttgccgaacagcattgtgtttcattatattgatgatattcatctttcagttattgcgccacgggtggcgtgtgcagcaacacaatgtttacagcaacaaccgatagactggcaaaatattccgtttattttgccggttgacgggccggttcgaaagcgaattgatcgttggttcaaagaattaaaaattaaagaaccgaagatttatgccacagtggcgggacacgaggcgattgtaccgatggttgcgttaggttgtggtgtggcattgttaccggatgtggttattaaacacagcccgatgaataatcaaatttcttatttgaaattgcctaaaccaatatcgccgtttgagctaggaatttgtgtacaagagaaaaggttacaagaaccgattattaaagcattttgggaattgttaccgaaagactaaaaacaacaagcggttaaattttaagaattttttgcaaatttcttcctaaatttaaccgcttgttttttatttaaataccgcccaaaccggtgcgtgatcagatggtttttccattgcacggatttctagatcaatccctgtttcaacgcaatgttccgctaagccttttgaagcaagcactaagtcgatgcgtaaaccgcgattgtcatcaaatcctttcgaacggtaatcaaaccacgagaatttgtcatccgcgcttggattcattgctcggaaggtatcaactaaaccatagttatataaacgatttaaccattcacgttcttccggtaggaatgaacattttccgtcacgtaaccaacgtttgcgattcggctcaccgataccgatatctaaatcggtcgggctaatattcatatcacccataatcacaatcggattctctggagtcagttcagtttctaaataatgctgtaaatcggcgtagaatttttcttttgccgggaatttggtttcgtgcgcacgattttcaccctgtgggaaatagccgtttaacacggtaagcacaccaaattccgtttcaatatccgccataatcatacgcttttgtgcatcagcctcatcagttgggaaacctttacgtacggcaagtggttcttttttggttaaaagcgccacaccgtagtgtcctttttgcccgtgatgaaacacatgatagcctaaatgattgactaaatcccaagggaaatcttcatcagccactttgatttcttgtaaaccaataacatccggctgatgcttttcaatcagcgcttctagctggtgtgggcgggcacgtaacccattaatattaaacgaaataaacttcataaataaaatccaaatagaaaccacggataaggcaaacaagcggtcattttttcgcgaaaatttgcattacccgtggcgtaagtaaaaattagagcgtcattgcagcaatccaaccgaacactagtaacggaatattaaagtgtaagaaggttggcacaacagaatcccagatatgatcatgtttcccatcagcatttaaacctgatgttgggcctaatgttgaatcagatgctggcgaacctgcatcacctaaagcggccgctacacctacgatagccatagtcgctaacggagaaaaaccgaatgatacacataatggcacgtaaatagaggtaataatcggcacagttgagaatgatgagccgatacccatcgtaataaataaaccgacaattaacatcaataacgcagccatttctttactttgaatcgaaccacgtaatgcttcaactaattcaggtactccaccggttgcgtttactacacttgcgaagccggatgcggcgatcatcacgaaaccaatcatcgccattaaacgtaaaccgtcttggaataaatcattggtttgttttagtttaaatacaccgcctaatgcaaaaataattaagccgactaaaccgcccatgacagttgagttagtagctaattgcaccgaacaagttgcgataattgcaacaatacttacaccgatatggaatggttttacttttgctacgcgggcagcaacttcatcagcggtcggttcttttacattttctacataagtacgaggcttacggtaagaaacaaaaaaggcaaatagtaagcctaaaatcatacctgatacaggaattgccattgctttagtcatttctgatgtggtggcaactaaattgaatgtttgaccggcctggttgatatttttaacgagaatactttcaataaaaatttgtccgaaacctgctggaattagcatataggttgcagttaaaccaaaagttaatgcgcacgctactgcacgacggtcaatttttaattgattcattacgcttaataatggcggtactaaaattggaataaaggcaatatgaatcggaattaagttttgtgatgacattgcaaatgcagttaacacaaataacacgatgtatttaaaccaaaatatcgagcgaccggacggttgtttgccaaaagcagaaatcactttataagcgagtaaatcggttacgccggatttagaaagcgctacagcgaaagcaccaagaaccgcataattcattgctgtttctgcaccaccgcctaaaccaccggtaaatttttcgatagtcttggtgagtgcttcgaagaggctcataccagcaacaccatagaaaccgataacgccacaggtaagggcagcaataattagcgcaattactacgttaattctgagtaaactcaaagcaagtaatacgataattgagataacaacttcgttagagaacattgtgttttaccttttttgtaataaattggaaatagtcttttaatgtaacgtaaaaaatagacttgtcgagtatttttttacagaatgaataaaattgatttttccttataagcactcacggtcgccttgataaacaaaacgactaattcgtctattttaatagagaaaatcgattaaaaaacaccagtttttggggcggtggaatggatgattggctaaaaaatggtcgattgaattaattctataaatagggtaaataaagaacagaaaatttctgaaaaagacatattagcgtagctaaaggagagcaaacgattaccaaaaatatcttggattttattgtgtgaaaactagtagaatagtagcggtttaaggggctaatttttcattttatacatacagaaactggggtatactccgtttccctctctaaaaaatgtaggggaatttgcctttgcaaattcaataataacggaggaaaaatgagtggtatgttgaatcttggtgcgcttaacgcatctcagctcgaaatagtgaatacgtcagcacatatcgttggttttattggtatggcgtgtgtcgtattggcattttggtttgtagtaagtgaacgctggaagccaacttcattgtcgtataatattttaaacggcattggcgcagtgttacttattctgagcttgtgtgtgcattttaatttaggttcgtttgtgattgaaattttctggatttcaatctctgcaatgggtatttataaaaacctaacgagacgtaaattagttgccgcttaaaaacgaaaagagcaaacgtaaaagtttgctctttgttttttattgaacttctttaaattgaatcatcccattttcgctatagtcagcttgttcgtcttcatcctgaattaacggttgatttggaatttccgctttatcaaaagcaatatcgccttccacaccttctaatatttgaccacgttttaaccctttaaaatcaaacaggctcggatcacaaagatgagagagtgtgatgttctgcattgcactaaacatcgtttcaattcgtcctgggtattgacgatcccaagtttggagcatttcttttacaacttggcgttgtaaattcggctgagagccacataggttacacggaataatcgggaactgtttggcttgcgaatatttttcgatatctttttctttgcagtacgctaacggacgaatcacgatttgtttaccatcgtccgaaataagttttggtggcatagattttaatttaccgccgtaaaacatatttaagaataaggtttccagcatatcgtcacggtggtgaccaagcgcaattttcgttgcaccgagttcggttgctgtgcgatataaaataccgcgacgtaaacgtgagcaaagcgaacaagtcgttttaccttccggaattttctcttttacgatgccgtatgtattttcttcgacaattttgtattcaacaccgatagattctagatattcaggcaaaatgtgttctggaaagccaggttgcttttgatctaaatttaccgccacaatatcgaagtgaatcggtgcgcttagtttgaggttgagcagaatatccagtaatgtatagctgtctttgccgccggataggcaaaccatcactttatcgccgtcttcaatcatattaaaatcggcaattgcattaccgacattgcggcgtaaacgtttttgtaatttattgaaattataggcaatctttttttcttgttgagtattcgttgattgagtatcttgattcataattgtgaatttttaagtaaatgttcggttcggtatatgagataaaaaaatgaagtccgcaatactaaagccttcagtattttttgcaagcatttcatttgatgtttttgtcgatagataaatctctatcagcaaacaggcggtctaattttagcatttttttgcaattttaaagcttatcaaaatattcattgccccaagtttgttcggcaagttgcaataagttggcaaaatcttgataagagggcatcgcttggtcttcgacttttttattttcattaatcagtttttgttttaattcttgataccagcctaatagtgaaagtggtaatggagaagccgcacgtttccctaaccaatataagccttgatacggcaagcttaatgcaaataatgaagtgataattgcattagcgagaatagattggctcggatcagcaaaaaagtattgccataaaatagcaaaacaagcaaaagcaggcataaagcgagcggctaatttcactaatcggattaaccgataatccggcataaacaaccctagctttttttgattcggataagtgttaaggtaacgttgacccgcttgaaatgttgcattcataatgataactgtgtacaaaaaaatgatagaaacagcatagcataagttttatccatcgaaaacgcacagattttaatgcagtaacggcgaactgttgctatactttgcaacaatttttttacacctgttagaaggaacgataaatgccaattaaatttcctgacttattacaagatagttggaattttatccgtaatcaacgtatgttttctctttatgcaatgctcttgttttgtattttacagctggcaagtttatttcttatgcctcgaacgggaaatgctcaagctcaaagtacaacgatgactttggctgatttatttccattattatttatgggcgtagccaatatttttattacaacattgttaattttaaatattaaagcgattaacaatgctaatttcagtcatttttttcagaatctatcaactacacttaccaagttattcccagtaattttgttgaatattattatggttctgcctctctcagttggtatggcttttcaagtatttggtgcacaaactggaaatggtttagtcttgttggcttttccgttaattattagtggcgcatttttatttattaaattgtgtttatcggtttatgcttatttagtagaagagctaccaagtgtaggagatacaatccgttttacgtggcaactaagccgaggtaagggcattgcgttagtactgttctgtgtgattgcttattttgtccctcaaatcttaatgtcatttgtgagtcgtttaggggataatgtgactgaacttgtgctaactgtgtttatcagttcatttttttccttattcatcactgtatttagcttccgtttttatcaagcgtatcgtcaatagaagggtaaggtaatatgaaacaattacttgaatttatcccgctaattttgttttttgcggtttataaattatatggtgtgcagcaagctgcaataacattggtgatcgcaacggtcgttcaattgattgcattacaagtgctttataagaaaatagaaaaatcacagtggattatgggaatttcggtggttttcttcgggattttgaccgcttatttcaatgacttaaatttcttgaaatggaaagtcaccatcattaatggtctgtttgccgctgtattattagtcagccaatttgtgtttaaaaagccgattattcagatgctattgggcaaagaactcactttaccggcgcaagtttggaataatctcaatttaggctgggcagtgtttttcattatttgtatgctgctgaatatcgtgatcagtcattatttttctgatgatgcatgggcaacatttaaaacgttcggatttacggggttgagtttagctgctgcaattgcaaccggcgcttatctttatcctcaccttaaaaacttggagagtaccaatgagcaaaaataaaccttatgacagagagccggaaggaaaactgattttaagaaccttagcgatgccttccgatacgaatgcaaacggtgatattttcggtggctggattatgtcacaaatggacttaggcggggcgattcttgctaaagagttggctaaaggcagagtagttacggtaacggtagataaaatgatttttcaccttccgatttcggttggtgatgttgtgtgttgctacggtactctcgttaaagtaggccgttcttcaatgcaagtgaaagtggaagtgtttattaagcaggtttatgaaggtgcccgagaacgtttccgagtaacagaagctttatttacttatgttgcagtagataaagaaggtaaatctcgtgcgattccacgagaaaataacccggaattagatgaagccttggcaattcttgaacagcgcttgattaatgaaacaaactaaaaaataataaccggaggaagttatatgtattacgtaatctttgcacaagataacccaaacacattagaaaagcgtatggaagttcgtcctgctcacttagctcgtttagaaaaattacaagttgaaggacgtttattaacggcaggcccaaatccaaccgaagacggcactggcgtaacaggttcgacagtgattgctgaatttgcgtcattagcggatgcgcaagtatgggcttctgaagatccttatgtagaagccggcgtttacggtgatgtaatcatcaaaccatttaaaaaagtgttttaatctcattttctcaataggcacaagcgatttcgtttgtgcctttttctcgtccaatttttgaaagaggcatatatgtttgctcaaaccgatctttccgaactcgtggcggaatcttatttgcaaaattctgacaaaatccgaccgcttgctattgccattggaatgtcgaattttgtgaagcagacgctacaaaagcaaccgcaattcttgcaaacgtggttagtggaatatccttctgttgcaaatgctggcaattatgcagagcgcttagctaccattttagggcaggtaaaagatgaatcccagttatcgcaggaactacgtttatttcgtcaccgtgaaatggcgacgctcagttttctgcaatcgaataaacttgccagcgtagagtttgtgttcgagcatttatccgatttggcggagacgctaattatcggcgcaagagattggttgtttcagcgttgctgtgaagaatatggtacgccgatgaactcgctgggcgaacagcaagaattgctgattttagggatgggaaaattaggtggacgagaactgaatttttcctcagatattgatttgatttttacttatccggatgcaggcgaaactgtcggcgggcgtaaaccgattgagaatagtaaattctttattcgtttgggacagcgtttaattaaagcgttagatgaaatcacgttagacggctttgtgtatcgtaccgatatgcgtttgcgtccgttcggcgacagcggagcgttagtgctaagttttgccgcaatggaagattactatcaggaacaagggcgagattgggaacgctatgcgatgatcaaagccaaaattttgggcgaagatccacagaatattaaccatcgttatttgcgccaaatgttacgtccgtttatgtatcgccgttatttggatttcagtgcgattcaatcgttgcgagagatgaagccaaaaatcagccgagaagtagttcgccgtaatttaaccgataatattaaattaggagcgggtgggattcgagaaattgaatttattgtgcaaactttccaaatggtacgtggcggcagagataaaattcttcaagaacggagtttattgcgtgtgttgcctcgcctcgccgaattacaattactcaccgaacagcaaactcagcaattatatgatgcttatatcttccatcgccaggtcgaaaacgtgctgcaagcgattgatgataagcaaacgcaaacgctgccgaccgatgagcaagatcgagcaagagttatgtttgcttgccaatcttttttgcaaaaaaatgcggaaaatcaaccgcttgttgtggagcataacattcatacttggcaagactttttacaggtactggaacaacatcagcaaaatgtgcgagcggtatttaatcaaattattggtgaagaagaggatgatgaagagtcaccgcttaatgaaaaattagcggtttggcaggatattttacattatcaaatcagcgaagaagatttagcggcagttttggtagattatccggttagtgaaagtgattacaacgatatttttagacagctttccagcacctttcaagattgggtgaaacgcccgattggtgtacgaggtcggaatgtactgcgcaagttaatgcctaaaattttagatatggtgtgcaacagagaagattatttagtggtattgcctcgtctgcttaatatcgtagataaaattaccttgcgaaccacttatttggaacttttgcaagaaagagaacaaatcctaccgcttctgattaccttgtgcagtcaatcgattatgattgccgagcaaatcgctcgttatccgatgttattggacgagctcattattcaaaacagtcttacgcaagtgttggcattagagcagtataaaacggcgttaaatgattatttaattcggattccggaagaagatgaagaggcattgattgatgccctacgtcaatttaaacagagccaaattttgcatattgcggcagcggatattttaggcgtattaccggtgatgaaaatcagcgatcaccttacttatttagcggaggcgattatcggtgcggtagtgaatatggcgtggaaatccttatcgcagcgttttggtgtgccggatcatttaaccgatacggaacaaggctttgccgtgattgcttatggtaaattaggcggcattgagcttggctataattcggatttagatttagtctttttgcataacgcaccgcaagatagcgaaacgaccggcgcaagaaagtcgatttccagtcaccagttttacttaaaattagcgcaaaaaattaattcgatttttaacttaaataccagtgccggcgtgctttatgaagtggatatgcgtttgcggccatcaggcgaagcaggtttattagtcagcacggtgagcgcctatgagacttatcaacaaaacgaggcgtggacatgggaatcacaagcgttagtacgtactcgttgtgtttatggttcgcaagaactgtcgcaagcctttgaacagattcgccgaacaaccttggcaatgcctcgaacaagcggtcaattacgccaagaaatttgcgaaatgcgttataaaatgtatcaacatttaagccatagcgataacgcccattttgatctgaaaaaagataaaggcggtattaccgacattgaatttatcgcacagtgtttagtgttggaatatgctcatcaatatccgcaaatggcggtttggtcggataatgttcgtatttttgattcagcggtggaatgcggtattttgtctttcgctgacggtgaaaggctgaaacattgctatacggcgattcgcaaccgtattcaccatttgaatttattgcgtagcccgagtgtggtgagcccagacgagtttgtcgaagagcgtgcttttatagcgcaaatttggcagcgaatttttgggtaaggtcagatagcggttaaatttgcaaaaaatttgtaaatttaaccgcttgttttccgctataataaggcaaatttacccattcaaggagtttgcaatggaatatcaattcacacattcaattcacggcgtagtcgcaaaatgttcaatggatcacgaagcatttgctcgttggttaaatacagagattgcggagaatccccaagagataaacaaagttttagcggaaatcgacaagtgtcgtgcaacttatccgaatccttatgaatatgttttggaaggtcgagaatatagtttatttattgatgcggatgaagtgatggtgaaagcaaataatctggatgatgcattcgatgaatcgcaaatggaagacggattccagttttatgatcaagaaagtatcgcattttgtggtttagaggattttgaaaatttcttaaaagcctatcaaaagtttagcaaaacttatcactaatcttgttacagtaaaaaagaaagggcactaattaaagtgccctttactttatagactattaacgtaagaactcaacaaaccaagtaattacacctaagtttaacaggtctacgaagaatgcgccgaccaatggtacgattaagaaagctttatgtgacggaccaaaggtctctgttacagattgcatattagctaccgcggttggggttgcacctaaaccgaaaccacagtgaccagcagttaaaattgccgaatcgtaatctttgcccattacacggaaggtcacgaagtagccatatagaatcatcactaatgtttgtacggtgaggataattaacattgggccggcaagacctgctaactcccaaagcttaatgctcataagtgccatcgctaagaataagcttaatgatgcattaccgaatacgtcaatcgcgcggtcaaacatatcaaatttaaatacggcagttagaacattacgtaaaattacaccgaaacctaatgcccatacgaactgcggtaaacctaaatcagggaaagaatttgccatcactgatgagaacgctaaacaagcagcaaataatgccatggtttcaatggttgagcttgcagtgataaaacgcacactgtctgcatcttcaaaagtactgtcatcgtactgttccgctgaagcatccacttttttactgtgttgtttgcggtctttcttcattttattgactaaacggcgcgcaaccggaccaccgattaaaccacccgcaactaaaccgaatgttgctgatgccatcgccatttccataataccgctgatgccatattgctcagagaagatttttgcccatgccgcaccagttccgtgaccgccggttaatgtgattgagccagtaattaaacccacaagcggatctaaacctaatgccgttgcaagaccaacgcctaccgcattttggataacaatgaaaacacctacaataatgaggaagatcacaaggggcataccaccttgttttaaacgagagaagtcagctgataaacctacagaggcgaagaacgctaacataaatgcgttttgtaagcttttttcaaattggaaagaaatgcctgcccagttatacaggcagaaaataacggttgctgcgactaaaccaccggctactgcttcaggaatattaaagtcttgtagaaatttaattttaccaactaaaaagcgccctacgagaagaacgagtgtagcagcaataagtgtgtggtaaccgttaagaattattggttccataggtgctcctctaaaatgttaaatgaatgtttaaaaatagatattacccgatactagaacaaacattttgatttgtcaaaggggctggataagaaaaattatttataaaattagaaaaacttatccaattatccacataaattttgaggaagatcagttttttgagtaaacaagcgcttatttcttgaattagttcgcattttttgtttttcggctttgataaaatttccttagttattattttatcgtggagactcaacatgagtgatatagcaattatagtaagcttattgtcattagtcgccgtattgggcttatggcttgggcacttaaagatcaaaggtgtgggactgggtattggaggcgttttattcggtgggataatcgtttctcatttttccacattgtacggtattaaaattgatgcgcatactttgcattttattcaagagttcggtttgattttatttgtatactcaatcggtattcaggtgggaccgggctttttcggttctttaagacaatccggcttaaagctcaacggttttgcgatcttaattgtgctgttaagtggtattttagttgccttaattcaccttatttttgatgtacctttgccagctattttggggattttctccggtgcggtgactaatacaccgtctttaggggcgggtcaacaggtgcttgccgaattaggcggagaaaataccaccgctgtaatgggaatgagttatgccattgcttatccgtttgggattatcggtattttgctttcgatgtggctagtacgaattctattcaaaatcaatatagacaaagaagccgctgattttgataatagccaaaatcaacaaaaagagggacttgataccttaaatgttcgcctaattaacccgaatttaggcggactaaaattaaaagaaattcctgattttgaaagccataaagtgatttattcccgcttaaaacgcggtgaagagctacttgttcctaaagtagatacggttttacaactgggagatgttctacatttagttggcgagaaagctatgttacataaaatgcagctgatcttaggggaagaagcgcatatttcattatcgacaagagggacgtgctatcgttctgaacgagcagtggtgactaatgagaatgtcttcggtaagaaaatacgccatttaatgctaaaaggtaagtatgaagtggtgatttctcgtttgaatcgagcaggggtagaactgattcctaatggtgaaatgacattgcagtttggtgacgtactgaatttagtcggtcatcaagaagatatcgaaacagtgcgagcgattattggtgacgctcaccaaaaattacagcaggtgcaaatgttaccgatctttgttgggattggcttaggcgtattattaggttccttaccgctttatgtgccggggtttccagtcgcattaaaattaggtctagctggaggcccgttggtcgtggcgctaattttagcgagaattggtagtatcggtaagctttattggtttatgccaccaagtgcgaacttggcattacgcgaaatcgggattgtattatttttatctgtggtggggttaaaagccggtgctaatttccttgataccttgctcagtccggaagggctttcatggatgggatacggtgctattattacttttgttccattaatggtaacggcattgattgcgcgtatttatggcaagatgaattatctttcattatgtggtttacttgccggttcaatgacagatccgccggcattggcattcgctaatgaaattaaagacggaaacggtgcggcagcgctttcttatgcgactgtttacccgctagtgatgtttttacgtattattttacctcaattactcgctattttgttgtgggctgccagttagttaaaagcttttaacgatagatagcggtcggatttaaagaaatttttgcaaaattctccgagaatctgaccgctattttcatttcatctctgttcagcaaatcagattccttgtagaataatcgtttaattttttatagaaaagaatagatattatgagccgtactaaaaaaacacgtcgtattaccgacattatgcctgctagaaaagcagataaaaaaccggaacaacctaaattaggtggcggtaaaaaccgtaaacctacacgttatgaacttgatgcaaaagcccgtgaagaaaagaaaaagcgtaaacataaaggcttgccgacaggttcacgtaatgtagatccggcagaacagaaaaaagcagtagtgaaagaggtgaaagatcctcgtatcggtagccgtaagaaaattccacttatggttgaatttgtgaataaaccggagaaaggtcaaacgattaagccggtgccgttagaagaatataaaccgcatttatctccagaactagaacttgaacaattagagaataatgagatcttaaatcaattattagatgaaattgaagcgggtaaaacgttatcggctaaagatcaaaaattcgtagatgaatgtttagatcgcattgacgaattaatgactgaattaggtatccaagacgaggatgaagataacggtgatgcgttacttcgccaattcgaaaccatggatattaaccaatttagataaaattaaaaaagcgtatgattcgattttttctccttattcttgcgatattagttgtgctttcaatggcaggatatgcgatctacttaatgttgagattgcgcaagcaaaatgctgaacagaaagtattacttgcacaagcaaaacaggctcagaaagcacgtttcgagcgaattattgacagtattgatgtgattgcgagagctatgctttccgaacaatgtgatttttcggaaggcgttttgcgtttaaaaccattacttgatgtattaggcaaacaactaagtcaatatccagcgatgtgggcgctgtatcaagttgtcgaaaatatgccgattttagacgagcgtaaggcgttaaaacgtaatgaacgcatgaagcaagatttacttcgtcaatcgaaagaagtcgagttagaagagcaaattaaaacggaatgtcatcaattactcattgatatcgcacagttgaagattacattatagtgagtgactcctatctttgaaggaaatccaatgtcagaaattatttgggatttagcccttatccaaaaatataaccaatccggtcctcgttatacgtcgtatccaacggcgttagagtttagtgaaagctacactgatgatgattttaaagcggcagcagaacgctacccgaatcgtccgttatcactttatgtgcatatcccattctgccataaattatgctatttctgtgcgtgtaataaaattattactcgtcatcagcataaagtagatatttatttggactatcttgaaaaagaaattaaaacgcgtgctccacttttcacaaatcgtacggtaacgcaaattcactggggcggtggtacgccaacgtatttggatgaagcacaatccgagcgtttaatggcgatgctacgcaagcattttaacgtgagcgatgatgctgaaatcagtattgaaatggatccgcgtgaaattgaattggatatgttagatcatttgcgtcgcattggatttaaccgtatcagtatggggattcaagatttcaacaaagaagtacaaaaattggtaaatcgtgagcaagacgaagaattcatttttgctttaatgaaacgtgcgaaagagcttggtttcacttccaccaatattgatttgatttacggtttaccaaaacaaaatgtcgaaagctttatgtacacgcttgagcgtgttattgagctgaacccagatcgtatgagtgtgtttaactatgcgcatttgccaagtcgctttgccgcgcaaatcaaaattaaagacgatatgttaccgcctccggaaaccaaattaacgattctacaaaaaacgatcgagtttttaggtgataacggctataaattcattggtatggatcactttgctaaaccggatgatgagcttgccattgcgcagcagcagggtgtgttacaccgtaatttccaaggttatactactcaagaagaatgcgatttgttaggcatgggtgtctctgcgattagcttacttggcgatacttacgcacaaaatcataaagaattacaacaatattacgcaaacgtagaagaaggtggtattgcgttacataaaggcttggcattaagtaaagatgacggcattcgccgtgacgtgatcaaagcactgatttgcaactttaagttggaattcgaccgcttgcaggctgaatatcagattgattttaaaaagtattttgccgaagacttagcgctacttgagccattagcaaaagacggtttattagaaattaccgaaaacagcattgtggtttcgcctagaggccgcttgctaattcgtaatatttgtttatgttttgacgtatattcaagacagcttgcgaaaagacagcaattctcaagaattatttaagtaaaaggtgtgtttacatacttttagaatttacgatgggcgagcccatccacataaggaactattatgaaaactcgttatagtgttctttctgttgcaatgatgacagcgttttatgctcagtatgcgcaagcggatttgagagaacagtgtctattaggtgtaccgcattttcaaggtgaagaaattcagggtgatcaaaccttgttaccggttgaaatcgaagcggatagcgcagtgattaatcagcctaaagatgcgacttataccggtgatgttgcgattaaacaaggtaaccgatctattcttgcagatgaagtacgagtagaacaaaacggtgagcagtctcgccgagcatttttgaaagggaaatatcaatatcaagataaccttattcaagcgcaaggtcgtgatgcggcaatggatctcagtgctgaaacagcggacttacagaataccgaattccaattagtgggtcgccaagggcgaggcacggcagaaagcggttcatttagtaaaaataaacgcattttaaaaaatgccagtttcactgcgtgtttgccggatgacaatgcatggtcgattgaaggcaacgaaatgattcagcatgttgatgaagaatatgctgaaatttggcacgcacgttttagagtattgggaatgccggtattttattctccatatttgcaatttccaattggtgatcgtcgccgttcagggttattgattccaagttttagccgttcgagtaaagatggttttacttattctcagccattttattggaatattgcgccgaatatggatgcaacgattacaccaacctattactcacgccgaggctggcaaattagcccagaataccgttatttaacccaattgggcgaaggtattattgcgggtgaatatatgggtaaagatcgtttagacgaatataagccggatgataatgaccgcaagcgttatttaatgcattggcgccataatatgagtttcttaactgattggcgtttatatgtggactataccaaagtaagcgacaaacgttacttctctgatttcgattcggaatacggtagtagtacggacggctacgctactcagcaatttaaattaggttattatcaaccaaattataatttatcgatttcgggtaagaaattccaaacattcgatgagctggatgtagggccatatcgcgtattaccgcaaattgattttaattactataaagataacttagtaaaaggaagtaattttaaactctttgcacaagcggctcgttttgagaacgatagtccattaatgccgaaagcgtggcgttttcatgtagaaccgacactgaatttcccgtttgcaaaccgctatggtagcttaaatttcgaaacaaagctttatgcgacccattatattcaagagaagggtaacagtaatcgagcgggtgaaattgataaaaatgttactcgtgttattcctcaagtaaaaattgatcttcaaacggtactagaagcagataagcaattatttaaaggattcaatcaaacatttgaacctcgagtccaatatgtttatcgcccatataaagatcaaagtaatattggttcaagcttaaatcgaagtgtaagttttggttatgactctacgttattgcagcaggacttttatagcttctttaatgatcgttcatttagtggtttagatcgtattggatcagcaaatcgcctgacagcaggtggaacaacacgcttttatagcgataaaacaggtgctgaagtgtttaattttagcgcaggacaaatgtactatttaagtccgtctaaaatttctgatgatttccgtactacaggccgatcatcttcatgggcattggaatctaactggaagttccaccgtaagtggaattggcacggagcttatcagtatgatacgcgtttaaaccaaacctcgttagctaatacgtcattacaatataaaccaagccaagataagcttgttcagctcaattatcgttttgcaagtaaagattatattaatcagaacttgcgtagcaatgcgtatggacaagatattaaacaggttggtgcggtggttggttgggaactaacagatcgcattgcatttatggcaagtcattatcatgatattgcactcaagaaaccagtagagagccaattctctatgaattataacacttgttgctggagtgctaatgtatatgtggctcgtaagctgactgcaacgccaatcggcgcgccagataccattaaggatttatattacgataataaatttggggtgaattttgaattgcgcttcggtacgaattatagtagcggcgttcgcaaaatgctgaagaaaggtttaattccttatacagagcaatacggcattaactaatgatataaaacaaaagcgagagaaatctcgctttttttatggctgtagcttaaagaaagcggtctatttccctttatgttttgcaattcaattagaacggaggaggagagtttgcaaaggtttagagaaaatagaccgcttgttcggacataattagtgacggaagtggcgcataccggttaacaccattgccataccgtgttcgttagcagcatcaatcacttcttgatctcgcattgagccacccggatggattacgcaagtaatgccgactttagctgccgcatcaataccgtcacggaatgggaagaacgcatctgaagccattacgcagccagcaacttgtaagccttcgtcttccgctttaataccggcaattttcgctgaatagacacggctcatttggcctgcgccgataccgatagtttgaccgtttttcgcatagacaatcgcatttgatttcacatattttgctactttccagcagaataataagtcttcaagctcttctttgcttggtttacgttcggataccacttgtaaatcgtcaattgaaaccgaaccttgatccgcatcttgcactaataaaccgccgtttacacgtttgaaatctaaacgtttttgcgcttgagtaaattcaccacattctaagacacgcacatttttcttcttcgcaagcgctgcttttgccgcttctgaaacgcttggagcaataatcacttccacaaattggcgttctgcgatcgtttgtgccgtttcaccgtctaattcacggttgaaagcaataataccgccgaatgctgatgtcgggtcggtttggtaagcacggttataagcttctaaaatgtctttacctaatgccacaccgcaagggttagcgtgtttcacaatcacgcaagccggttctgcaaattcttttacgcactcaagtgccgcatcggtatccgcaatattgttataagaaagtgctttaccttgtaattgttttgcggttgaaacagaagcttctttcacttcgttttctacatagaatgctgcattttgatgtgagttttcaccgtaacgcatggtttgtttgcgtacgaaatttaagtttaatgtacgagggaattgaccgcagacttgagttaaatcttcttcctcagcaccttggtatggcgggacaagtttaccgaagtagtttgcaatcattgaatcgtattgtgccgtatgttcaaatgctttaattgccaggttgaaacgcgtttcaagggttaattcgttttggttttgatccatttcggcaagaattgcatcaaaatcgttattattcaccacgatcgccacatctttatggtttttcgctgcagaacgcaccattgttgggccgccgatatcaatattttcaaccgcatcctctaaggtgcaatttggattcgcaaccgttgccgcaaacggatataagtttactaccactatatcaatacgttcgataccgtgtcggttcatcacttcatcatccgtaccgcggcgaccaagaataccgccgtgtacttttggatgtagagtttttacacgaccgtccatcatttcagggaagcctgtgtagtccgatacttccgtgaccggtaagcctgcttcagctaacagctttgccgtaccgcctgtcgaaagtaattttacaccacgagcggcaagcccttgtgcaaattctacaataccttttttgtcagacacacttaataacgcctgttgaatcgccatttttctaagttccttaaaatgaatgttaaataaatacttttctagtataacgcaaacgtttgcttttttcattagcaagcggtcgaatttgcaaagtttttcagtattatgtagcatttgcacaaacattaaatatttcgtaggggcggggataaaccccgcccctacataaattttcctaaaatcaacttttgtgcgactgctacataataccgcttatgtctgcttaaattttattaaacagcaccctgttattgaatatattttatgaaatttctagtcttactcccctatatttacttagatttaacgatttaatttaataggtaaataaatagaatttcaaattaaaaaagtcatagttttccccttccctcttcgggtaaaataaccagcaatttagatttaaggaaaaagtatttatgacaacaccaatgattgatttacagattgcctgtgaaaatagtgaaaatttacccagcttagaacaattaactctttgggtgcaaacagcgctggcttatgaagctcaaacggaggattttcctgaaacggaaatgactattcgcattgttgatgaagccgagagccacgaattaaacctgacctatcgtggtaaagataaaccaaccaatgtactctcttttccttttgaagtgccggaaggtattgaattgccgctattaggcgatttagtcatctgccgccaagtggtagaaaaagaggtggaagaacagcaaatatcccttgaatctcattgtgatgaaattcatcacactcatcaaaaaaatataacaaaaaccgacttttatcgtcttcttgccgcagcgcactataaaacaacgcctacggatttacgccgtttatttgatggcgaaaatcagattttatttccttattcagaaaacgggcaacttattggtgggatttgggcgatcaatgaaggagggctagataatgaactttctcaagccatttggcgaggagaacggcgccctcaagggaatttagtggcgcaatatctttgctatcaaggtaatctacccgaagctccgcagttatactctatccgaatttctcgtattgccgttgaacctcatttccaaaatcaaggtattggcaagcggttaatttctgatttcattttgcaaatctcaaaacaaaaacaaccgcttgttgattttatttcggtgagttttggacaaaccgaagcattaacctatttttggcaacaatgcggttttgaattagtccaaattacgccgaataaagaagccagtagtggttattacagcgcaatgatgctctatcctttaacggagaaaggcaaacaatttgtcaaaaaagcgcaaatgcaatttagccgaaatcaagcacttttgccccatatccaaaatggcaatcaaaaaatgactaaatatctcaagctagataaaactgattggcatgacttatacggttttgcttatgcacaacgttctttccaagtaagttatgccagtttaaaaagactttattggcaatatcctgaacaattttctgcgatgaaaggtatttttgaacgtgaagagccattacccaacaacaaaaagcaatggcttaaccattacagaacgttggtacaaaaaattttacaggaaaatgatggatagtccttaacaaaaattaatgttttatttcctataaaacatccgaccagtattatttttgattaaaaaaagaacaaacagatcatgacaaacgtttgccttgttttccttcacaaaaatattatggttttttatttagaataaattatctatattcattttttagggaatgggagggatgatgctaaaaaatgattttaacgtattgggacaaattgcttggttatgggcaaattctccaatgcaccgaaattggtcagtttcactgttaatgaagaatgttattcctgcaattgaaaatgaccaatatttgttactagttgatgatggttttcctattgcatattgcagttgggccaaattaactctagagagtgaggctcgctatgtaaaggacaccaattcattaaaaatagatgattggaatgcaggagatcgtatatggatcattgattggattgccccattcggggattcatctctattgtataaacatatgagacaacgttttccatacgatattggaagggcaattagaatctatcctagcaaaaaagatactggaaaaatcatatatttaaaaggaggaaaaataacaaaaaaagtagctgaaaagacatttcttcagtatgagcaagagttaataacagctctacaataatatctttaaatgatcaattatataaaggagactcttttatgtcaaaaatcactttgtcatcattaaaatcgtccttacaacaaggattgaaaaatgggaaaaacaagttaaatcaagcaggtacaacactgaagaatggtttaactcaaactggtcattctctacagaatggggctaaaaaattaatcttatatattcctcaaggctatgattcgggtcaaggaaatggaattcaagatttagttaaagctgctaatgatttaggtattgaagtatggcgagaagaacgcagcaatttggacattgcaaaaactagctttgatacaactcagaaaattctaggttttactgatagaggaattgtattatttgcacctcagctagataatttattaaagaagaatcctaaaattggcaatacattaggaagtgcttctagcatctcacaaaatataggtaaagccaatactgtattaggtggtattcaatctattttaggatctgttttatctggagtaaatctgaatgaattacttcaaaataaagatcctaatcaattagaacttgcaaaagcagggctagaactgactaatgaattagttggtaatattgctagctcggtgcaaactgtagatgcatttgcagaacaaatatctaaactaggttcacatttacagaatgtgaaaggattaggaggattgagtaataaattacaaaatctaccagatctaggaaaagcaagtttaggtttggacattatctctggtttactttctggagcatctgcaggtctcattttagcagataaaaaggcttcaacagaaaagaaagctgccgcaggtgtagaatttgctaaccaaattataggtaatgtaacaaaagcggtctcatcttacattcttgcccaacgagtcgcttcaggtttgtcttcaactggtcctgtcgctgcattaatcgcatctacagttgcactagctgttagccctctttcattcttaaatgtagctgataagtttaaacaagctgatttaatcaaatcatattctgaacgcttccaaaaattaggatatgatggagatcgtttattagctgattttcaccgtgagacaggaactattgatgcttctgtaacaacaattaacactgctttagcagctatctccggtggagttggagctgcaagcgcgggttctctagtcggagctccagttgcgttactcgttgctggtgttacgggacttattacaactattctagaatattctaaacaagccatgtttgaacatgttgcaaataaggttcatgacagaatagttgaatgggagaaaaaacataataaaaactattttgagcaaggttatgattctcgtcatttagctgatttacaagacaatatgaagtttcttatcaatttaaataaagaacttcaggctgaacgcgtagtagctattacccaacaaagatgggataaccaaattggagacctagcggcaattagccgtagaacggataaaatttccagtggaaaagcttatgtggatgcttttgaggaggggcaacaccagtcctacgattcatccgtacagctagataacaaaaacggtattattaatattagtaatacaaatagaaagacacaaagtgttttattcagaactccattactaactccaggtgaagagaatcgggaacgtattcaggaaggtaaaaattcttatattacaaaattacatatacaaagagttgacagttggactgtaacagatggtgatgctagctcaagcgtagatttcactaatgtagtacaacgaatcgctgtgaaatttgatgatgcaggtaacattatcgaatctaaagatactaaaattatcgcaaatttaggtgctggtaacgataatgtatttgttgggtcaagtactaccgttattgatggcggggacggacatgatcgagttcactacagtagaggagaatatggcgcattagttattgatgctacagccgagacagaaaaaggctcatattcagtaaaacgctatgtcggagacagtaaagcattacatgaaacaattgccacccaccaaacaaatgttggtaatcgtgaagaaaaaattgaatatcgtcgtgaagatgatcgttttcatactggttatactgtgacggactcactcaaatcagttgaagagatcattggttcacaatttaatgatattttcaaaggaagccaatttgatgatgtgttccatggtggtaatggtgtagacactattgatggtaacgatggtgacgatcatttatttggtggcgcaggcgatgatgttatcgatggaggaaacggtaacaatttccttgttggaggaaccggtaatgatattatctcgggaggtaaagataatgatatttatgtccataaaacaggcgatggaaatgattctattacagactctggcggacaagataaactggcattttcggatgtaaatcttaaagacctcacctttaagaaagtagattcttctctcgaaatcattaatcaaaaaggagaaaaagttcgtattgggaattggttcttagaagatgatttggctagcacagttgctaactataaagctacgaatgaccgaaaaattgaggaaattattggtaaaggaggagaacgtattacatcagaacaagttgataaactgattaaggagggtaacaatcaaatctctgcagaagcattatccaaagttgtgaatgattacaatacgagtaaagatagacagaacgtatctaatagcttagcaaaattgatttcttcagtcgggagctttacgtcttcctcagactttaggaataatttaggaacatatgttccttcatcaatagatgtctcgaataatattcaattagctagagccgcttaatattcaaatcatagcaatcctatggtgtaaattataggattgttatttttttaaaggagaagttatggaacccaataaaaataaggatcttggtttatctgtagaaaatcaaacctaatctgacagttcccgtttaaaattaccgtgtctgtcagattaatttgagcttaaattcttttctgcccaaatccgttttccatcaagtaatgttgccatcggtgttctgccacagcacacttttccttgatgtgttcgatggtgattataatacattaaccactcatctaaatcagcttgtaatgtcgctaaatccgtatatattttcttcctaaatgcgacttggtaaaattcttgtaagatagtcttatgaaaacgttcacagataccattcgtctgtggatgcttcactttcgttttagtatgctctatgtcatttatcgctaaataaagctcataatcgtgattttccactttgccacaatattcactgccacggtcggtgagaatacgcaacatcggtaatccttgggcttcaaagaacggcagtactttatcattgagcatatctgcagcggcaattgcggttttcattgtgtagagctttgcaaaagcaaccttactataagtatcaacaaatgtttgctgataaatgcgtccaacaccttttaaattacctacataaaaggtatcttgtgaacctaaatagcccggatgagcggtttcaatttctccactcgatatatcatcctctttcttacgttctagggcttggacttgactttcatttagaataatgcctttctcagccacttctttctctagtgcatttaaacgctgtttaaagttagtaagattatgacgtagccaaatggaacgaacaccaccggctgaaacaaacacaccttgcttgcgaagttcgttactcactcgaacttgtccgtaagctggaaaatctagagcaaattttacaacagcttgctcaatgtgctcgtctactcgatttttgatattcggtacccgacgagtttgcttaagtaatgcttcaacaccgccttgcgctacggcttgttgatagcgatagaatgtatctcggctcattcccatcgctttacaagcttgagaaatgtttccgagttcttctgctaaattgagtaaaccggtcttgtgtttaatgagcggattgttagaataaaacatgagagtttccttttttgtttagattgaattttagacactcatattctaaacgggaaactctcatttttataatgatttgtcagatcaagtctgatcttctacagccaagtcgaaaacaagtggatttaattgctaaagcgcaagatcacatggctagggatagtgataaatatatccttcgtatgaatattgacttagatagtatgaagacatttataagagcaggatgtaattattttacttattgggataatcttgcaagaatagaaagtgattcatcttgtattgcaacaaaattagccgatgccgaaatcaatattttcaaatctaatgatattaaagataaggatggctttactatcccttatgaaaaacgacgctggattttagtcgataccattccagtgaaatgggaataattatccccatttatggagttcgtcttttagatgaactcctattgtttataattcgataaaattagctttctcacagcaactcagcaatgagttgcttttttatttgacagaaaaacaacgtagatctatattaaataccgttcatcgttgatgaacatctacaatttgccaatgaaccatttatttatatttagcctagtttctttcaaagaagcaaagcgaaccatataggcgtagagacctttattaaggctctatttcggtttgcaactcatttattaaagtccacgtatttcttgtggcagtacggtattcaaggcaaaacgctttgagccgacctgaaaattcaggtgggtgattttttatgtctggcgtttagctttgagtgccttgtacacacaaggaatacttatggctcattacttactttccagcaaatctaaaacattatcccttaaacacatcttccgcctaagtgaagatgaagccttccgacttttaaaagcaaaccgttggggcaatcctgataatcttcacgatgtttgttgtccgcattgcggcatacgccatcacgcttattttcttcaatctcgcaaacgttggtgctgcaaacattgccaacgccacttctatattacgactaatacagcatttgcttttcataaattaccgtttgttgatattttggcagcaactcttctctttgcgaatgaagtcaaaggaatttcggcaataacaatgagccgtcatcttaatatcagttataaaacggcattcgtcctttgccataaattgcgtgaagccctattcaaaactcgtgatttaactccgttacaaagggaaattcacgaagatgggacgttgattaactataagctacgcaaagcaaattttaaaaagaatcaacataaacaacgagataaaaagacaaactatcctaaattgagaccaactaaacgtttcattatcagcctaaatcaacgtgcttctaatgatgaaacattgtggggctcaaatagaactattgtcgcaatggattacaccgaaaacgctaacatcgttctcgccttaaaccatcgttttgtaaaagcaggtagcgatattatgtgtgatgaaaacctagcctacaaaggtctggattttcactacactcgttggagtgttaatcataaagaatgttatagtgccaaaggtgtgagtaataatctcgccgaatcctttaacgctcgtttccgtgatttacatcgtggtgtacatcacaaatgcgataacaaatacgccctacattatgccaaccaagcggcatttatgtcagataatcgccaaaagtctaatggtgagctatttagtgatattctcaaacgttgtttatggatattgccattaagggaatgggtgggttactggcaaggaaatcatcgcacgcaagagcttatcggtatgactgcatttagccccgaagaaatttcccagtcctacttcaaaaatctcaatgaaagaatgaagtacgaacaagagttactggcagcctaatttgtttaactaaaaaacgaattgaaatgtaagtacagggaaatcagctaaaatttgccaaaataaatgcccttaacgattaagggcatcaaaaattttactgcggctaagattgcattttaggctttgtgcaactgctacataataccgaagttttttgtaaaaatgaccgcttgcaggaaacagaaagaagcgtagaatgcagaaaatataggaggcgttatgattaaacatgatttagataattttgagtttagctatctaagcgaagagggaatcaaagccggaagattacgttatcgctatattaaagataatgtgattgacgcttataccaccaaagtggacgaagcttttcaaggaaaggggattgccggtgagctttatgccgcattaattgcattcgctcaagaaaaagggctaaaaatcaagccaagttgtagttatattgaagtaaaaatgcggagaagtcatcaggatttaattgcataagtaaaaggcactcgtcaggagtgccttttagggaaattattcgttaaagagcgccatataaaatttattttcaaaattcactaacggcgcacgtttggttttactttccagctcgccggttgaatagccgtttacaaattgtacaaaggcgatacgttcacctcgcgcatttttcataaagcccgccagattatatacccctttcagtgaaccggttttggcaatcagatttttcgccagcggttcgacggagatagagcccctaccggaaatcgtaccgtccacacccgcaatcgggaaggtttcaaacagctgtaattgcgcttcattttttgcaatatattcaagggcttgcaacatcgtttccgcattgatttggttatgacgagaaagacctgaaccgtctgcgacaatactatttccaaaggtaacgcccgctttagattttaataaagtgcgtaatacgtgactagctaacggaaaagacgccggacgattatgctgctgattggcaatggttctgaatagactatccgcaatttggttatcggattttttcatcatttttttcagaagttccggtaacggagcagaccaatgttccgccaacaaagtacctttttgcgcattaagcggttcttgaattttcccttcaaaagcaatgcctaggcgcttcaaattcgctttaatcaaatttgcaccataagtagcgggatcttgtacggaaaaactcaatccgaacggttccgcttggcgagccatacagcctttgatttgatagcggttgttgtcattaactacgacatccaactggcaataaggagcttccgctttatcgacgatataagcggagctaaatacttgtaccggataagcggaaggcacattaactttggcaaaatcaccgactttttgattggcgtctaaattgacataaaaacagttgttatccacattgacggctgccggcggagcgttaaagcacatagttaaatcattccaaatccagcccgctgctttatcgtggctggcaaaaacagaggtatctaaaattaaattaccttctattttttcaataccttgtttttttaattgtccgataagctgataaagctgaccgctagtgaaatccggatcacctgtgaatttggcgattaaatcaccttttattattccgttttccacttttccattcgttaataaagccgtttgaaagcgaaaatcattcggtaaaaccaatttggcggcaagtgcggtaaatactttttgtgtacttgccggcaacataaaaacatcactttgatattgtgtaataatttgattggtttcgaggtttttcgcaataaaactggcggaggcacctgccggtaaattggtgagaagctccgaggtatttatttcggcaaaagaaatactcggaataaagatactcgtcagtaaaagattttgaatgtatgagcgaacggattttaacaacatataaattcgggagttgatatttttaacaagacgttgaataatagtcctttaaactattttagtaaacttgaaaaggataaataatgaaacaaattcctatgacggtgcgtggagcagaattgcttcgtgaagaattagaatttctaaaaaatgttcgccgcccacaaattattgatgctatcgcagaagcacgcgaacacggcgatttaaaagagaatgccgaataccacgcggcacgtgaacagcaaggtttctgtgaaggtcgtatccaagaaatcgaaggtaaactaggtaatgcacaaattattgacgttactaaaatgacaaataacggcaaagtgattttcggtgcaaccgtcagcttagtaaatgcggacaccgaggaagaagtgacttatcgcattgtcggtgacgatgaagcgaatattaaagaaggcttaatctcggtcaattctccgattgcccgcggcttagtcggtaaagaagtggacgattcggtcagcatcgtaacgccgggcggtaaagtggaatttgatattattaatgtggaatatatttaatccgaattccgtataaagttaagcggtcatatttcttcaaaattttgtaaaaaaggaagaaatatggccgcttttttaggtctattggaacaactgatggtgttttactaattcctcacgagtgagggcaaatacaccgagtccgccgtttttgagtccaacccagtggaacggtacgcttgggaattgttccattaaatgcaccatactgttgccgacttcgcaaactaatacaccgttatccgccagataattcggtgcttcggcaagaatacgcttggtaatatctaaaccgtcaacgccggaacctaatgctaattccggttcgtggtggaattcttgcggcatatcgtctaaatcttcttgatccacatacggcggattggtcacgattaaatcatatttatcttgcggaatatcggtaaataagtctgagctgattgggaatacgcgatgtgcaacttgatgacgctcgatattaatttgtgccacgtctaacgcatcaagcgataaatcgaccgcatcaacttctgcgtgcgggaatcgttcggcacaggcaatcgcaatacagccgctaccggtacacatatctaaaatacgtttcggttcggcacgtaaaatgccggtaaatccttgttgaattaattcgccgattggtgaacgaggcacaatcacacgttcgtccacatagtattccgcaccgcagaaccaagcggaattagttaaatatgccaccggtttacgcatacctaggcgttgaatcaccatctcgataatacgttctttttcaatgcgggtcaggttagaggaatacatcgcttccggcacgtcaatcggtaaatttaacgcacttaataccaattgatgagattcgtcccaaggattatccaatccgtgaccatagtaaagatccgaagcgttgaaatagctatatgcccaacgcatcatatcttgaatcgtttttaaatcatccgctgcggatgactcggtaatttcttctaataattctaagttatgttcaaacatagttgccccttttatataagttaaagcaggcttattctataccgatatagttttttgcgctagaattccgcaaaattaaaggaaataaaaatgagaacgaccgagcttatcgaactagaccaaaagcatatttggcatccttattcttccattactcatcctattcccacttatccggtagaacgtgctgacggtgtaataattacacttaaagacggtaaaaaattgattgatggaatgtcttcatggtgggctgcattacacggctataaccatcctcgattaaatcaggcggcaaccgaacaattaagcaaaatgagccatatcatgtttggtggcttgactcacgagccggcggctaaactttcgcaaaaattattggaaatcttaccgcctgagctgaataaaattttctttgctgatagcggctcggtagcagttgaagtcgctatgaagatggcattgcaatatgcgcaagcaagcggtcaaaaaaatgctaaaaaacgcactaaatttgccactattcgttccggttatcatggcgatacttggcatgcgatgtcagtttgtgatcccgttactgggatgcacggtttattcaattccagtttaccggtgcaatattttctgccgcaaccgagtgtgaaatttggtgaagcatggcgagatgaagcgattttgccactacaagatttatttgaacaacatggcgatgagattgccgcattaattctcgaacctgttgtacagggcgcaggtgggatgtatttctattcgccggtttatttacaaaaagcaagagaattatgtgatcgtttcgggattctgttaattttcgatgaaattgcaaccggcttcgggcggactggcaaattatttgcgttgcaacacgctgaggtggtgccggatattatttgtttgggcaaagcactcaccggcggttatttgactttatctgcaaccgttactacagaaaaagttgcaacggtcatttgcgaaggagaagcaaaatgttttatgcatggcccgacatttatggcgaatccgcttgcctgtgcgattgcttatgaatcgattaatttattattagaaagtgattggcaagccaatattcaacgtattgaacggcaattaattgaggaactcgcaccggcaaaacactttaaatcggtagcggaagtacgagtattaggcgcaatcggtgtattagaaatgcaacagccggttgatttggtaccactacaaaaattatttgtcgaacacggcatttgggttcgccctttcggcaaactggtttatattatgccgccgtttattattagtcaggcggaattaacccaactcactagcgcattattgcaagtattaaaaatagcttataacgaataaaacgtaatacattttacggaggttttatgaatgtattcgaacaaaagttagcggaattaacgcaagccggtttaaagcgagcgttaccgccgattcaacacgatgggaagtggattattgccgataatcgtcgaatgctaaatttttcttcaaacgattatttggggctagcttcagatcagctcttacaaaaacaatttttgcaaaaaatcaatgaaaatgaaccgcttgttaccccgcttacctcatcttcttcgcgtctgctaaccggtaatttcccgatttaccgagattttgaacagctgattgccaaccgttttcagcgagaagcggctttgttatttaacagcggttatcatgccaatatcggtattttgccggcgttatcggataaaaataccctcattcttgccgataagttagtacacgccagtttgattgacggtatccgtttagccggcgtgtctttttatcgttatcaacataataacctcgaacatttaactcaattactcagcaaatatgctgcacagtttgagcgaattatcattgtgaccgaaagtatttttagtatggacggcgatattgcgcctttggctgaactcgtggcattaaaaaaggcctttgccagccagtgtcacattatgctgtatgtggatgaagcgcacgcaatcggggcatacggagaacagggattaggcatggcggaagtattaggctgtatcgatgagatcgattttttagtcggtacgttcggtaaagcattggcttcgatgggggcttatttagtgtgcgatcaagtgattaaggaatacttaatcaacacgatgcgtccgctgattttttcaacggcattaccgccactaaatgtcgcgtggacggcatttttatttgagcggttacccgaatttcaacctaaacgacagcatttagcgcatctcagtgagaagctaaaacaagcggtacagcagaaaaatagttatccgctacaaacgcaaagttgcattattccgtttatcgtgggagaaaacgaacaagcggtacaaaaagccaaaacattgcaacaacaaggtttttattgcttgccgattcgcccgccgacagtaccgaaaggtacggctcgtatccgactatccttaaccgcagatgtaaccacagaagaattagatcgcttaattgcttgtttataaggagacaaagtgaaaacaaaattaatttcaactcaacaagccaatttgattatttattttgccggttggggcacaccggcatcagtcgtctcacatttagcgttgccgaacggttatgacttattgatttgttatgattaccaagatttaaactttcctgcttttgattttagccgttaccaaaccgtccgcttagtggcgtggtcgatgggtgtttgggtggcggaaaaggtattgccggagattaatttggcttctgcgacagcaattaacggtacgctttttcctaaacacgacttgtggggcattccgctacagatatttgacggcacattacaaacattaaatgcagaaaatcgcttgaagtttgaacgccgaatgtgtggtgataaacagttgttaaatgtttacctcgcattacccgaacagcgttcgcttgctgaaattcatcatgaacttgaggtattgaatacggcaatcgaggcaaatcttgttacgccgaagctacattggacgaatgtcattattggcgagaaagatcgtattttttcagcacaaaatcagctagctttttggcaagataaaaaggtgcgtatgacacacctatctaaaggtgagcattatctctggcaacatttttctgagtgggaacaattatggcagagttagataagccattgattgcacaacgttttgcagcccatatcacggaatatgatgagcatgcgatcgctcaacaacagattaatcgacaattggtaaatttgcttgcccaaacgaataaacaatgttttcggcgagtgttggaaatcggttgtggtacgggcgatttaactcagcatttaatgcgtgaatatcaagtggaacatttggccgtcaatgatctgagtaatgtctatcaagattgcgtcgtgcaaaaaattggcgaaaatcgaccgcttatttcctttaaatttatagccggcgatgcggaacatttagcctttgatggacaatttgatttgatcagttctgcgtccgcagtacagtggtttgaacagccgcaaacttttgtttcgcaagccgcgaagctgttacagccaaatggtgttttgctatttaatagttttacaacggaaaatttggcggaaattcgtgaactaacgggtgtcggtctgacttacccaagcccagcagattggcatttttggttaagtaaagactttacccagttacagattatgcaacggcagattcgtttaacctttgcttcaccgcttgccgtgttgcaacacctgcggaaaaccggggtaacggcaattagtacgcaaacctggacacgcaaaaagttgatggaatttagtgaacaatatcaagcgcaatttagctgtgaacaaggcgtttatttgacttatgcgcctatttttattttgggagtgaaaaaataatgggcaaaatcatttttgtatcaggtattgataccgatattggtaaaacgatcgccaccggcttttatgctaaacgcttgatggaacaaggctattcggtaatcactcaaaagatgattcaaaccggctgtgaggggatttccagcgatattttgcaacaccgtcaaatgcagaatctgccactcacggaagaagataaagagggtattacttgtccttatctttttcgctatccttgttcgccgcatttggcagcggaaatggaaaatatcacgattgatacgcataaaattgccgaagccagccgattattagccgaaaaatatgattatgttttgttagagggagcaggcggtttagctgtgccttatgataaccgacataccacgcttgattatattgcggagcagcaattaccgttgattttagtgacttccggcagattaggttcgattaatcataccttgctcagtttaatggcgtgccaacaaaaacagattccgttagtcagtttgatctataatagttatccaccaacagacgaaattattcagcaaagtacgctaaactatttaagagagtgtattgaacgcaatttcccggaagcggaatttttagtaatggacaaacagcatgttagataacgaagattttgcacttttccaagaagcggtaaaaggcacgaaaaaaattaaacaagacacttttgtgccgaaaactgcgcctcgtaaaaaagttaatgaattacgagagttacaagaacaaaaagacaccgaatttttcttctccgatgaatatgaaccgttattacgagaagaaaatgagaaaatcaaatatttgcgtgcggatattgacccgtatattttaaaacaactacgtcgtggcgattttcagccggagctttttttggatttgcacggtttaacccgtgaacaagcaaaaaaagaattagcggcactgattttggcgtgcgagagagaacaagtttattgtgccagcattatgactggttttggcacccgtactttaaaagatcaaattccccgttggttggtgcaacaccctaaaatcatcgctttacaccaagcgccaagagagtggggcggtgatgcggcaattttgattttggtagaacaaatcgaaagtccggaaagacgtttatttgaacgtaaatagagcataacaagcggtcgtatttttgcaaaattttgcacagatccgaccgcttgatctatctatctcataaggaagtttgtagaatgcgaagctttgtttataaaggagaatttttatgttagaacttgtgatcgctattttatgtagcgtctcggtcggtgtgctgattaaggttgcacgccaaaagcaaattgccattgatcaaagtatcgcagtgaactatatcgtcacgacttcgatgacttattttttactgaatccggattttaaagggcaaactgtagtcgatattgtggcgaataacccttcgtcttatctgttttttgcattaggtttcttattaccaaccattttcctgattcaagccaaatcacttgaatttgctggcattattcgtaccgatgcggcacaacgtctttcgctgtttttaccgattttggcggcatttaccattttcggtgagcaaattacccaaaataaattgattgcattggtattagcctttattgcattaggatgtttgctctggaagactcatcatggtatgggtaaaggcggtaaaattgcaattgtgagtttagcttgcgtatggttaggctatggaatgaccgataccttgtttaaacaaattgccaaatccggctcggcttttccggtaacgctgtttatcgcctttgtctttgccggctgtttaatgtttgtttatttattgcttaaacgtacgcaatggcacgtgccgagcgtagctgtcggtttagtgttgggcgtattgaatttctgcaatattttattctacattaaagcacaccaagtgatgaaagatgatccgacattagtgtttaccggtatgaacctcggcgtgatttgtttaggcacatttatcggcgcgttagtttttaaagaaaaaattaataaaattaactacttaggtgtctttattgcaattattgcgattatctgtttattttattggaaataatccgatttgaatcaataatcaaaactattcagatacacagtttaagctataataaatcctttctatttttaaacgatagaaaggattttcttttaagggggaacaatgaaggcgatcaaacaatgcagccagagttatgtaaattgggtattgcgcttggggagaggaaaggctgccctgttgggattctttgtattggccagctgtgccattgtcgcacaaagtcttttaacctatctgtttacgggcggtattttagcgcaagatattttacgttcgatttctttcggattgatttccgcaccttttgtcatttatttcttcaatctgattgtcgagaaattggaaaagtctagaatccagcttgagcagagcgtttatgatctcggtattttgcgggaacaagacgcttttttaaatgcaactttagaaaagaataaccgtgataaaagcgtgttaatggcaacgattagccatgaattacgcaccccgttaaacggtattatcgggttaagtcgaatcttactggaaggcgaattgaccgatcaacaacgtgaatatctaaaaacgattaatatcagtgcggtttcgctggggcatatctttagcgatattatcgatttggaaaaaattgacagccgtcgagtcgagttgtttagaaaagaaatcgaattctcgcaactgattagcgatattagtaatttcggcaatttaatggcggaacaaaataaaattaaatttcatatcgattactcggatgatttaccgaattttatctatgtggataacgcccgtttaagccaaatactgtggaatttggtcagcaatgcggtcaaatttactccggctggcggcgatatttatttaagcgtgaaacggattgataacgatcatttcagcttcagcttgaaagataccggcatcggtattccgaaacacgaacaacgcaaagtgtttgcaatgttctatcaagcggaaaattctcaggaaagaaaagcgcaaggcagcggtatcggtttggcgatttcaaaacgtatcgcaaaattaatgggcggtgatttaaccctacgcagtgaaatgggcaaaggttcaacttttaccttgactattcaggcggatccggtcgaagcgaaaaaatcggtgaaaatcaacgcgcacgcgttaaaagtcttattggtggaagatattgaagtgaatgtggttgtcgcgcgtgccatgttagagaaattcggctgtgatgtggatgtcgcaatgaccggcgcacaagcgtttgagttatttgaacggaacagctacgacttgattttactggatattcaattaccggatatgaccggctttgatattgcacaacgattacgcgaacgttatgaaaacgaagaggtggattatttaccattgttagtggcattaaccgcaaatattatgcaaaccaaagaggaatatcagcaacagggtatggacgacgtgttgcgtaaaccgctttcgttggaagcattatccgaatgcctaaatcattattttaacagtgatttttcggaaaaaaccgctgaaattccaccgcttgtcgaaacggaagaaacgctcaacctaccgtatgatcgtaaaattttatcggaatttattgaggtaatgggggcgaaagcggtattggcgaactttgcattattcgccaaattaatgccggagtatttggctaatctacaacattatctgaccgaatggcaggcaaccgattcgccggaaatgcgcaaatgtacggcggatgaagcgcataaaatcaaaggcgcattggcttcggtcagcttgaaacgcttacaagaagtcgcacaacttgcgcagagcgataacggagaagtgtgggaacagcatatcgcacaatgggtgttccaaatcgctcaacagtggcaagcggatttagcattagcggaaaattgggtaaaagaaaattactaatcgaaaggggataacgtatttaggctttatcccattttttatgtttcggattgacgaattcaatccctttatctttaaaatgaattccttcgagtgccaatagatagcgtttagccggtaagccgccgccaaagccggtcaaagtttggctcttgcctaatacgcggtggcaaggcacgataattgaaatcggattgcgcccgaccgcaccgcctaccgctcgcattgcattcggtttaccgagttgtcgtgcgatttcaccgtaactggtggttttgccgtaaggaatggttaataaaatctgccagacggatttctgaaattcggtaccttgcggtgccagaaaatccaaatgtctaaactccaatttctcaccggcaaaatagcggtctaaaatatcgcgcgttttgcaaaaaatttcgaaaatttgaccgcttgtttcgttagcttcttgccatttttgcgcatcgcttgtgagctgttcttgctcaaactcaatgccgattaaacctttatcattggcaatcaataacagcttgccgaccggtgaatcgtaatattgatagtaaatcgttgatttcattatttctccttaaagtaaataaaaaggcgtgtaatcagtttacacgcctttggcatcttcgtaatttcctattttgagttaggcgttagaatttgtagttaagatttaagccgtagagattcccgcgagctttaattttaaatgccgtacctttttcgtcaaagctgtttgccgtaccgcgtaggaacgcataaccggcatccaccgaaagcgcaggggttacacgataggttgcacccaccgaataccacatacggtttgtatccggaatcgaaattgacggatgattggtacttgcgttttcatcataagcgatacccgcacgtaatgttaatggctcggatacatcataagatacgcctagtgcataacgactcgcatccgagaaatcttcttgtttgtgtaagtaatgttcgcctttagtgctgtaagcatctaacgtttttaaacggctccattcggtacgtttccagctatattgaaccgctaagcggtcggttaatttatggaaacccgataattcccagaatgccggtaaattaagtgttaatttacccggaaactcttgaccggctgttgggaatgcaacgatagaacttcctgttgcagcagaaataccgttactgtaatgacctttaaatttcacatctacaggagagtggtatgctaaaccccagcggtgattttcattcaactcgtaaactaaaccggcattccaacctaatgaccattcatcgccactgacacgagctacttctgttgaacgtttataagaggataataaattacctaaagcttgatattggtttgctgtggcggttaatgcttgcgcttgagcggttaaacccgctgcgtttgcttttgcagccgccgctcttgcttgtgctgcccctgccttagctcgagctgcacctgcttcgacattatcacctaaatgacgaataaattccgctttagagtaaacaacatttaaacctgcaccaatgctaaaaccgtaacctaatttataagcgccgcttaggttgaagttatgcgcttgtaattcggtattaccgcctaatgaacctgcggcgaaatcggtcggatattttgtttttaaaccgtaatttacgttataacctaaaccgaatgagaaatcatcattcaccggtaatacgaaatatatattaggaatcggtgcggttggtacgacattacctgcataagcttgattaccgtttgaagtgattccgcgaacggtcaaatctgtatcaacgagcacgccaccggctgaaatttcagggcgtttgaatttagtcattaacgccgggttatttgctactacggacgcattgtccgcaaccgccgcattacctgcgtacgccataccgagtcctgacgttgaaacttccgcaagttggaataaagaagccgatacaccgccggcagataaagttaagagtgaagcaataagagttttattaaatgtgtgattcattaggtatccttttaaataaaaaaatagccgtataaaaggccatttttgtgaactgtcgttcatatttttatgattgctaaaaagcaaaacgcgggcgattctacgtagggataacaaggtgagcaagtgtatttacttaaaaaagtaggagttccgaccagtaggcggaatacctctttccgtttataaggctatcgggtcgatatgagaactaaaacggcaatagattgtacgttatatcaatttcttcggctttagtcgggattattattttatgagctttaaaaatcatttataattgtaaagttattgatttaaaaaaatgcaaactattcttttatgttatcaataaggattattaataatctttatcatttataaaacctttcagtgtgataagtgtaaaattcttgactgtaacagtcaggtatatcaaaattcacaccgtaaatcgattactatttccttattaaaagagggacaaaaattatgaaattaacgtcaagagggcgttatgcggtaactgcgattctagatattgcgttacacggaaagtctttgccggtaagccttgccgatatttcggaacgtcaagcgatttcattgtcgtatttggaacaattatttgctcaattacgtcgcgaaggaatcgtgcatagcgtgagaggtccgggcggcggttatcaactcggtaagcaacctgaagagattagtgtggggatgattattgcggcggtgaatgaaaatctcgacgtaaccaaatgtaaaggtagcggcaactgtagcaaaaactctcagtgcttaacccatcatttatgggaacgtttagaagaacaaatcggtgtgtttttaaatacgattactttagcggaacttgttgaagaacattcggatcacgattgtgaaaaagaacattgccacgatcattcacacaaacattaattgcaacaatttcaataaaaacggccgcttatttaaagcgagttaggagtaacaatgtcagttaaattacctatctatttagattatgcagcaactacgccgatggacgagcgtgttgcgcaaaaaatgatgcaatatatgaccaaagacggtatctttggtaacccggcttcacgttcgcataaattcggttgggaagcggaagaagcggtagatgttgcacgtaaccatattgcggatttaatcggcgcggacagccgtgaaatcgtatttacttcaggtgcgacggagtcggataatcttgcgatcaaaggtgcggcgcatttttaccaaactaaaggtaaacatatcatcacggttaaaaccgaacacaaagcggtattggatacttgccgtcagttagagcgtgaaggttttgaagtaacttacttagatccggaagaagacggtattttagatttagcgaaattagaagcggcgattcgtccggacaccattttaatttccgtgatgcacgtaaataacgaaatgggtgttatccaagacatcaaagcaatcggtgaaatctgccgtgcgaaaaaaatcattttccacgtggatgcaacgcaatcggtcggtaaagtgccggtaaacgtacaagaattaaaagtggatttaatgtctttctcaagccacaaattatacggaccaaaaggtatcggcggcttatatgtatgccgtaaaccacgtgttcgtatcgaagcgattattcacggtggtggtcacgagcgtggtatgcgttcaggtacattacctgtacaccaaatcgtaggtatgggcgaagcatatcgtatcgctaaagaagaaatggcaacagaaatgcctcgcttacgtgcattacgtgaccgtttatacaacggcttcaaagatatcgaagaagtgtatgtaaacggttcaatggaagaaggtaaacgtgtagattcaaacttaaatatcagcttcaacttcgttgaaggcgaatcattaatgatggcgttacgtgatattgcggtttcatcaggttcagcgtgtacatcggcaagtttagagccttcatacgtattacgcgcaatcggtcgtgacgatgaattggcacacagctcgattcgtttcactttaggtcgttggacaaccgaagaagaaatcgactacaccatcgagcttgtgaaaaaagcaatcgtaaaacttcgtgagctttctccactttgggaaatgtttaaagaaggtgtggatctatcaaaaatcgagtggaatcaccactaatcagtagaaatattgcaatgcatttgcgttgttgaaccgccttgccgtactgattgtactgtctgcggcggttcgcctagcaactgcaaacaatattttactgataacagaatttaacagaaggaatacaaaatggcatacagcgaaaaagtaattgaccattacgagaacccacgtaacgtagggacatttgataaagaagcggcggatatcggtaccggtatggtaggtgcgccggcttgcggtgatattttacgtttacaaattaaagtgaacgatcagggtattattgaagacgcacgctttaaagcgtacggttgcggttctgcaatcgcatcaagttctttaatcaccgaatgggtgaaaggtaaatctttagaagaagcgggcgcaattaaaaacagcgacatcgcagaagaattggaattaccaccggtaaaagttcactgttcaattcttgcggaagacgcaattaaagcagcgattgccgattataaagaaaaacaagctaaataataattaacttcgaataacacggaaagcacgaaaacaagcggttgttttttcgcaaaattttgcaaaatcaactttttcgtgtatttccgtgttttctgtggtaaagatcgctttcatttaacagattaaaaaggataacttatggcaattacattaaccgaaacagcagcaaatcgagttcgtacattcttagaaaaccgtggtaaagggatcggtttacgtttaggtgtgaaaacgtcgggctgttcgggactggcttatgtgcttgagtttgttgatgtgttaaatgaggatgatcatgtctttgaacaacacggcgtaaaagtgattgtagatgaaaaaagcctgacttatttagacggtaccgaattggatttcgtcaaagaaggtttaaacgaaggttttaaatataacaatccgaatgtgaaagattcttgcggctgtggtgaaagttttaacgtatagagataaacaatgaataatccttttgcactatttgatttaccggttcaatttgaattggataacgcgctactttccgaacgctatttggcattgcaaagacaactgcatccggataattttgcgaacggttcttcaacggaacaattagcggcggtacaaaaatcggcagatataaattcagcgttacaaacgcttaaagatccgattctacgtgcggaagcaataattgaaattcataccggcgaagcaaaaaatctcgaagaaaaaagtatgcgagatatcgagttcttaatgcaacagatggagtggcatgagaaactggaaacaatagagcatcgtcatgatgaagctgaattaaccgcctttctaaagcaaattaaaaccgaacagaaagccgttttagagcaactgcaacaaacgctggaagcgcaacaatggcaacaagccaatgggctgaccgatcgcttacgctattttaaaaagctgattattcaaatcgaaaaagttgaagaaaaattctttgatatgtagcggtatcagccggatacaagcggtctgattttaagagaattttgcaaatggctttaccctatattttattggcactggtcgccggttccgctctggcaagccaagcggcaattaatagccgattagcgcaggcaatgctcgggcaacctttggtagcagcggcaatttcgtttgcaacggggacgattgcgttattgttattctgtttttggaaaacggatttaagcggtgcgttacaacagcttccgtcacagccgatttggaaattgctcggcggtattttaggcgccgggttcgtctttactacggtatttttagcacctaaaatcggcattaccaatatgctgttttttattattgtcggacagctggtcacaggggcgattattgaccatttcggtttgttcggaatggcggttcgtcctttccaattaaatcagttaatcggcttattaacggttgcttgcggtttggggatttatttcttagcccgaaaataagcggtcgaatttaaaggaaattttgcaatgaaagcattagaagaattattagataagcaatcggcgtggctcattttaagagattggtttacgcaagcaaaaaatcattatgaaattttagcgagctatccggaagacgccggtgcggcgttagtcggaatgcagctttcgacgcgttcgccgatgggcgcaatcgtgtatgagaccggcggtatttttattgatcacggctggttacgtattttaggctcaggtaacgaaaagttaccgagaggattattcgactggaatttcggaaaaacctttaaacaatcgggcgaacaaccgagccatttattagtggcggacgatgcaatcggcggttattttgcgattaatgccggcggcttaggcgataaagtcggacaggtctattatcacaacccgaaaacccaaaaatgggaaccgttaaatttaggttattcggaatttctcggctgggcgttagccggtgatttaaccgatttttataaagacttacgctgggaaaactggcaaacggatattgcgaatttacaaggttatcaagtattagaattagaaagtaaaatcgccgtcccgatcgaacgccactaccaaggcgtattcgcaccggaaaatatgggctattcggtcgcataattttatcactctctcccacagggggagagagtgcagtaagtactcgtttttgaattagatcttgagcggaatttggtagagttaaaacataatattatataaagagagataaaaaataatggcattacttcaaattgctgagccggggcagacggctgcgccgcatcagcatcgtttagccgtcggtattgaccttggtacaaccaattcattggtggcaagtgtacgtagcgggcaaacgcaggtgttgttagatgatcaggaacgtgcgttagtgccgtcagtcgttcactacggcgaacaacaaaaaacggttgggattgaagcatttacacaggcgagtctcgatccgcaaaatacggtcatttcggcgaaacgcttaatcggtcgctcgcttgcagacgtacaaacacgttatccggatttgccttatcaatttattgccagcgataacggcttgccacttattcaaaccaagcaaggtaataaaagcccggttgaagtgtcggcggatattttaagccacttaaatcgctttgccgaacaacgtttaggcggggaattatccggtgtggtcattaccgtgccggcgtattttgacgatgcacaacgccaaagcactaaagatgcggcacgtcttgccggtttaaacgtattacgtttattaaatgaaccgacggcagcggcgattgcttacggtttggatagcggacaagaaggcgtgattgcggtctatgacttaggcggcggcactttcgatatttcgattttgcgcttaagtcgcggtgtatttgaagtgttggcgaccggcggcgataccgcacttggcggcgatgacttcgaccatttactcgcagattggattgcacaacaggcaaattacaaaccgcaaaatgctaacgaacagcgtaagttattaacccttgccacccaaactaaagtagcactttcacaagcggtcgaaaccgaagtgaaatttgcaaattggcaaggcacggtaagccgtgagcaatttaacgagttaattcaaccgttagttaagcgttcattgatgacctgtcgccgtgcgttaaaagatgccggcgtggaaggcgaagaaatccgtgaagtagtgatggtgggcggttcgactcgagtgccgtttgtacgtgaacaagtcggtgagtttttcggtaagcagcctttaacttcgattgatccggataaagttgtggcattaggggcggcgattcaagcagatattttagtcggtaataaaccggacagcgaaatgctgctgttagacgtggtaccgctttctctcggtatcgaaacgatgggcggtttagttgagaaaattattccgcgtaacacgacgattccggttgcacgtgcgcaagaatttactaccgcgaaagacggtcaaaccgcaatgagcgtacatgtgttacaaggcgaacgtgagttggtcgaagattgtcgttcactcggtcgctttacgttacgaggcattccgccgatggttgccggtgcggcgacgattcgtgttacttatcaagtggatgcggacggtttgctcagcgtaacggcaatggaaaaatcgactaaagtgcaggcttcgattcaaattaaaccgtcttacggtttaactgacgaagaagttacacaaatgattaaatcttcaatgaccaatgccaaagaagatatggaagcccgccaacttgccgaacagcgagttgaagcggacagaacgattgatacggttatttcggcattacaacaagacggtgcggaagtattaagcgttgaggagtttaaattaattgaagcggaaatcgcaaaactgattcaattaaaacaagggacggatcgacaagcgattgcccaaggggtaaaagatttagatctcgccacacaaacatttgctgcgaagcgaatgaatttatcaatccaaaaagcattagcgggtaaagccgttgatgagattatttagtttttatcactgaaaatacggaatactcggaaaatagtatttgcaaagaatcggcaaaatccgaccgcttgcattaattgatttccgtgtctttcgatggtaaatcaaagagaggatattatgccaaaagttgtttttcttccgcatgaagagttctgcccggaaggtatggtgattgaagcgcaaaccggcgacaatttattagagttagcacacaatgcaggtgttgaaattcaccatgcttgtgacggttcttgtgcgtgtaccacttgccatgtggtaattcgtgaaggatttgattcattaaatgaaacgaccgatcaagaagaagatatgctagataaagcatggggtctggaaatggacagccgtttaagttgccaatgtgtagtcggcgaggaagacttagtggtagagattccgaaatataacttaaatcatgcaaatgaggcgacgcactaatgaaatggtctgatacacgcatgattgcggaaaatctctatgatatgaatccggatttagatccgacgacggttcgttttaccgatatgcacaaatggatctgcgaaatggacgattttgatgatgatccggaagcgtcaaacgaacaggttcttgaggctatcttgactatttggcttgaagaatacaaataatctgtaaaaacctaaagcgaaagttttagtttttgttcgcaactacttatatttttgcatctgttttgcttggcattagttggtttaaggtttttcgtgaaaagtgcttagatggcagagaatcatcttttgggtagcttgaattacctaaaatattgagatcaaagataaaaaagaaacagatttacgtgcctgaaccaacagatttatcactacacgcctttaaaaaaataacaacgtgagcttgcgatttcccgctatgagattgcttacttaaaaggttgaagggcttgactgccaaaaacgacagcagaaaaaggaaccgccattcatgccctaaaaaagcacattcattaaatgatttattgcaagtggctcaaatggtcagctcccccttttattatcaagaggttaaacgaaattattctgaagaaaaagcagtgatgttgagagaatagcgggatggttatcgtgctttaactctaaaattgcgtcaaatcggtgttagattaaatcatacaactatcttgaagctgaggaatgtccagcaagatctattctattgttcgcaagaaaaactttatttttcattagctaattgagaaattatctcttatcagattgcgacatgtcccaaattcccgatggttaaaaagatgctagaacaagggctgagtcaattaaaagccacggatggtccgattattcattatgctcaaggtgtaatggtacagcggcgtggcgaaatatgttagaaggaaaagttatccagagcatgagtcgatagctgttataataatgcgctaattgaaggtttctttgggattttgaaatcagaatgcttttaccatcgcagttatacatcgatagtagcgccacagaccgagttggaagaatatttagtgtattattactaaactggatttaaaaggactgggccctgctcaatcccgaggctcagcctttatagtttattaatctgttcaactttttggggcaaatcatatcgtttttaattattagattaaaaacgactttcgatgattagattcgcatttttatccgtgtaagcatataggcttggtaagttgctatgatgtttagcatagccaagttgcagtttgggtgtaagccctaaccaatgccaatctcgtttccaaagggtaagattaatgctgttcacacggtcatggcgaattttacctagattaagtttgccacccagcaccgcagtgtctttataatgtctgtcggtgtaagcaagggtcaggcggcttgataatccaagtgtttgccattcctgctgccagccgaaacgtaagcttttggtatcagaactatgttgtttcaatacggttttatctcggttgaaatcggtaccaataaagaaaaactgttgcggattacgtagccagagtagggtagctgaagcaagtttatagctgccattgtaaatgtgctggtcgaaatagcgttttttcccatactcgaatgcagtagcaagttgccagtgaatagaaagccaatatgcatgttctagccttaatccgtttgtccagcgttctgattgatgatgtttccagcgtttttcataaaatggcaatacgcgggtggtttggtgtgactttttgtaagcatagccaaacaaagcgcgattggtgatttcatcgtagtcatgattatcccaataaagttccccctgcgtttgattatcgaaactaaggtaatgcgagccaagtaggttaaaatctctttgtagtccaaaagaatagtgaattccgtgcgcagtttgtggtaacaggttaggctgtttcacatagccggtatgctcaatttcagtttgtttggatgtgttattgatattaccatcccgtacatagtgggcagagaaattgaacttccaagcttgttttttctccagatattgctgatactgttcaatcagttgctgcactttataaggtaggtttttggcacttttagctttatcgaattgttcacttgccgcattcgtttgttgatcatgtagtaatgcaattgccagttcaattcgtacggtatttagttcaggttgtttagcaagaatagtgcgaaactctcgaatagcttgtgaataatttcctttaagtagcgcgattttaccttgagcatagcgcaataaaattgggtcaatttggttaaaatcttgataaattatcaccagtttttccatattagtgagctggcgagtatagatagcttggctgagtaatttttcggttaatgcctgattagcacgtaattcagcttcgttaaaaatgtggcgagacgattgttccactgcaagctgtaagggtgccgatgttggtttagcgatatgttctatttggctaggtgtactattgggatcttgagcaaagagtaatgtcggaaaaaaaaacagtaatggaaatttcttcatttcttatccttagaaaaagaaaagggctgttaccagcccttttagctatggcgagcctatttttcagttttcactgcaccaaatacagcgttatatttagttatgtcattgttattaatatcatccgttttattttctaattcaatagaaccaacggcatcgttaagctttggaccagcaaactcgacagagtagaagccttccaacgagttatttgctttagcttcgccattaaagccaatatgatccactaaataagttgctggagcaagtttactttcttcaagcttaatttcacctatagttgtactatttactttcccactaagcttactgtctgtccaattattatctaagtgcaagttcaaggttacatcgccatctacttgtggagcaaagacaacggttttatcgccaatctgcttttcaatacgtgcaatcacgtttccttggtaaacagcatcacctacaagcccattattccatttggcagtttgaccatttaatgtataaacgccatattcagcatagcttgcgccactttctccttcgctaatgattctccttccatctcttcctgtgctgagttgtacatggaagagattgctgttattcgcatctgtaaatagtgctccataactagaataaggctgattcacgtacaagtagttgattttatttgaatccccaacaattttactatcttggtagatgccactatgttgccctaagtagttattacctttttgattaagatttttgataaaagggctaccctgttcattttgtccaagttcaaaactaagaaaatgattatattctgtctccccaaattccttgctattatcaagaggtgaatttttgcttttagtcagtgaatccagatgatctttgcgatattcactaatattgagcaaactgccatttcgacttaatgcaacaactcgccatgccttgcctttgctatcctcattaataccagaagcgtacggtttattctttggtatatcaggttgtgcgggttgttctggttgagcaggtttttctggtgtaggaacaatggactctggctgttttggtgtttcggctggagtaaccggtttagccggttgcaccggttttggtagctcaggtttagcaggaatgttattggccttattcgattcttcctttttatccttttcctttgtgatttgaattggttgaggctctgaattttttgctaccacagatggaccatggctagatttacagccagtaatcacaaaagaaaccgcaattgcggcaagagtaagtttaaatgtagaacgcatgttttatctccgttaagttaaatccataaaattttaatggatatgtttcctgcttggcaagaggggaaagataaaaacacataatttttttatggttattattgtcaagtctcatattttgcagtaacttattaaccataattattttatggagaataaaattgtttaataaaaaattactagctgtgttgatttcagcccaatttagcccgcttgtttgggcaaacaataacgatgttgcagtgttagacgaagtttcagtagttggtagcacgccgagtatttcgcaaggaagtgaagttaccttactgaaagtcagtgataaaattattgcaggtaaggaatttaaaaagcgttcggcaacgctgggcaatgcgcttgcagcggagttaggtgtacacagtaacccgtttggcggtggcgcgagtaagccaattatccgtggccaagaaggcgcgagaattcgtattctgcaaaacggttcggatgtgattgatatgtcaaacctatcgccagatcatgcggtagttgccgattcattgcttgctaaacaggtagaaattttgcgtggttccagtaccttgctttatgccagcagttcaccggcggggattgtgaacgtggtagataaacgtattccaactgagatcccagaaaagggctatgaggtggaactcaatagccgttttgataccgctgccaaagagaaagtcggcgcattaggggcaacctttggtatcggcaaacatattgcggtgcgagccgaaggactgacccgccacagcgataactaccgtgttccagggattaatttaggtgaacggttaaactatgtcccggatacttataataaatcaaaagtcggcacgttagggttatcctttgttggtgagcaaggttatatcggtgcgtcatacagtaaacggcgggataactatggcttaccagggcataaccataaattcgatttctgtattgggcatatttatggcaataaacagggcaaatacgcctatacctatctctatccgcatttgattggcgaggaaaacattgggagcaatccgcatttccactgtggaactgatcatgcagaagatggtacacacagccacgataatccattcggacacgatcacgaccatacacaccctggtccatgggttgatttagaatccaaacgatttgatgtaaaagccgagttgcgtcagccattcaaaggtattgataaaattaaagtaagctacgccgatgccgattattaccatgacgaaaaagatgccggtgtgttagcaacacgctaccataaacagctgaaaaaagatcaggattatggcaaaccggtcaatattttcaaaaatcgaggtaaaaatgcccgcttggaaatctatcatgcaccactaggtggtttaaccggtgtatggggcgtgcagtaccaaactcagaagagcagcatgcatgcaccgaaagatcgtgaagtgaaattcccgctggttgaaaacacgaataaacagatgagcctgtttggtattgagcaatatatgtgggataattttgctcttgaatttgctggacgagtagaaaagcagaagattgaaattgaatacgatcgcaatgaaatcaaacgcttgcaggatcattatcgcattagtggtggtaaacaggttgagccagatctgtcaccttataaccaaaacgcttatgcctattccagtacgctaaattggttcttccacccagattatcagctctcgtttactgcatcgcataatgaacgtttcccaacgccgatggagctgtattatcatggacagcatattgcgactaactcgtttgaatacggcaataaagatttgaaaaaagagcaatctaacaatgtagaactaggcttaggttatcaaactgagcaagttgggtacaaagtgaatgtttattacaaccactttaaaaactacatttacaatgaaaatttattccgtgaaaatcagttatttatgcgtcgttataaccaggcaaaagcccgtttttacggcatagaagctgaggcaagctaccgctttaacgacaaataccaagccacgatttttggtgatatggtaagaggctggctgaccaatttacctccactgacggtaaacagcgattacagcgtatttaaagattatttaccaaaagatgctaaaccaggtgaagattatttgatttatcgtgctgatcaaaatacgcctcgaacccctcctgtacgactaggttttcgttttaatgcggagtttaccccaaattggtcaggagatttagaattgatccgtacctttactcaacgccgtaccagtcagttggaatatattacggaaggtaatacgatgttaaatattggtgtggcatatagtaataagtggaaagatttggattacaaaatcagtctaaacggtactaatttactcaaccaaccagtctatattcacacctcttaccaccaatttgtaccgcaaacgggacggaattttatattagttgtgaatgttaaattctaaaaacaaggagcctatgaatgatctgaccccaaaaagttagactgtttaatttaaggactgagttctgtattgtacagggctcagtccttttaatttcacttgaatacgctcattgttgtaataatgaatgtactcgtgaatcactttctcaagttgttcgaaagtttcaaatcgcttaccaaagtaacattccgttttcaatcgcccaaaaaaactttccattgccccattatccaagcaattcgcttttctcgacatactttgtttaatatgatgttttctcagcatgtcttgatagcctgccatctggtattgccaaccttggtcggaatgtaaaatcggtttagcgtccttaggcagtttcgcgaccgcttgctttagcatccgcatcacttgctcaaagttagggcttcttgctaaatcataagcaagaatttcactattaaacaagtccttaataggcgataaatagagcttgccttccgcacatttaaactcggtgatatccgtgacgagcttttcatttggcgccgttgcgtgaaaatcccgttgcaatacattctcggcaattttaccctcttcaccttgataagaacgatatttcctctgcttacatttcccttttaaatcaagctgttgcattatcctttgaatacgcttatggttaatcgcacccaaaaaatcacgtaactttaacgtaatacgacgatagccgtaattgccatcattatcttgataaatctcaatcactttctgcctaatcactgcatttttatcgattttaggcggtaagtgataaaagaacgtactacgttttaaaccagtcaaagggaggaggatttctaagggaaaatccactcgcaacgtttttacgatggctgcttttgccgcattttttgttggttgaactcccgcaacttttttaggtaagctacctctgcttccagctctaaaatacgataacgtaagcgttcttcttcagttttaggtggaggaggcattttcgggtatttcggtttcattgtcggacgacctttgggcttgggtaataagccgtttataccttgttcttcaaagatgtgcaaccattggctaatcgaacctgaattagcaatgccaaaatgaagggaggcgctttccgcagaaaattgcccctttttgaccgcttgtatgacggttaatttgaattcgggggaatatttttgcttcttacctatcaccgctagcccattgattccgttatgattaaattgagcaatccatcgagttaaggttttcttggataattgaaaatatcgttgagtgaataaacggtttttgtcattttgaagataaaactcgatgacttgttgtttgaattgttggttatatttagtcataaaaaatctgcaccttaatccgttggaggtttagtccaacttttggggggcagatcagaaggctccttgttttatacattgggttttattatttttattgctgtaattcgccgcttattcaactcttccctgattgcttttttttcaaaaccgtcttgaatcacagcttgtacatctacttgggctgctactttaaaataccatttagcaagttcagcttgtggatattccctattttcaaaacctaatctgccacgagcatccgcttcacaagcgagtaaaaaatcacagaaacgttgcggtttacgccatatatcaagtgcattaaatacttttaatacggtttccggacgcagctccgccattttatggcagtgggtgtggtattcagtgaccaaaatggcgaaatcttttacgtctgttgacactttcaggcgatttgaaagttctcgagccggtttgacaccttttacttcgtgcccgtaatgatgtgggagaatgtctttttcggttaaccctttgcctaaatcgtggcaaagtgcagcccagagtaaagcggtcggattttctgcattttttgcaagtcttttggcttgctcaattaccagtaaggtatgaaccccactatcaatttcagggtgatgttgctcgggttgaggtacaccgaataagcgatcgaattccggaaataatacggctaatgcgccgatttctcgtaatacttcaaaatagatttgcggattatccgttgcaaacgctttttgggtttctaaccaaacacgctccgcagttaagtgagccaattcaccacaagcggtcatttcttgcattaattttaccgtttcaggggcgatcttaaagccaagcgaatggaaacgggcggcaaagcgagctactcttaaaactcgcagaggatcttcactaaatgccggcgaaatatgacgaagcaggcgatttgctaaatcttgtttaccgccgtaagggtcaaaaatttgaccgcttgcatcttgggcaatcgcattaatagttaaatctcggcgaattaaatcttgttcgagggtgacatccggtgaaaagtcgcagagaaaaccattatagccgaccccgtttttacgttcttggcgggctagcgcatattcttctttggtttttggatgtaaaaaaacgggaaagtcattgccgacttgctgatagccttgcgctaataattgttcgggcgttgcgccgaccaccagataatcccgatcttttaccggtaagtttaataactgatcacggacagcgccgccaacgagataaatttgcatagttttgttacttttatgaaagatgattccattttgcagaattataaaaaatttgaccgcttgtgttgagtgcaagcggtcaaatttctaatggattttgcgattaggcaacggtaaccgattcaattactacatcttcaaccggtacgtcttggtggaagcctttgttgccagttttcacgcctttgattttatcaaccacgtccataccttcaactacttcaccgaataccgcatagccccattcttgaactacttcacgaccaaacatttcttttgaacggtaatctaagaaagtattgtccgctacgttgataaagaactgtgagcttgctgaatgcggatcagaagtacgtgccatggcaagtgtgccgcgtttgttgcttaaacggttgttcgcttcgttttgaatcggcgctttggttgctttttcaattaaacctgaagtcataccgccgccttgaatcataaagccgtcaatcacacggtggaaaattgtgccgctatagaaaccttctttgcagtaatcttcaaagttttttgcggttaccggtgctttttcaaagttaagttcgattttaatgtcaccgaaattcgtatgtaatgtaatcatttagatttccttataaaagagaaagggaagtttggtgcgttattattaaaaagtttacgggaaattgcaaaaaaatctcaaaattagaccgcttattcgctatacttctcaacattgcgataacaaatcagtacagaggatactatgctcaaaatttataacactttaaaacgtgaaaaagaagaatttaaaccgattaacccgaaccaaattggtatgtatgtctgcggtgttacggtttacgatctctgtcactttgggcacggacgtacttttgtttcatttgacgtgattgcacgttatttacgttatttaggctataacttgcgttatgtgcgtaacattaccgatgtggacgataaaatcatcaaacgtgcattagaaaacaacgaaacttgcgatcaattagtcgatcgtatgattgccgaaatgcataaagattttgatgatctgaatattcttcgcccggatgttgagcctcgtgcaactaaacatattccggaaattgtagcgatggtggaaaagctgatcgcaaatggccacgcttacgtagcggcggacggcgatgtaatgtttgatgtggaaagcttcaaaaaatacggtgcgttatctcgacaaaatttagaacaattacaagcgggcgcacgtgttgaaattaaatcggtgaagaaaaatccgatggatttcgtgttatggaaaatgtcgaaagaaggcgagccgagttggcaaagtccgtggggcaacggtcgcccgggttggcatatcgaatgttcggcaatgaacagcaaagagttaggcgaacattttgatattcacggcggtggctcggacttaatgttccctcaccacgaaaacgaaattgcgcaatcttgctgcgcacatggcggtgattatgtgaattactggttacacaccggtatgttaacgattgatgatgagaaaatgtcaaaatcactcggcaatttcttcacgattcgtaccatgttagaaaaatatgagtcggaaactttacgttacttcttcttaactgcgcattatcgtagcctattaaattacagcttagataatttggatttagctcgttcggcgttagaacgtttatacacttcattacgtggttgcgatttatcggttgaagccgtaggcggcgaacaatatgttgaagcatttaaagcggcaatggatgatgatttcaatacaccgggcgcattagcggtgttatttgaaatcgcacgtgaagtgaataaacttaaaaccgaagatgtggcgaaagcgaacgggttagcggtgcgtttaaaagaattagccggcgtattaggtttactctatcaagatccggaagcgtttttacaaggcgatgcggataatgatgaagttgcggaaatcgaagcattaatcaaacaacgcaacgaagcaaaagcagcgaaaaactgggctgttgccgatgaagtgcgtgataagctaaaagcaatgaatatcgtgctggaagacacaccaaacggcacaacgtggcgtaaggcgtaaaatttcatcccccattttatgaaaatagaatgggggatattttatatttatttagcaaatttataagctaaatcattccaacgtagttcatttttaagctgaggtaattcggtatgttgattgatatggataaattcaacaccaaaatactcggcaaatgtacgtagcatttccgcatcaatatctaaactaaacgcactatgatgggcacctccggcaagaatccatgcttgagttcctacatcaaaatttgggtgtaatttccaaaaagcgtgtccaaccggtaaatttggcatttgatttggtggggcgatagcatctagatcggcgactaccattctaaaacgctctcccatatctacgacagttgcatttactgctttacctacttttccgctaaaaattaaacgtaccggatcggatttaccaccgatgcctaatgggcgaatagctaatttagctttatcttgagcaatagaagggcaaacttctaacatgtgagcacctagtacaacttggttctgttcatctaaatcataagtataatcttccataaatgaagaaccgtttggtaaaccgtaacccataaccttaactgcacgcacgagtgcggctgttttccaatcgccctctccgccaaaaccgtaaccttgttccattaaacgttgtaccgctaagcccggtaattgtttaataccgtttaggttttggaaattatcagtaaatgttttaaatccaccgttatctaagaaagtttttaaaccgatttcaatacgtgcggaataggcaagagattctcttgccgaaccatttgcttgcaatgcttcttcaacttgatacaagcggtcatattctgctaataatttactaacatcatcatcagaaacggcattaatcgcttcggcaagttcgtaaacaccatacccgtttacgctgtaaccgaagactctttgagcttctaccttgtcaccttcagtcactgcaacttcacgcatattatcgccaaaacgagcaatttttagttgtttatgatcataaattgcgacagcaactcgcatccagcgatctaatttttctattacgcttttatcttgccaatgacctacaacaatagttcttggtaaacgtaagcgagatactaagaaaccgaattcacgatcaccatgtgcggtttgatgtaaattcatatagtccatatcaatgttattccatggaatatgacgattaaattgggtatggaactgaactagtggtttagaaaatgcttgtaaaccagcaatccacattttagccggtgagaaagtgtgcatccatgcgatcacgccaatacagttttcttgattattggcttccttacatactgagaatacttcttctggtgtagtagcaacaggttttaatttaatttttacaaacgggttttgttgatttagataatttacaatttcttttgcatcggcttcgacttgtttcaacgcttccggtccgtataagtgttggcttccaacaataaaccaagcttcaagtgatttgataaattccataaaaactccttatgctttgaatgctaaaacggcttctttaacgacctcgattccttttctataacgttgcataaatgcttcatatcctttagatatttctacatcgggttctgcaaccgaaattgatgtcgaattaaaaatttgttgattcaggtaatcatctagtgaataaccttttttgtattcgtttagataattggcaagtaaagcaattccccaagcaccaccttcacctgcggtttgcatggtggcaatcggtacatttaaagcggatgctaagatcttttgagccacattttctgttttaaaaatgccgccatgaccaagaatttgagtaatttcgactttttcttgcttcattaaaatatccataccgattttcatagcagcaaaggcggtatagagatgaactctcataaaattagctaaattgaaatgggcatcggcaggatgcatgaaagtagggcaaccttcagataaaccgacaatgtgctcacctgaatagaatccgtaagagagtaatttaccgcaatcaggatcagcttctaacgcttttaaaaatagcgtttgatatagcgcatcggtatcgcagggtaggtttagtgcagtaagtatttctttaaataaaccaacccaagcattaatatccgaggaacagttattggaatgcgccatggcaaccagtttgccggttggcgtggtaaccatatctaattcttcatataccttagagagttcttgttgcaatacaatcatcgcaaaggcggatgtaccggctgaaatatttcctgttttttcagagatactatttgttgcaaccattcctgttccggcatcgccttctggaggacaaagtgtagaaccggcttgtaatctacctgtaggatcaagtaataatgccccttgttcagttaaaactcccgccttttctcctgcaaccaacacttgaggtaaaatgtgtgaaatagaccaattaaagcctttatttgcgattttgttatcgaattgatttaacatattcggatggtaatttttgcttactaaatcaataggaaacattcctgaagcatcgccgataccaagaactttctctccggttaattgccaatggacatagcctgctaaagtcgtaataaaatcaacttcggctagatgagattcattatttaaaatagcttggtaaagatgagcaatactccaacgttgcggaatattgtaattaaacagtttagttaattcatgagatgcttgggctgtaaaattatttcgccaagtacggaagggaacaagtaattcgttttgtttattgaaagctaaatagccatgcatcatcgcactgataccgatattcgctatttttgttagtgggcatccgtattgctgttgtacgctttcggctagttgtttgaaagcggattgaacgccattccaaacttcttctaaaggatatgtccatacaccatcgataaaatggttctcccaattaaatccaccgacagataatatattacctctggaatcaattaagaccgctttaatgcgtgttgagccaaattcaataccaagagaaatattgccgtcaataattgctttttgtgcgtttgacataatagttacccctaaaccatatttaatatatggttagactagcacccatatttaaatatggttagggggtaaatggctatttatatggacaaaacagctacattattttaaatgagaataagatcacattttatctggaatctctgaaagcagaggggcttaaacccgtgtagcgtttgaataatcgagcaaaatagagttggtcgtcatagcctaattgacgagctatatgataaataggggcatttgatgtatgtaataaatgtctggctctaatcattctttgttcttctctccacttaataatgcttgtaccgatttgttctacgaataagtgtgttaggcgagaagaagaaatatgtacatgagcagctaattcttcaattttatggtttaagtgaatattttgtgagatcagattacacacatctaaaattctaggctcaatttttcttgtttgattagagggttccaattcaatacaagtaataattaattgttcaagcaaactcatagacattgcttctgaaaacaaacgattagaattatattctttttcgattttttgaaataaagagagaatattttggtaagtcttttgatcgggaatagttagcctgcctacattctggattgtattactccagtttagccagtctttccataatgttctggctctaaaatagatccactgatgatgccaagaatcggaatcgggagaacgctgataatcgtgtatagcattaggcggaaataaaaggagatcaccaacattacagtcaaattggtgatctccatgaaaaacggaaccttttccttttatggttaaatttaaaatgtaaccattcataccgtgaggacggtaaataggaaaatcgagttcatttgatttttcgatttgggtacaacctgccactaaataagcgttaaagtcgtaccccggtagtaatggattattttgtgaattctgcttgtgttgacccatattgatctcaatgattttatttaaatattttttgtttatatttatcaaaaatcactgctgtcatcaagatcaaaccgcgtacaacatattgagcaaacggagaaatattaagcagattcattacattctcaatcgtacctaaaataagtacgccggcaattacaaatgaaattctacctacaccgccagttagtgaaacaccgcctaagacacaagcagatattgcggttaattcaaaaccaacggaagtcattggttgtccactagtcattcgggcggctaaaattacacccgctacggcagagataaatccggatacgacaaaaatcattaacttggtacgatctacattgataccggctaaacgagcggcttcttgattaccaccgatagctaacgtattacgtccgtatgttgtcttgctaagtaaaaaaccgaagattataaagcaaacgattgtaaaccaaataggaagaggtactcctaagaaattttgataaccgatttcgaaaaactcttctttagtaataccgacagctttaccgtcagatatgatataacctaaaccacgtgcaatctgcatacttgcaagcgtggtaattaatgagttaatttttagtttggcaataataaaaccatttagtaatccgacagcaatccctaagccaacacctgctacaataccaatccatacactttgtgtttgattgataacaacagccgtaactactccagcacaggcgatcacggatgcaacggataagtcaatttcaccggctgctaaacagaataacattccgcaagccaccataccgctcattgatattgctagacctaaacctttcatatttattgcagttgcaaaattaggtacaaaaatacaagctgcaataaaaattgtgaagaaaatcagtaacattccataagcagtccaaactttgttgattacactagctgattttgcatttgtcataattgtttctgacataatatattcctcatcagtaaaacttctagttattattaaccatagcaagttttaaaataccggcttccgttgcatcttctcgactcacttctcccgtaatttgttgccctttcattaccataattctatcggataaaccaatcacttcgggtaagtcactagatactacgataatggccaatttttcgtccgcaagtttaaaaattaaatcataaatttctgattttgctcctacatcaattcctcgtgttggttcatctaacaataaaactttaacattttcggataaccatctgcctaaaatagccttttgctgattacctcccgataaattcacgattaattgttccacggaaggtgtttttacattcatttgttcacgctgaaattcagcgttttgcttttcccatttatcattaatgataaatttcataaagttatgcaaacgtctagcactgatattgatattttctcccaccgtagcggttggaataataccttcttttttgcggtcttccgggcaaagtacaattccgttagtaatcgcatctttaggagaatggatagttaatatttgtccgtctaattcaatagtaccttgtgtaattttatctgcaccaaaaatgactttaagtaattccgaacgtccggcacctactaaaccaaataaacctaaaacttctccagcttttacatttaaattaaaatctcctttaagcgccgagcctgataaatgagatatttttaaacgttcttcgcctaactctcgagaacgataatggtaaatgtcccctaaattacgtccgaccatactacgaacgagatcatcattcgtaattttggataaatcggaaaacgtttgtacaaattggccatcttttaatacagtgatttcgtcactgattctaaagatttcttccattcggtgagaaatatataaaatgactttcccttcagcttttaactcattaataactgaaaataatttttcaatttcaggcgcggataaactactggttggctcgtcaaaagcaattacttttgctcctcggcttaatgctttggcaatttcaatcatctgccattgaccgatagataaatctttaagctgagtggatggtgaaatattcagttcaagtttatctaaataaaattgagcattttcttccagttccttttggttcacgatgccaaaagtatgtggaaattgccctaagcaaaggttttcggcaaccgtcatttcaggaacaatatttaattcctgataaataatggcaacaccggctaacaaagcatctttggtattacggaaatttaccgttctaccgccaatgtgtaatttcccttgagttgcgggatagttgccacttaatattttcagtaaggtggattttcccgccccattttcccccattaatgcatgtacttttccttcgtaacatttaaatgaaacgccttttaaagctttaacaccgggaaattctttatgaatattgtcaaattctaaatatgcgaccatatatcctccttactgaattcttgttattttatctaaagttaaagaccttttttatccagttccactttaaagttttcacgattaagtaatactggatcaccaataggagtgtattttggcggttctacaccttctttcacccatttgtataacatttccgtactacgatagccatgaacatctgggctaggtaataatgaacctataaaaccggttacttttggcttagaaagctcattaactgcatctgtaccgttaataccaatgccgataacattttcagctttaaaaccttgtccttctgttgctcttactccgcctaaaacggtattgtcattcataccgacaataagccaatttttgacttcaggatgttgcactaacattgaattagcggcatctaaagctcccggaatatcattgctttttgttggagatttataaattttttcagcagggaagccagcttttattaatgcatcaatagagccttcagtgcggcggcgggctgtatccaattcatctgctgtaatagcaagcactgcggtgtcttttacatcccaattacgcttttgcatttctttatagagttcttgaccttgacgttcaccgatttcggttgctgccatcataattaaaggcacattagtcattggctcaccagcggcatttaaaaactgatcatcaacagtaatgactttaagatcataagatctcgcttttgccataattgctggacccagttttggatcgggagtacaaatcacaaatcctttcgcaccattagcagctaaattatctatagcatttaaggttttttctccatccggaacagcaatttttatgatttcaacatcccctaaatcttgagcggctttatcagcaaaacgccattctgtttggaaccatggttcttcaggttgttttactaagaaacctaatttaaggttatctgtagatttagcataggtaaaacctgaatgtaagccactaatagcaagaatggaaactgctaaaagtgattttaaaaaagttcttttactagttttcatataaaactccttaaagttaaatgtaactattaaataacatttctgcttgataaatagacatgcgctttaatatgcaaatggataatagcagtatataaaacgtgtatgtgtgatctgtttcacattatgaatttatagcaaaaaaatccatatattcgacaattaaatccttatgtatcaagaatgagtaatttgtaaaaaattttgcaaatttcaccgctttttttgttcttagaatgattgaatgcttttttattccttttcggtataaaaaaactggtttagtgaattgacatagcattctagacgtctaaaataactagctaatttaatttgatttatagtgtggatatagagttatgattcagctgaaaaatatcagcaaacagtttgaggtaaagggtaaaaagattaccgccttagacaatgtaaaccttgaggtgccgaaggggacaatttacggcgtaatcggggcgagtggtgcgggcaaaagtacgcttattcgctgtgtgaatttacttgaacgtccaacgatcggcagtgtgattgtggacgggcaggatttgaccgcaatgtcggaaaaagagctaattttagctcgccgtaatattgcgatgattttccagcattttaatttgttggcttcacatacggtatatgaaaatattgcattaccgttaacgttaagcaatacgccgaaagatcagatcgagaagaaagtaaatgaattgattgaattggtcggcttaactgaacgtaaagacgtttatccgagcaatttatccggtggtcagaaacaacgtgtagcgattgcccgtgcgttggcaagtgatccgcacgttttattatgcgatgaagcgacaagtgcattagatccggcgacaacacaatcgattttacagttattaaaagacattaataagcgtttaggcttaaccattttattgattacccatgaaatggaagtggtaaaacgtatttgtgatcgagtggctgtgatcgataaaggtcaattaattgaaaccggttcggtcagtgaaattttctctaatccgaaaacggaattggcacagaaatttattcaatcgacattccattacgaattaccggcggaatataccgagcagctttctgagcatcaaacgccaaacgggaaaccgattattaaatttgaatttaccggtcgttcggtggatgcgccgttactttctattgcatcgaaaaaattcggtattgatttcagtatcttaatgtcgcaaattgattatgcgggcggtgttaaattcggttttgtgattgcggaagttaccggtaataatgattcgattgcagaagccaaattctatttaattgataataatgtaaaagtggaggtgttaggttatgtgggatagttttatgcaagaactcacacctcaaatgtggggtttagtcggcacttcaacgcttgaaacgctctatatgggctttgcagcgactttacttgccgtagtagtcggcttaccgatcggtttcttagcattcttaaccggcaaaggtgagattttagagaatccacgtttacatcaggtattagatgttgttatcaatatcggtcgttctgttccgtttattattttgttagtcgtgttgttaccttttacccgtttattggtagggacaacgttaggtacaacggcggcgattgtgccgttaagcgtttcggcaattccattttttgcgcgtttaacttcaaatgcgttattagaaatcccagccggtttaaccgaagcggcgaaatcaatgggatcaaccaattggcaggtggttcgtaaattctatttaccggaatcacttccgattttaatcaacggcatcacgttaaccctagtcgctttaatcggttattcggcaatggcgggtgcagttggcggcggtggtttgggtaaccttgccatcagttacggtgaacaccgtaacatggtctatgtaaaatggatctcaacaattattattgtagcgattgtgatgattagccaaaaaatcggcgataacctcgcaaaacgttacgatcatcgttaaacacaacattaaaaaggagttttcctatgaatttcaagaaagtattaggtgtggcgttagtgtctgctttggcattaaccggctgtaacgaagagaagaaagcggatgctgcacaagcaacgtcaaaaattaaagtcggcgtaatgtctggtccggaacatactgtggcggaaaaagcggcacaagtggcgaaacaaaaatacggtttagaagtggaattcgtattattcaatgactatgcgttaccaaatacggcggtaagcaaaggtgatttagatgcgaacgctttccagcacaaaccgtatttagataaagacagccaatcaaaaggcttaactaaccttgaaatcgtaggtaatacctttgtattcccacttgcgggttattctaagaaagttaaaaacgttgcggagttagcagaaggatctgtagtggcagtacctaacgacccttcaaaccttgctcgtgcattaattcttttagagaaacaaggcttaatcaagttaaaagacaatacaaatttattctcaactacattagatattgttgaaaatccgaaaaaattaaacatcaaagaagtggatacttcagtggcggcaaaagcattagatgatgtggatttagcggtagtaaacaatacttacgcaggtcaagtcggtttaagtgcgaatgacggtatttttgtagaagataaagattctccgtatgtaaatatcattgtggcacgtgaagacaacaaagacagcgaagcagtgaaaaactttgtgaatgcattccaaactgaagaagtgtttggcgaagcgcaaaaacactttaaagatggtgtagtaaaaggttggtaatcatttattgattccaattgttactcaaacaagcggtgagattttatctaaattttgcaaaaaaatgagagaattttaccgcttattttttatctagattgagaggtttactctatgaatatcaaaaaattatttggtttagccgttgtttcagctttaacattaaccggttgtaaagaagagaaagcagcagatacggcaaaagtagaagcaagaacattaacggttggtgtgatgcaaggccctgaagcgcaagtaaacgaagtggcggctcgtatcgcaaaagaaaaatataacttagatgtgaagttggttgaatttagtgaatatactcaaccgaactacgcattaagccacggtgatttggatatcaatgtcttccagtcagtaccgttctttgagcgtgaaatgaaagagaagggttacaaatttgttgcgcaagcaaatacgtttgtatttccaatcgcaggttattcaaaagcactaaaagcgattgctgacttaaaagaaggcgcaaaaattgccatctcaaatgaactaagtacagtaggccgttcattactgctattacaagcaaacggcgtgatcaaattaaaagatccgacaaatctttatgcaaccgaaatcgacattgttgaaaacccgaaaaaggtgaaaatcactcaagtagatacggcattattaacacgtgcattagatgatgtagatcttgcaatcattaataataactatgcaggtcaagcaggtttaacaccggaaaaagacggtgtgattgttgaagcgaaagattcaccgtatgtgaatttgatcgtttctcgtgaagacaacaaagacaatccagcaattaaagactttgtcaaagcattccaaactgaagaagtgtaccaagaagggcttaaacacttccctggcggtattgtaaaaggctggtaataaatgataagcggtaagattttgtggattttttgcaaaaattaccgcttttttctaaatgaaggagaataaaatgaaattaaaaaatgtattaagtgcagttgcaatttgttcggtatttttaaccgcttgtaatgaaaaacaagaaaaattaaaagtcggtgtgatttcagggccggaacttttctaaatgaaggagaataaaatgaaattaaaaaatgtattaagtgcagttgcaatttgttcggtatttttaaccgcttgtaatgaaaaacaagaaaaattaaaagtcggtgtgatttcagggccggaacatcaggtaatggaagtggcggtaaaagtcgctaaagaaaaatatcagcgtgaggttgaattagtggtgtttaccgattatgcgacaccaaacgaagcgctaaataaaggcgacttagatttaaatgcgtttcaacatcaaccttatttagataatcaaattaaagaaaaaggctataaattggtttcggtcggtaattcatttgtctatccgattgccgcgtattctaagaagattaaagcgctgaatgaattaaaagacggagagacaattgctgtaccgaatgacccaactaatttagctcgtgcattaattttgcttgagaaacaaggcttaattaaattaaagccggaagccggtttaaaagcgacaagtgttgatattattgaaaatcctcgtcagttagtgattaaagaaattgaagcgccgttgttaccaagaacgctggatgatgtaacattttcagtgattaatacaacttatgctgggcaaatcggtttaacaccaacaaaagatggtttgtttgttgaagataaagattcgccttatgtgaatatcattgttgctcgcacagataataaagattcagcagcagtgcaagactttgtgaaagcataccaaacggacgaagtgttcaataaagcgaatgaagtgtttaaaggcgcgatgataaaaggttggtaatagaagataagtggctgagtgtttactcaaccacttattttattcccttaacgcatcaatcacgcacttcagcgcaggcgaagtattccgatgagggtaataaagatgaaagcctgtaaaggtatagctaaattcgcttagcacttgaatcaattcgcctttttccaactctttctgaaccaaatctttacagatatagcctagtcctaatcctaatttcgcagcatctcgaatcgaataatcattagaaaatgtccattgtccttgtgttttgacctgaatatgctcgtgattgacgatgaagtcccaatggtacatcgctccgctggcgtagcgataatttaagcattgatgatgagctaaatcagaaggcgttttgggaaatccgtgagtatgaaaataatcaggtgatccaatagccgccatttcttcatcgttgctaattctgactgcaatcattccttcagcaactgaatcgccaaagcgaacacccgcatcaaattgttcggaaataatatcagaaaaagcggtatcgctgattaattcgagctgaatatcaggatatcgtgtttggaatttagcgagtttaggtaataacactttatcaatcgcatattgtgaggctgtgattcgtacctgtccagacggagtttggcggtaatgctctagcattgctaattcgtgatcgagtttagaaaatgtttgttcagcagtttgaaaaagctggttacctgcgtgagtgagtgataatcggcgggtggttcgagcaaaaagttgtatacctaaacgagattccaactgtttaatggtacgacttaacgcagattgtgaaatacctaatttagtggcggctttagtgaagttttgttcccgtgcaacacataaaaatgcatacagatcattatagttttctcgttgaagcataatacaagtcttatagtaaaaaataggagaaatttaaccgctattttacctgatttagaacctgaataaataaatgttattgaatttttggtcattatcatttgaatggaaatttttataatgcacacatcttttgagatgattaatgaggaaagcaaatgaaaattcgtacaaaattaactgcactttctagtgcacttttacttggttctacatttatcggaggcaatgctatggcaaatttaccgcaatcagcaacggtagttgaagttcccgctcaaactatccaacttactcaagaatgggataaaacattcccaaaatcagataaggtggaacaccgtaaagtaacctttaaaaatcgttatggtattactttagtgggcgatttatatgtaccgaaaaatgctaaaggcaagctagctgcgattgcaataagcggaccatttggtgcggtaaaagaacaggtttcgggtttatatgctcaaacattggcggaacgagggttagtcactattgcgttcgacccgtcttataccggtgaaagctcgggtacacctcgaggtatggcatcaccggatattaatagtgaagatttgtctgccgcattagattttcttggcaatttacctgaagtagatcgtgaacgcttaggattattaggtatttgcggatttggcggtatgagtattaatgcagctgctatggatagtcgtgttaaagcgcttgcaacctcggttttatacgatatgagccgttcaataggtaaaggtgtcggtaatcaacaagatctttattcagctaaagaccgccaattagtgaaagcctatttagcgaatcaacgctgggcagatgtggatagtggcaaacgtgccgtaggtatgcatgagttgccaatcattaacggtaaagtagaaggaagtggcacgcgtattttaccggaaaccaagccggtggatttccctgatatgtgggcaggcttttttgattattaccgtaccgagcgaggataccatccccgtggaattaattccaatacagcttggttagcaacaatgccactatcgtttattacgatgccaatggatacttttgttcatgaaatttctgctccggtgttaattgtggcaggtgaaaaagcccattctcgttatatgagtgaagatatttttgccaaattgacagggacgcaaactaaagaattagtgattgtaccaaatgcaacgcatacggatttgtatgataacgttgcaggcaaaattccatatgataaatttgaacagttctttaaagctaacttgaaataataacaagcggtcaaatttctctaaacttttgcaaaaatgagaggaatttgaccgcttatctttttgaaaaccggagaacaaaaatgcaatacgctgttgatttacccatcgataagttgattcctcaaggaagccaaatttttgaagatattcatcgaattgttgcagaaaatgcccctaaaattgctgaattatcaggagagtttcaaacacaagagaacattcaacgcctcttgagtgaaattactcaatcgcaaattgacgaaaccttgtacgttaatttaccgttatatagtgatttcggtcgtcatcttcgcattggtaaaaatgtatttattaataccgcttgtgtgtttaccgacttgggagggattacacttgaagataatgttttgcttgccccaagagtaaatattattacggttaatcaccctacagctccgaaaactcgtcgtggtgtgatcgtcaaacctgtaataattaagcaaaatgcttggattggtgcaggagctacgattttacctggcgttacggttggtgaaaatgcgattgttgcggcaggtagtgtggttactaaagatgtgccagcaaatacgatagttgctggagtgcctgctaaaatcattaaaatgattgatgaggttagcaatgaaaattaggtttctagttgggttgattttcagtttatgttttagtccgtttttacaggggaaaatgatgcaaattacgataggacaacaaattttcgaagcagaattagccgataccgaggctgcacaacaacttacagaattgttacctttaacattggaaatgcaagaccacctacgcaatgaaaaatttgcagaattacctaaaaatttgaccgcttatgatcacgcagttggctcaattcaaaccggcgatattttgctttggcaaggaaatacattagtgattttttatgagcgttttgataccccttatcattatactaatattggtaaaattcataatgtgaagggattaaaagaagcgttagggaaggggagtataaaggtttcttttgaaaattaactataatacgtgaactttgtatatttcaaatagctaaagaagaaagcctttcaaactttcttcttttttattaataacgttatttatggtaacccgcgagcaaggcttgccaattttgctcgttaaatcgaatatttaaacgagtttgctcctttttaaacgaacgtagtaagcgggctaagttttccgatttccaatcattagtttgtgaaatgccacatttatcgaaatcaattaagaaaaattgaccgcttgttggctcaagcaaaatattatggatatttaaatccgaatgatgcacttgatgatcgtgtaattggcgaatcagtttaccgatttgctgatattgcgtgtcggaaagtgtgtgagtttggagatatttactcaaatcttgcgtcccttcaattttttccagcatgatgtcagcacgataccaacaacagtttttttctacttttaatgcaacagggcgggggacgggtaaatgccattcgtgcaatttttccaataaggaaaattcttgaaacgctcgggtgttttccaacccattaaatagatactgatctttgacgattttgccgaatagcccacctcgatagtaatgacgaagcaccacatttacacccaattcggcttgagtgtttagaaaccaagtaatgcctctgcctttggatgaacctaacaagcggtcagaatcagcaaaatttttgcaattaagtaacgtttttagtgtttctatttgtgtgtgagggacaagtttggcattaaagtggtaaaaaatcatacaagttatttagattggttatcattaagttaaattttagtgctattttttttgatgtcaatttgttaaaattcctgccttaatttttagaggaaacccaatgagcattatctccgcagaagcccaaaaagtgcgtgaagccttaattgcgaaaggcattgaaaccccaaccattcaattaactaaagataaagattcccgtcgtgcagaaattcaacaacatatgcgttcggtaatggagttactcggtttagatttacaagatgatagtttggaagagacgccgcaccgcttagctaaaatgtatgtggatgaaatttttagcggcttagattatgcgactttcccaaaaattaccaatattgaaaatcgtatgaaagttagcgaaatggtattagtggacgatattaccctaacttccacttgtgaacatcattttgtaacgattgacggtaaagtagcggtagcgtattacccgaaaaaatgggtgatcggtttatctaaaattaatcgtgtggtgcaattctttgctcaacgcccgcaggtacaagaacgttttaccgaacaaattctaaccgcattccaaaccattttagaaactgaagatgtggcggtttatgtaaaagcaacacatttctgtgtgaaatgtcgtggggtgaaggataccaatagctatacggtaacgtcggcatttggtggtgctttcttagaagacagagaaacacgcaaagaatttttgggcttaatcaataaataatcagtgggcgaaagcccacttttgctatatagaatagagcaatgagaccgtagcaagcggtcaaaaaaacgagaaattttacaaatgaaaatagcgttaggcattgaatatgacggaagccgttatttcggttggcagcgtcaagatgaagtagagagcgtgcaacaaaagctggaagaagcattgtcggttgtggcaaatgcaccggtagaggttttctgtgcgggacgtacagactccggcgtacacggcacggggcaagtggtgcattttgaaacggaagcggtacgcccgctacaaagttggtgcttcggtaccaatgcgaatttgccggacgatattgcggtgaaatgggcagtagaggtaagtgaagattttcacgcccgttttagtgctacggcgagacgttatcgctatattatttttaataacaaactgcgttcggcaattttgccgaaaggtgtttcacattatcaccatgagttaaatcatcaaaagatgcacgaagccggtcagttcttattgggcgagaacgattttagctcgttccgtgccgcaaaatgtcaatcacataccccttggcgtaatattcatcacctgaatgtaagccgattaggcaattatattgtggtggatattcaagcgaatgcttttgtgcatcatatggttcggaatattgttggaagcctgattgaagtcgggcagggcagacagccggtggaatggattcaatggttattagctcaacgagatcgtacgttggcggcaccgaccgcaaaagcggaaggactctatttagtggatgtgcattatccggagcattttgggattcctaaaacggcattaggtccgttatttcttgcggataattaataaaaaagccaaatcaaattttgatttggctttaaagttagtcacgatttattgagtcgttattgtacgctttttaacgtgttatcagtacgacgtgcttcatttttatgtactaatttatttaattgcgtttcaagttttgtttcgacttcgttaattgctttgtataaatcttcgttatcagccttcgcaaaaagttctccaactggagtgccaatcgatgcctcaacttcataaccgttcggcaatttatgaatcataaagtgcgggttaattaattgagtttgccatttttcgagtttcgctaagcgttcttcaatatgggtacggattgcaggagtgatgtccatttgtttacttgaaatattgattgtcatagcattttcctctttgtgaaggggttattaagttgatttcaaaatatgacttttgctccaaaatatcaagtcaaaaaatgaagcaaaatttaaaaatttgatctagttaacactttttctgtgtttttgattataatctatccgaaacataaggatgacgaaaaatgacggatacccaaaaatttcctccatttgaatggcggtttttacaccctagatattgggggctttggcttggattgggcctatttaaattaattttgtgtttaccttatccagccttggttgtagtgggtaaagggcttggaaaactatttgccaaacttggtttcggtaagcgtagaatgcgtattgctcgccgtaatttagaactttgttttcctcagtattcagcggaacaaattcaaactattctagataaaaatattgaatcggtcggtatggcgatcatcgaaaccggtatggcgtggttttggtcggacaaccgtatcctaaagtggtctaagattgaaggcttagaatatcttaaaaatcagccggaaggtgcgggcattttatttgttggcgtgcattttcttacgttagaaatgggagctcgcattgtagggcttcatcaccaaggcgtgggcgtttatcgaccgaatgataatccgttattagattggattcagtttcgaggcagagtgcgttcaaataaggcaatgcttgatcgtaaagacttacgcggtatgattcgtgcattaaaagcgggtgaaacgatttggtatgcaccggatcatgattatgggcgtaagaatagtgtgttcgttccgttttttgccgtgccggaagcttgtactacggcaggtacgcgtatgctattgcggtctgcaccgaatacggttgttgtaccgtttagtccaattcgaaatgatgacttttccggatatacggtaaagattagtccagcggtcgattttagcgaatgtgaaaatgaactggataccgcaacgaaaatgaacaaggttgtggcagcggagattcttaaatcagtaagccaatatatgtggttacatcgacgatttaaaacacgtcctcaagaagcggataaaagtttatatgattaaaataaacccgacatttatacttatagtgtcgggtttatttttaatagggtgatttaaataaattttttagtggttattcgcaaaaagtacttgcatatttaaagcgaattttgcaatctaacaaataaacattgcacataacaaaaaagtacaggagatgattatggcgacccctttatttcacggcagtattgttgcacttgtcacaccaatgactcatggcgaagtaaattatgaagaattaaaaaaattggttgaatatcatgttcaagccggtacacacgggattgtgtcggtaggaacaacaggtgaatcaaccacattaagcatcgatgagaatgtgaaggttatcaagaaaactgtggaatttgcggatggacgaatccctgtgattgcaggtactggttcgaatgcaaccagcgaagcaattattttaaccaaattgttaaccaatagtggtgttgcaggctgtttaagcgtggttccttattacaataaaccgactcaagaaggcatgtatttacactataaagcaattgctgaaagtaccgatttaccacaaattttatataacgtaccgggccgtaccggtagcgatttaaaaccggaaactatcggtcgtttagctgaaattccgaatattgtcggtgtgaaagaagcaacaggtgatttaactcgtttacctttaattaagcaattagccggcgaagattttattttcttaagcggtgacgatgcgacaggtttagaatcaatgaaacttggtggtcaaggcgtgatttcggtaacaaacaacgtcgcggcagcagatatggcaaaaatgtgcgaacttgcattagccggtaaatttgatgaagcggaagttattaaccaacgtttaatggcattgcatcacgatttatttattgaagcaaacccgattccggttaaatgggcagcttataaattaggtttaatcagtgaaccgaatttacgcttgccattaactactttatcggaaggcgctcaaccagccgtattagcagccttgcaaaaagccggtttaatttaaccgcttgttattcgtaatatgaagaccccgtatttgaatacggggttttttattagacaagcggtcaaatttgccgaaaaatttgcaacatgccgtttagaaaagttcgacgactttagcaaataccataataacgccataagtgagcggcacggtcacaataatccaacgtagccacaccatacaaccgccgtgagcaacttcttcagccacaagataagtatctgagatcaccgtttcatcactcggcttagcactatatgcagcctctttaatcggcaattcatgatgtttttcgtgcacggctttcacacttaaattacagaagaaaccgacaattaataacgccgccataatatacatagtaatgctgtacgcttgcgctgccggtacgccgctgtcaatttgcatttggcggatatagttcactaatactgggcctgccactgcggccgttgaccatgcgagcagaactcgtccgtggattgcaccgacttggtaagttccgaataaatcacgcagataagctgggattgctgcaaaaccgccgccatacatggaaatgatcacacagaaaccaaccacaaataacgctttattaccactttcgcctaatgacggaacggcaaaataaagtaccgatcccaataagaagaaaatagagtataagtttttacgtccgattttgtccgaaatactcgaccaaaagaaacgtccccccatattaaataagctgagtaagcctacaaatccggctgccgctaaggtgctgattgccgcttgtttgccgactgaaatttcggagaataattcctgaatcattaccgatgcttgaccaagtactccgatacctgccgttacatttagacataaaatccaaaacaataaccaaaattgtggcgttttcattgctttatttacgccgacattgtgcgagctgaccaatttatttttaggtttgttatcgacaaaacctttcggtttccattcgggatgcggcaggcgaatagtaaagacaccaaacatcataaaaatgaaatagaacacacctaaaacaataaatgtttcaacaataccgaccgaggttgggttgctgaagaaatccattaatgcaaccgaaatcggcgaagcgagcatggcaccaccgccaaagcccataatcgctaaaccggttgccatgcccggtttatccggaaaccatttcattaaggtagaaaccgggccaatataaccgagtcccaagccaataccgcccagaacaccgttgcctaaatataacagccacagattgtgagtgtgtacgccaaatgctgctacgagaaaacctaagctaaaacagatggttgcgacaaacatcgctttacgagggccgacacgttccatccatgtgccaaatagtgcagctgaagcgcctaatacggcaagcgcgatactaaatacccagccgattgttgtgagtttccagtcatccgcagctgattgagtgatgccgattaccttggttagcggcgcgttaaataccgaataagcataaatctgcccgatagataagtgtactgcaagagcagcgggaggaattagccagcgattaaattgcaagggggcaattgtcttttcacgatctaaaaatgacatggagactccaagttgtattaacaatgatttaacattagtataacattaaaatttatttgcgcaaacgtttgcgcaaataaattagcaacaaaaaagcctcttggttgaaagaggctttgaatgctaaatttataggaaattagaccgcttgtaagtgtgcttcgtaagcttgtagcgtattttgcatcaacatcgcaaccgtcattgggccaacgccgccgggcacaggagtaataaagctggctttaggttctgccgttgcatattccacatcaccgactaacttaccgtccacacgattaataccgacatcaattacaatcgcaccgtctttaatccattcaccttttacaaagtttggtttgcctacaccagcaactacgatatctgcttgcgagacgtgataagctaaatctttagtacgactgtgtgtgactgtaacagtacaaccggcaagtaataattccattgccatcggacgacccacgatatttgacgcaccgacaacaacagcgtgtaaaccggcaagattcacaccggtactttctaataatttcattacgccgtatggggtgcaagaacgcaaagtgggaattttttggcataaacgcccaacgttataagggtggaaaccgtccacatctttatgcggcacaatcgcttcagtgactttagtcgcatcaatttgcttcggtagcggtaattgtaccagaatgccgtctaccgaatcgtcatgatttaattgctcgataattgccagtaattcggcttcacttgtatctgccggaaggtcgtaagatttcgattcaattccgatttcagcacagctttttcgtttactattcacataaacttgagaagcaggatccattcccactaaaattacggctaaccccggtttacgtttgccttgcgccgtatgggcttgaatttgttcggcgatattcgttttaacttgcttggctactgcggtgcctgaaatgatttgtgcggtcatagtttctcctgtctggatgtgaatagttgaagaccattctattctgtcagaaaaaaggtgatttgcaagtgagagatgagttaatttattgtttacagttgcgaacaaagttcaatcaatcgaactgcgattgtcaaaaaagggattgacgagattttagataagtctataataaatatcacttttcagtcggcgagtagcgcagcttggtagcgcaactggtttgggaccagtgggtcgtaggttcaaatcctatctcgccgaccactttatctttcataaatatttcttccttatatttatttcacttgcgcccttagctcagctggatagagcaacgcccttctaaggcgtgggtcaaaggttcgaatcctttagggcgtgccatttaatccttttaaaattaattctttaatctcctatttaacattgctttatattgtcatattttgggattgtgtcacgaattttacgtttgctgcgtgtactaacaaatggttggcttttgagttaagcataatatttaaaacaacaagcggttaaatttaggaagtcttttgcaaatttttcccaaaatttaaccgcttgtaatgagtttgaaaggcgcgtttaccagctaccgcctgcgccgccaccgccggaagagccaccgccgaagctgtcaccgctacctcggcttccgccaccaaacccaccgccgaagccaccggaagaatcgcctccaaagccgcccccaaaactacctctacgacgagatgaattaatgatgattctacctaattgatccgcagcactcgggctaatatattgcgtatttctacccgggcggaagattaagaaaattacaataccggcaacaaggaagaacagtaaaccgtcaatttgctctaaggattcttcgcctgcgtcttcgccataactatcataagccgcatattcgccgttaattgccgccataatcgccgataaaccactagcaatcccttccgcatataagttttgtttgaagtacggcgtaatgttatgacgaataatggttgaggcaatcgcatcaggcaatacaccttctaagcctctgccggttgcaataaacagttttcgatcgtttttggcaatcagtaataatatgccgttattttcattatttttggtgcgaccgatgccccatttattaaataagttatgcgaataacttgcgacatcctcgccattggttgacggcacaattaccacaataatttgcgagctggttttagcacggttggcaattagcgcatcttctaaggttcgccattcttgttgagttaatgttttggtgtaatcggtcacataataaaaaggattcggtgcagcagggtagttatccgcagcagcggcttttaatgtgaaaaatgccaacaggataaaccaaatcggcttaaagaacgcttttatcatttaatcaccacctcatttgacaattcattcgtatcatcatcacgacgaggaaaataagcaactaactgtgcttctacttgtttaatgccgtcacaaattgcttgagtataatccgcttgttgacattgttgtttcatcgcatcataaactgattgccaaaaaacttgaccgactttttcatgaatcgccttatcaccgacaatcgctaaattgtgcggtttgaacgagaggtaaatcagtacgccgttacgatctgccgtttctcgcatctttaattcatcgaaaagttgattggcacgagccatcgcatcgattttttctttggttttacgttcaacgactacgcgtaattcggcagatgtttgatgttctaaatgtgaaattgcctgttcgatacgctgagtatcaacaggcaatttatttgaaagaaaagaaaataatttcatagagttatcactaaattcacaaaaaacacggaatatttttaagtattccgtgttttgtgtaagaaattaattaaagtttactgttggtgctttttctgaaccagcttcagctttgaattgtggtttagctttaaagcccataatcatcgcagcgattttggttgggaactcacgcacttgtttgttgtattctttcaccgcagcgttgaagttattacgctcaacattgatacggttttccgtaccttctaactgagcttgaagatttaagaaaccttcgtgcgcttttaactcagggtatttttcaactgaaactaataaacgagaaagggcagaatttacgccttgttgcgcttcttggaatttcgccatttgttcctcagtggcattgtttggatcaatggtcactgcagtcgctttggcacgagcttcaatcacagaggttaaggtttctttttcaaagtttgcttggccttttaccgtgtttactaagttagggattaaatccgcacggcgttggtaagccgattccacattaccccacactgagttgatatcttcttccgcacgcattaagtcgttatatttcgttaaagagaaaccgccgactgcaagtacggcaattactaagatccaaaaaattttcttcatattaaaaagtcctatttaaggttaaaaaaacgggcggatcttataggtaagcggtcgaatttcctagcaaacttacaaaagttttcagatagaaacataaattacttgcataaataaccagtatcggataatctttcctcgtggtggtagagacgccccacgtaaaaaactaaaagctcgattgaaatctgtggcggtaggttcgccccacgtaaaaaactaaaaggccaaatgaaattacacccacttttatagtgggtgttttcgtataggagactacgatgccaaaggcaatagaattttataaactaacagaacaattttatattgataataaagataatacgcaaattttatttaataaaggtgggagaggttacggggttattctcgttaaaattctaggctgtgattttgcaatacctcttcattctaatattaaaaaaggatttatattagggatcaaccaagaaacgggtattaaacacggattggattatctgaaagcaatttgtattacggataaaaccaaatacattggtgataggtattatttaaaagagcgccaagagtttaataaaattaataatgcgcaaaagcatatcattcaagaatttgagaaatttgttaaaaagtatattaaagcggtacaggaacaaaatgaaaatattctaaggacaaattatcgtaatactacgttagtttattatcatcatttattaggcattactactaaataaaaacggagctaacaagctccgttttttactgcaaaagaattattctgatgctttttgtttgattgctgcgtaaatcacaccggttactactgagccgattgcgattgccgctaagtacattaacggttgtgaaacaaatggaatcacaaataaaccaccgtgtggtgcttggagtgtgatagcaaatgccattgagatcgcacctgcagttgcaccacctaacacagaactgataattacacgcacaggatctgccgcaacaaacggtaacgcaccttcagaaataaagcataaacctaatacgaatgacgctttacctgcatcgcgttggttagaagtaaatttattacgagcgattaatgttgcaatcgccataccgataggtggaaccatgcccgccgccatcactgctgccattggcgtatattgttgcgaagcgattaaaccgacaccgaatgtatatgccgctttatttaccggaccgcccatatcgatacacatcattgcaccaaggattgcacctaagataatcgcattcgcttgacccattgaatttaaccattcaactaaagcatccatgatgccttttaccggtgggttgatgaggtaaatcatcgctaagccgacaattgcagaacctaataatggtagaatcaaaatcggtttaagcgaagttaaacttgccggtaattgaatcacgccgtttaaaaattttacggtataacccgcaaggaaaccggctacgataccgcctaaaatccccgcaccggctgtagtggctaacataccgccgattaaaccgactgctaaccccggacggtctgcgatagagaaggcgacataaccggcaaatacggcgatcattaagtggaatgctgcgccgccaccgatatccattaacgctttcggtaagccgcctgcgatggtttcatctttgaacgcttcaataccgaacataaatgaaatcgcaattaataaaccaccggcaaccactaacggtaacatatgtgaaacaccggtcattaagtgtttatataagccttttttctcaccgcttgctgaaccttcagcttgttgtgcagccgttgtgccaccttgataaacggttgcttgtgcaaacgctttttcaaattcttgtgccgttttcttcaacgctaaaccggttgaggtacggtacatcggtttacctttgaatttatctaaatccacgtcaatatccgccgccacaaagactaagtctgccgctgcaatttcttccgcagaaatcgggttacccgcaccaacctgaccacgcgtttcaactttaacgttccaaccttgcgctttggcatagttttcgatagcttccgcagacataaaggtatgtgccacaccagtcgggcaagcggttactgctacgatgtttttcacacctgaagaggatacgcttgaagcagttgcatttgcaaaagtttttgcattttcgaccgcttgtttaagcgttgcttccggttgagcaaaagcttggtctaagttcactaccgcaccttgtttgccggcagcacttgtaggaatttcatcgttaaataacacgacaaaatcagcttgttcagcgtttacaacttgatggccttgttgcttggctgccgctgataatacttcattcacgaggaaagcacgggctttacctaatgattgagggaatacaaaggaaatattcattttgagatccttataagtttgagaaaatttattccgccctcttttctaaagaggggaatgttgttacaaattattaacgtaattgagttaatttcacctgcgctacaatttcatctagggcttttcggtcgctgatacccacattactttgtgatactgctaatgccgatgtaccgcttgcgaaggcgagggtttttgctttatcccaaccttgagaaagcccataaattaagcctgccaccatggaatcgccggctccgaccgtactcacaacattttggcagcgaggcggttgagcttgaaccacgccttcgctgttaagccatacggaaccgtctgcgcccattgaaataattacgttctcaataccgccggcacgcaattcttgtgccgctgcaatcacttcttctaagctatttaacggacgattcgcccaaacttctaactcacgacgattcggttttactaaccacggatgggcttttaaaccttcggttaatgccgcattgctgctgtctaatacaacttttaagccttgttggtggagtgattccaaccattgtgagaattgttgtgccgttacaccacgagggagtgaaccgcataccgccaccaaatcaaactcttttgcccattgctgtgattgagcggtaaagtttgcccaatcttcggcgctaatttcaaaacctaagaagtttaagtctgtcacatccgcttcggtttcggtaattttcacgttaatacgcgttttaccgtcaatacgatagaattgatcgtccacaccgttttgtttaaacgattgaacgaaatcgccttgattttcagcgcctaaaaaaccggtaactgctaatttaacgccgagatccgctaatactttcgctacgttgatacctttaccggcagggtataagcctaaggtttcaacagtatttacttcacccacttcaatgcgttgtaggcgaccgaccaagtcaaatgccggatttaaggttacggttgcaattcgtaattgttgtgtcattgtttgttcctcaattactcgcctaaacctgcagcaatcgccgcaccgataccatcaatcgctttttgagcgtcatcaccggttgccacgaagcgtaagcggtgaccttttactacacctaatgctacaattttcattaaacttttcgcactgactaattggctatctcgatctaagttttgcacaacgatagtcgcattatattttttcacttcgttgactaacaccgcacttggacgagcgtgtaagccgtgttcgttttgaatcacgaatgtaccttccacttgcccttccacttgaccttccaccgtaggctcagaagcggtcggatttgcagaattttttgcagattcaaccgcttgtggttgtgcagcaccttcaatcgtatcttcaaccgcaggcacgaatgaaacgctttcgcctaaaccttctacgaatgcttttgctaatgcttcgatcgcttgttgagcatcttcaccttctgccacaaaacgtaagcgatgtgcttggcttgcacctaacgccaccactttcatcgtgcttttcgcatttgccggtgcagtacctcgatctaggttttcaacggttacttttgccgcaaacggttttaaggtttgcactaatactgcgcttgggcgagcgtgtaaaccattgtcgttacgtacggtgaaagttccgataacctgacccgccaccggttgttcggaagcagtcggatttgcagaattttttgcagattcaaccgcttgcggttgtgctgcgccttcaatcgtatcttcaaccgccggtacaaatgaaacgctttcgcctaaaccttctacgaatgcttttgctaatgcttcgatcgcttgttgagcatcttcaccttccgccacaaaacgtaagcggtgtgcttggcttgcgcctaatgccactactttcattgtgcttttcgcattcgctggcgctgtgccacggtctaagttttctaccgttacttttgccgcaaacggttttaaggtttgcactaatactgcgcttgggcgagcgtgtaaaccattgtcgttacgtacagtgaaagtaccgataacttgttggctggtttgttctgctgctgttgagcttactgctgaagccgcattttcatttgcgccaaagagagcgatgatttgtgctgctgacgctgtggttaattgtttgcgaatatcggcatttaataaacgtgcgataagtgcagaaaggttgttatctgccgctgcgatagtgactaaagtttgtccttgttggctacgtgccactgcaaagccgttcgcttgattaccgtttgcagagtcagttacaaaaagattgttacctaggtttagaggagagtttgcaaccacatcgctaataaatgcttgtgttacatagcctttttcttgaagttttgccgcattaatggcagaaagtgtaataagacttgcagaatcgatatttaatgaaatcgtttcttctgaaataacaggaagtgattttttaccgcttaacactgcagcaaactcttcgacatcttgcgttttagctaaggtctctgccgcatcttcatcacttaatacgccggttaattggcgaaggagagccaagtgttcgtcagattttgctgcaataccaatcacgacataggctttattgccttcgccccattccacaccttgtgggaattgataaatttgtacaccggtattttgtacaaggtggcgagtatctaatgtgccgtgaggaatggcaataccattaccaaggaaagttgaggtttgcgtttcacgggctaacattcccgtttcgtaaccttccgcaacgttaccatttgctacaaggcctgctgcaacaagcttaatcgcttcttctttgttgctagcagtaccatttaaacggatattttgtgccgataaatttagcatctgagctccttattggatttaattttaaaaataaaaatattgctacatattgtaccccataatctgctaaatcgttctagctgattaaaaaaaatgtcaaaaagtgtgaactagttcgcatatattgcgaaaaaaatatgatgtaaatcacaaaagcgcatagtttttcggtgaggtttttattttaatgttaaaatgcaaacgttttcgtcagaaaagaaaaataatttagagtgtaaaaaaatgaggaagcaaataatgacaacttataattattcagaacaagattcgtcttttattgagcagctttccggtgggtattgcaaagacccgttttcctatttgggcagtcattttgaaaatggacattgtgtgataaggatttatttacctgaagctgatgccgttaagattgtggatgaaaaggggcgatgtttatccgacacgctaaaaattgatgattgcggcgtttttatcgctgtgcttgattgttccgaccctcatttctattaccgtttacgcgttacttatcctttgggtgaaattgatattgaagacccataccgctttaaatcctccctattcgaattagataattggttattatctgaaggcactcatcttcgtccttatgaaaaattaggcgctcattttgaaatccaagaaaatattgacggtgtacgttttagtgtttgggcgccaaatgcaaaacgtgtttctgttgtcggggattttaattattgggacgggcgagtacatagtatgcgctttcacgcagaaagcggtatttgggatatatttattccgaatattgatgcaggagcattatataaatttgaattattagatagccatggtcagctgcgtttgaaatcagacccttacgcctttgcttcacagcttcgccctgaaacggcttcaatcgttaccggattatcggagattgttcaggttgaggaaaaacttcgccgagcaaataatattgatcaaccgatttcaatttatgaagttcatctaggttcttggcgccgcaatttagaaaataactattggctgaattatgatgaaattgccagtgaactcattccttatgtaaaagatatgggattcactcatattgaattacttcctattaccgaatatccgtttgatggctcttggggttatcagcctattggactttattcgccaactagccgcttcggctcgccacatgatctccgttcgtttatccgcaaagctcacgcagcgggcattgcagtgattttagattgggtggtcggacattttccaaccgattcacacggtttagtgcaatttgacggttcacatttatatgagcaccaagatccgagagaaggctatcaccaagattggaatacgttaatttttaattacggtcgtaatgaagttttcaattatctctccggcaatgcgttgtattggacggaacgtttcggcattgacggtttacgtgtggacgcggtttcttcaatgatttaccgagattactcacgtaaagacggtgaatggattccaaaccaatatggcggacgtgagaatttggaagcattggattttttacgccgcaccaatcaaatgcttgagcaagaaggtcatgctgcggtgacgatagcagaggaatcgacctcatttaacggcattacgcatgcggtaagccagcaaggcgtaggttttgattataaatggaatatggggtggatgaatgacacgctccgttatatggcgttagatccgattcatcgtaaatatcatcatgactggatgacattcggcatgatctatcaatatagcgaaaaatttattttgccgctttcacatgatgaagtggtgcatggcaaaggttccttaattggaaaaatgccgggcgattgttggcaaaaatttgcgaatttacgtgcttattacggctatatgtggggctatccgggcaaaaaattactgtttatgggtaatgaattcgctcaaggacgagaatggaactttaacgaaagtttggactggttcttgcttggtgaagaaggtggcaattggcataaaggtatgttgaattgggttcgagatctgaatcgtgtttatcaacaatatccggcgctttatcaacttgatcatgagcctagcggttttgagtggctggtagtggatgattggcaacaatcggtattcgcttttgaacgtaaagcgaaagacggttcaagcgtgattgtagtcagtaatttcacgccgatcgtgcgctataactaccgtattggtgtcgcacaagacggggtttataaagagatactcaactcggatgcggcttattatgccggtagtaatgttggtaattacggtgagattctatgcgaggaagaaccgtcacacggcaagccttattctctcagcgtttcattaccgccgttagccacgatttttattgtgcgcacagcaaaaccggaagaggaacaagcgctgattaaaaaggtagaaagcgcatttaaaaaaacgaaaaacgctaagaaaaaaagaaaaagtaagaagtagcagatgaaaatatcagtgggaaagccgttccctcttggtgcacaagcgggtaaaaaaggcacgaattttgcaattttttcagcaaatgcgaccgctattgagctgtgtatttttgatgataagggcgagcagtgttatccgatgcagcgtagtggcgatatttggcatctgttcgtttacggtgttgggagtggcaccttatatggctttagagtttcaggcgatgttgatgagcaaaaaggcgcattatttaatccgaataaattgttgcttgatccgtatgctaaacgagtagtcgggctacccgatgcgcatgatgagaaggcgttaagttattttgtttggaatgacccgcaagataatgctcaccttgcgcctaaatcagttgtggtaaccgatgattttgattggactggtgaaaaacgtccgcattattcatgggcggaaacgattatttacgaagcacacgtaaaaggctttagtcgtttaaatcataatattccggagccgttacgcgggacttacgcaggtatggcgcatccggcatcgatcgcacatttaaaacggttaggcgtgacgacgattgaactgcagccggtgagctaccatgcggatgaagtgcatttacagcgattagggctaaccaattattggggatatagcgttttagcgcattcggcaattgatccttgcttagcctgggaccaagaagatccgctttccgagtttaaatatttagttaaaaccttacaccaaaatggctttgaagtaattttagacgtggtttataaccacacggtggaagccggtaaagacggtatgatgctctgccaaagaggaattgataaccaaagctattattggctggacgaacaaggcgaatatcgcaattggacggggtgtggcaacgcattaaatttagttcatccgatggtatgccaatgggctgtcgatagcttagtttactgggtggaagaatgccatattgatggtttccgttttgatttggcgacaacattagggcgaacgcctgatttctctaatgttgcaccactgtttgaaaaaatcaaacaaacaccagcattgcagcagattaaattaattgcagaaccttgggatatcggcccggaaggctatcaagtcgggcattttccggctggatttgccgaatggaacgataaataccgtaccacaatgcgtagctttttcttacgtgaaagcggcaatttagccgaatttgctcgtcgtttagcagggagtgacgacttatattggcaatatgcgccttctaaaagtattaactacttcgcctctcatgacggtttcactttgcaagatctcgtgagttataacaaaaaacataatcaggcgaatggcgagcaaaatcgagacggtgatgaacataattatagtaataatcacggtgtggaaggggatacggataacgaattggtaaatattttgcgagatcagaccgcttgtagtttgcttgcgacactgtttctctcaaatggcgtaccgatgctacgtgccggcgatgagttggggcattcgcaaaaaggcaacaataacagttattgccaagataatgaaacgacttggattaattggcagcagacgaatgataaacgcatcgactatgtcgctaagtggattgatttacgtaaacaaatttcgctgctttcccaccaaagtcattggtggacagaaaatgacgtgcagtggttttccgcatacggtgagattatgcaagtggacgattggcataaccactcacttaaagcattacaaattcttcttcaagaacaatggcttatcttaattaatgctaaaaaagataagcaacaatttttcttacctcaaggtaaatggcatttttaccttgggaaagaaacggcaactttgatagcggatgcgcaggcggttactcttcagctggaacagatgggagtatgcgtgcttcaaagaaaattaggctcacattagcgtgataaatgacacacaacatcggagaaacaaagtatgcttacacaagaaaaaaacgatttaaccagaaacgatattactaacgatacgttagtgcttattttagcgggtggtcgtggttcacgtctttatgagttaactgacagacgagcaaaaccagctgtgtattttggtggtagccgccgcattatcgactttgcgctttcaaactgtattaattctaatttacttaaagtgggggtaattacccagtatgccgcccactcattactgcgccacttacagcgtggctggtcattccttccttatgaacgtaatcaatatattgatatgctaccggctcgccaacagttagatgaaaacacttggtatcgtggaaccgccgatgcggtatatcaaaatatggcgatgatgaaatcgcattatcgcccgaaatatgtggtgattttagccggcgatcacatttataaaatggattatactcagatgttgcgtgaccatgtagaaagtggtgcaaaatgtacggtcggctgtattgaagtgcctcgggagcaagcggtcgaatttggtgtgatggcggttaacgataaattaaaagtgaaagaattcgtggaaaaaccgtcaaatccgccggcaatgcctgataagccgaattcatcgttagcttccatggggatttacgtgtttgatgcagattatttatatgacgtattagaacgagaagcttctattccggggacttcgcacgactttggtaaagatatcattccaaaagcggtagaagagggcgtgctatatgcgcatccgtttgaacgttcatgtaaaggtcgtaatgcaagcggttcgatttattggcgagatgtcggtacgattgatagctattgggcggcacatatggatttagtttcggaagtgccgcaacttgatttatatgatgagtcttggccgattcacggacgaccgcaacaaaccgcaccggcacgtttcttttataaaaaagcacgtcagcatactttggataactcgttaattgccggtggttgtgtggtcaccgatgcggaaatcagtaattcggtcttatttgccaaagtaaaagtggatgcggaaaccgtaattgaacatacggtgattttaccgcaggtaacgattggtaagaactgcgtgatcaaacgtgcggtaattgatcgtcactgtaccattcctgatggtttggaaatcggtgtaaacttggaagaagatgcaaaacgtttccgagtcagtaaaggtgggatcgtcttggtgactcagaaaatgcttgattcattaagcggttatgagtccagtataaaattccatcatacaatttaatctgatacaggtgggcgtttagcccacctttagcgcttttacaagcggtctaattttctctttattttacaaatacaaattaaacggcaacaaaatgaaaattctacatatttgctcggagatgtatccgttaattaaaaccggtggacttgcggatgtgatgggggctttgccttatgcacagcagcaagctggcaatgatgtccgagttttgctaccgctctatcctcaagtagcggaaaaaattggggaaacaaacgaagtagtcactttaggtacttttgccggtttagtgacgattcattttacttatttcaatggtttgggcatttatctgattgatgcgccgcacttatttcagcgttctggcaatccgtatcacgattctggttatgcagattatccagataactataagcgctttgctattttaggctatttaggtgcgcagctatcggaagggctagatcattggtggggtaaagcggatattgtacatgcgcatgattggcagggcggtttggcttgtgcttacctgaaaagttggcatagcccggtgaaaagcgttttcaccattcacaatattgcctatccggggcgcttccagccgcatcatttaccggagttgggtttctcatgggatttcttccaagcagaaggtatggaattttatggtgaaatctcctatctaaaagccggattgtattatgcggatcgcattacgacagtaagtccgacctatgcgctggaaattaccgagcaaattgccggtggcggaatgcacggcttgctacaaacacgtaaagcgcaagggcgtttacacggcgtgttaaacggtgtggacgataaggtatggaatccggaaaccgatgaaaatattgtagcgacatacaaaccgagttatatgcacggtaaggcgaaaaacaaagctgagttacaacgtatgtttaacttaccggaagacaaagatgcaatgcttatggtcatggtaactcgcttaacggagcaaaaaggggcggatttcttactggatagaattgatgacgtgatgcaacagcacgtgcaactaatcgtcttgggtagcggctccccgcatttggaatatctgctaaacgaagcacgtagtcgttatccggagcaaatcggtttgtatatcggttataacgaggcactgtctcatcaaattattgccggtggtgatgtcattcttgtgccaagtcgtttcgaaccatgtggtttaacgcagttatacggattgaaatacggtactttaccgctagttcgccaaaccggtggtttagccgatacggtggtggatagtcacaaagacagcattgaacaacgtaatgcaactggatttgtatttaaataccctagcagtgatgatttctttgaagcattccaacgtgcggtaaatctttggaaaaaacaaaagttatggtctagcgtgcgtcaaaatgcgttagcgcaagatttcggctgggcaagagccgcagcagcttaccaggcaatttatcaagagattgtataaccttacttttcacaagcggtcggaatttgcaaaaaaattgcaaaatcttaccgcttattttgtaaacaatagcaataaagcaaaatctttgtaattctccagcgatttttatggcattaactataaaattgttgtgttttttttactcgatttccgtttgttacttcacttgttagttaggagctattcatgggcaataaaattttaagtcccgaaaatattcaacatgtaaaagatgccattttatataaattggtttatgcgctaggggtagagcctcgtgaagcaagtaaacgtaactggctaaatgcagcgttacgtgtggtgcgagatctttctactgagtcgtggctacaaactcgccgcagccaagtggcgaacgccagccgccgtgtgtattacctttcaatggaatttttgatgggacgtacgttctcaaacgcaatgattgcagaaggcgtgtatgagttagtcgatgccgcattaaaagaactcggacaaaatattgaagagattattaacgaagaaggcgatccgggtttaggtaacggcggtttagggcgtttagccgcttgttatatggatagtcttgctgcaatgaaaattccggcgattggctacggtattcaatatgagtacgggatgttccgccaagaaattcgtcacggcgaacaagttgagcaaccggatcaatggttagaaaatgagtttgtatggccgtatttgcgttcaagtaaacgtttcccgattcgctttggcggtcgcatttggcaagaaggcaaaaaaaccgtatggcagccggatgaagaaattatcgctcaagctcacgatcaattaattcccggctatgaaaccaccgcaaccaatagcttacgtttatggtcggcgcacgcttcagggaaaggtttcggtttagcggatttcaaccgtggtgattattttgccgcaatgagccatcagaatttatcggagaacgtttctcgggtgttgtatccggacgattctacttataacggacgtgaattacgtttacgccaagaatatttcctttgttccgcttcggtgcaagatattatccgtcgccatgaagcggaatgcggatcttgtgtcaatttagccgataaagtggcgattcatttaaacgatacccacccaacgcttgccgtgccggaattaatgcgcatcttaattgatgagaaaggctatagctgggatcaagcgtggaatatgactcgcaaaattttctactataccaaccacaccttaatgagcgaagcattagaaacttggccggtggaaatgttagggcgtattttaccgcgtcacttaggcattatttttgagatcaatgaatggttcttaaatgaagtgcgtgaaaaattcccgggtgaagaagatttagtacaacgtgtgtcactgattgatgaacacggtgatcgccgagtgcgtatggcgtgggtagcggttgtggcttcaagcaaagtaaacggtgtggcaaaaatccactcggatttaatggtggaatccatttttgccgactttgctcgaatttatccggatcgtttcaccaatgtaaccaatggggtaacccctcgccgttggatcaaaattgccaacccgggtttagccaatattttggataaacgtatcggcaaagattggttaaccgatctcagtgaattagaaaaattcaatgtctttgtggatgatgcggatgttcaagccgaaattgcagcggtgaaatatgagaataaacgtaagttggcggattatgttgagaaaaatttaggtatcaaactgaatccggaagcgatttttgacgtacaagttaaacgtattcataaatataaacgccaacagttaaacgtattacatattattacgctatataatcgtatcttaaaaaatccgaatgcggattggacgccacgtgtgtttatctttgccggtaaagcggcaagtgcttactatgcagcgaagaaagtcattcgtttgattaacgatgttgcaaatgtaatcaataatgatgaacgagtacgtgatttgatcaaggtggtgtttattccgaattatggcgtatcgctcgcacaaatgattattccggcagcggatgtgtccgaacaaatttcattggcgggaacagaggcttctggtacgtctaatatgaagtttgccttaaacggcgcattaactatcgggacgttagatggtgcgaatgttgaaattttggaacacgtcggcaaagacaatatctttatcttcggtaacacggtcgaacaggtagaagagctgcgtcgtaatggttattcgccgtatcattattatgaaacggacggtgaattaaatgaggcggtttcacaaatcttaaacggtaaattctcaccggatgatccgtatcgttatcaagatctgattctaaattctggtgactattaccaagcttgtgcggatttccgtagctatgttgaagcgcaagaacgagttgcagccgcttatcgcaataagaaagcgtggacacgttcggctattatcaatattgcgaatatgggctatttctcatcagatcgctcggtgctagattatgcacgagatatttggcatatcgagccaatggatgaagtgcaattaaaagaaaatactgatttggcgagtattattgaaagctcaagcaagctattgattattcgttaataatatgaacaagcggtctgtttcttgcaaaattttgcggaaattcgaccgcttgtagagctaaaaaagccgtttgtttaaaacaaacggctttctttttagtcttgcttaaataatttcatttggtgtgaagaagtaggcgatttcacgttttgcagattcttcagaatccgaaccgtgaaccgagttctcacgaccgctgatagcgtagagtgctcgaatcgtgccggctttacgttgctccggattagttgcacccattaattcacggtagtgagcgatagcattttcaccttcaagtactaccgcaacaatcggtgccgaaatcataaattcgactaacggcgcaaagaattctttaccttggtgttctgcatagaagccttccgcttgttcttgggttagttgtacttttttgagagctttaatggttaagccagcttcttctaaatggctaagaattttaccgattaaattacgttttgttgcatcgggtttaattaaacaaagcgtttgttggatcatggtttctccttaattcgcaaaaaaagcggtgaatctcaccgcttgttattgcttttattttacttgcatacctgggcggataccttcatcagctgaaagtaagaataagtctgcaccgccggtgcctgccgataagatcataccttctgacacgccgaatttcattttacgtggtgcaaggtttgctaccataatcacgaaacgaccgactaattcttccggattgttatatgccgctttaattcccgataacacttgacgttggtgatcgcctaaatctaattggaattttaataatttgtttgattccggtacggcttcacagctaatcacttttgccacacgtaaatctaatttcgcgaaatcatcaattgtgatttccgctgcgataggctcaacagccgtattttcggtattttccactttttgttttccttttttatcttctgctttattttgttctgcaaacaatgctttggtttcttcaatcaccgcatcaatttgttttttctcaagacgagagaacaatgatttaaacggtgcaacgtttttacctaataatggttggtgaatattttcccacgttaattcagcttgtaagaaagcttcggcacgttccgctaactgtggtaataccggttttaagtaactcattaacacacggaataattcaatacccattgaacaaaccgcttgtaattccgcttcacgcccttcttgttttgcaatcacccaaggcgctttatcatcgacatatttattcgctttatcacaaagatccataattaaacgaattgctttgttaaattcacgattttcgtaatgtgttgcgatctgctctgattgtgcaataaattctgcgaaaagtgcttcatcttctaatttatcagccaatttaccttcaaaacgtttggcaataaaacttgcattacgtgaagcaaggttcaccaatttattaacgatatcgctgtttacacgttggacgaaatcttcaaggcttaaatccaagtcctcaatacgttcgttcaattttgccgcatagtaataacgtaaacattccggatcgatatgttttaaataagtacttgcttgaataaaggtaccgcgtgattttgacattttcacaccgtcaactgtgacgtaaccgtgcgcaaatacattggttggcttacgtaattcacaaccgtctaacattgccggccagaaaaggctgtggaagtaaacgatatctttaccgataaagtgataaagctcggtttctgagtcttttttccagaattcgtcaaagtttaagccgctgcgatcacataaatttttaaatgacgccatatagccgataggtgcatcaagccatacgtagaagaatttattttccgcatccggaattgggaaaccgaagtaaggtgcgtcacgactgatgtcccattgttgtaaaccgctttcaaaccattcttgcattttgttggcaatttctgattgcagtgaacctgaacgagtccactctttcaacataccttcaaaacttggtaaatcgaagaaaaaatgctcggattctttcacgattggtgttgcaccggaaactgcagaacgaggattgataagatccatcgggctataagttgaagcacacacttcacagttatcaccgtattggtcttccgctttacacttcgggcaagtaccttttacaaaacgatccggaagaaacatttgtttttcagggtcaaatagctgagagatcactcgacttttgataaaaccgttagcacgtaattttttatacatttcggtagtaagttcacggttttcttcgctatgagttgaatgatagttatcgaaactaatgttaaagcctttgaaatccgctacgtgatcagtttttgctttttcaatgagttgttccggagtaatgccttgttttgctgcattaagcataatcggtgtgccgtgcgcatcgtccgcacacacaaagtgaatctcgttgccacgcatacgctggaagcgcacccaaatatccgcttggatatgttcaagcatatgacctaaatggattgcaccgtttgcatagggaagggcgcaggtaaccagcatttttcgtttttggtttgacatgaatgatctctctgaatttattacaaaattctgtaaattgtagcggaaaaagggctttttttctagagcgtatctgaaatgaacgttgttattgtcttcattaacttcaaatttaacaaaatttcattgtaaagaatgtattgtttttgtaaaaagttgatagaatgtatctataacaacaattatagaaggagaggctaatgttttatttaaaaaaacattattacgacggaattgataagcaaggaaatacgtttattatttattttgttgagtttatgttattgggaattaaaattccttattcttccattttatttaatagtaaaaatggtcagcaatttgaaaaaagtgtttttttcagaccaaaacaaatagatcgttctattaatcactctcgtttaaatttttcagcatattggataccacattcgcctgaaataaaatcaaccttagtttataactcaacacaatatatgaattggaattgccatacgccgaaaggcaattttcatatcatatttcaaggcaaagagtaccaaggattaagctatgcagaaacgctagatatgaattttttgccttgggaacttactgtttctgaattatattggggacgtttcttatctgaaagtcatacggtaatttggatggaatggaaaggtaagcaatcgtttaaacagcttatttggaatggaaagcaatttagtgattttgaaattcaagaagaaggaattttgttaccttcagaaaatatgtttttgcgttttcaaatgtcaaccatgttaaaaaatgaaccgattggacatttgattacaaaaataccattattaaaatattttctgcctaagcgttttttacggactcgcacaataaaatggaaaagcgaaaccaaaatactgataaatcaaaaagtacaagaagtaggctacgctttatatcagaaagtattatggagaaagtaaaaattaagattagatattcataatatggttattttttgattattttattgtgtaaagttattagttgttttgaacaatcaataaagatcttctcgtttcaagcaagaatagcggtaaaataagtctaaaattttgcaatttttgaggacttattatgcgtaaagcacagttatatcgttaccagattccagtagaaaccggcgttattttacgtcatcgccgattaaaacagcgtgaaggtttaattgttaaattaactgaagagaaccaagtcggttggggtgaaatcgccccgctacctgaatttagccaagaagatctttcgcttgctcagcaacaaacggaacaatggcttgcgaaatggctagccgggcaacaagataatttagacagttatgtgccttccgtggcattcggtttaagttgtgcattagcggaattaaacggagaactaactgagcaaggaaattatcgtgcagcagtgctttgctatggtgatccagatgagctatatgctgagctaaacgcattggaaggtgacaaaatcggcaaaatgaaagtcgggctgtatgaggctaatcgtgacggtttaattgccaatatgttgcttgaagctttacccgatttacaattacgtttagatgcgaatcgaggctggacgcttgagaaagcggttaaatttgccgaaaaaattgcaaatgaaaacaaaagtcgtattcaatttattgaagaaccgtgcaaaacaccggaactttcccgccaatttgctcaagtctcaggcattgcgattgcttgggatgagactgtacgagagccgaatttcgtagtaaaaaacgaaccgaatgtgaccgctattgtgattaagccgaccttagttggctcgttacaaaaatgtattcgtttaattgagcaagctcatcaacaaggactaagtgcagtgattagttctagcattgagtcgagtttaggtttaactcagcttgctcgtttagcacaacaatatacacctgaaacaacaccgggtttagatacgttagatctgatgcaatatcagctaatcagaccttggaaacattcaatcttgccaattgctgatttagatagtccgtttgtgcaagaaattatgctataatccccactctataagcggtcaaaaacagagaaaaatttgcaaaaaatgaagcatttctgaccgcttcctacttcttattcaataaaaattgaatctctcctttaatattcaagagaaaattatgcgtttagataaatttattgccgaaaatacggggttaactcgttctcaagcaggaaaagcattaaaaagcggtttagtgacggtgaatggcaaaatcgaaaaaagtggttcagcaaaaattagtgaaacagatgaaatttgttatgaaggcgaacgtttagaatgggttgatgaaggtcagtattttatgctgtataagccgcaggggtatgtgtgttcgcatgatgacggtgaatatccgacagtcttccaattttttgactatccactgatgactaaattgcataccgcagggcgtttagatgtggacacaaccggtttggttttattgacggatgacggtaaatggtcgcaccgtattacttcgccgaaacaccattgtgaaaagacctatttggtgacgcttgccgatccggtggaagatttttatgaggaaaaacttgcggaaggtattttattacgcggtgaacgtgaaccttgtttaccggcacaaatggaaattattgatgattacaatgtgaatttaactatcagcgaagggcgttatcatcaagtaaaacgtatgtttgccgctttaggtaataaagtagaggcgttacatcgctggcgtatcggtgatgtggtgttagatgaaagccttgaagaaggtgaatatcgtccgcttaccgagcaagaaatagggggcttttgatggcaccccaaagaccgcatccgtgcttttttattattttaggaatgatggcaatgctgccaccgcttgcgatcgatatgtatctgccttcattccttgatattgcacgagatctacaggtttcgcaggaaaaagtacaaactacattagcggtatttactttcggctttgctgttggacagctattttgggggccgatggcggatagttttgggcgtaaaccgattattttatttggtctttccggttcggcgattgccgcttatttccttacagcagtgatgacaatcgagaacttttatctactacgattaattcaagggctttgtgcagcagcacctgccgtagtactgggtgctttagttcgagatttgtttgatcgtaatcgtttcgcccaaatgatgtcggtgattatgatcatttcaatgcttgccccgctattagcgccgatcttgggtggatatatcgcaaaatattttcactggcattcgattttctataccttagtatttatgggcgtcagttgtgtgttcttgatcagctggaaaatccctgaaacattagtacaagaaaagcgccaaccgctacgttttggtattgtgtttaaaaatttctggaaattgttatcggataaaagcgtattaggttatgtgttagttgggggattgacctttgccggtttattctgctttttaacctcaggctcattggtctatatcgggatttacggtgtatcgcaagaatattttggctatttcttcggtttaaatatgattgtgatggtcgcaatgactgcactaaatgggcgcattgtagttaaagtcggttcggagaaaatgttgagaatcggcttacttgtccagttattagctggtatttggcttacgtgtgtcgctgtcttccaattaggcttttgggcgatggcattaggtattccgttttatgtgggtatgctttcgaccatcggtagtaatgcaacggcagcgattttagatcgttatccgcaaatggcggggacagcaaacggtttagccggaacagcacgttttggtattgcttcggtagttggtgcaatgttatcgcatattacgctaacaagtgagcgcccgatgctatatgcaatggctatttgtaccttagcggcttctgccatttactacttattatgctgtaatcgtgctgaacaagcggtctaatttggcttaaattttacaaaaacggacactgtaaagtgtccgtttttttaccaacaagcgtaacaataatgccaagggcggaaatgagtacgctcaaaatcatagtaacgttgtatttcctctaattccgcttggtgtttatagttatcccacgcgagtttatagcaagattggaacagcggatcattgacttttttctggtagcgcttggcaaaagcggctttttctttttcggtctgagccaccggcggatcatataactgcgctattaattcggcagtttctacatcacactgcttagctaatgctaccgataaggcttgatgtgccttgagttgttgcgcctgtctggcagcttgttgctgtggcgttaaagcacaagcagaaagcaataatgagagcaagacaggcgttatctgaatacactttttcatattagcctccaattgattatgccaaaaagtaagctctttgagtttatcactcaaagagcttttattcacataaattattcgctttcttgttcggataattcttctaattcgtcagccattgcactgagtgcatcacgacaaagttgagcaagcgctttgtagaaaccgctgtcatgcgcttcaatttgtcctaagaatttagcagcacacggcaataaaaactgctcaaaaaaggcttgttgtgcggcgcttgaatctaaattatcttcaatccaagaggcggtaagtaataaaagtgcaacgtgatcaggtttgtctaacgctggcattgcgcgtgtttggcggaaattgataaagtcttcaaccgcaattttataggcagaaattgttgtagcaatagctccttcctcgccaaaaagtgcttgatagcttgcttgtaattgcgtagggttagcatttttttctaacactgttaaagctaattcactttgagcatcggttgaaagcgcccattgctggcgtaaaccgccttgtgcaagccaagcaaaggtgccggcaagaatcggatcagttggggaacggtagaataagttgccgaataaacggcacaatagtgaaaaatcgttaatggttgtttcgctcataagtaatgatttataaaggttaagaagttagccattttacacgaataggataagaagatgaaatatattggtgcgcacgtgagtgcttcgggtggtgtcgagaatgctgtgttaagagcggttgaaattggcgcaaatgcttttgctttatttactaaaaaccaacgtcaatggaaagcgccagctctaaaagcggatacgattgagaaatttaaacgcttttgtaaggcgcatcagttctcaccggatcatattttaccgcatgacagttatttaattaatttaggcaatccggaagcggaaaatttggcaaaatcacgagaagcttttattgatgaaatggaacgggcaaatcagttaggactaaagctactgaatttccaccccggtgcacatttaaataaaatttcggaaagtgaatgtttagcgcgcattgccgaatcgattaatattgcggtggaaaaagtaccgaatgtggttgcggtaattgaaaatacagctggtcagggttctaaccttggctatcgttttgaacatttagccgaaattattgaccaagtggaagataaaagccgagtaggtgtttgtttagatacctgtcacttattttcagccggttacgatatcggttcattacaagcttgtgagcaagtatttaccgagtttgaacagattgtcggttttaaatatttacgaggaatgcacttaaatggctcaaaaatgccattaggtagtcgagtagaccgtcaccacacattgagagaaggcacaatcggcacagatttttgcaaatttatcatgcaagatgaccgttttgatgatattccgcttattttagaaacaattcagcctgaaatttgggcagatgagataaaatttttgcggacattggcaaaataatcgactatactggctcagcttataacttaaggcttatcagtggataagcctttttaatgtgaaacgttatttttagactttatttttagatataggaatcaaccgctgtagttgttctggcgagacaaattatgattaaacaaaattctacttttacaaggcttaagccgttattcaccacagtattgtttgcagcgattacaagctattcatcaatggcttctgctagtttaagtagtactcccgccacaccgaatcaaatcaaaattgttgctaaagcagcaactgctgatcaaattaaagcacagcttgcttataaagcttccgcaaaagcaaaatctgcaacagataattcatccgcaaattcagctactcaaaaagtaaataagatttatcgtaagtgggctggtactcgttatcgtttaggcggagaagggcataatggcattgattgttccgcttttgtgcagaaaacaatgctcggtgcatttaatattgatttgcctcgttcaaccgcagagcaacgttattcaggtcgttcaatttcaaaatcagaattacgtccgggcgatttagtattctttcgccgcaataatcacgtaggcgtttatattggtggcggtaaatttgttcatgccagtacaagccaaggtgtaacgacaagttcactgtcggaacgttattgggctagaaactatacgcaatctcgccgagtaatgtaatactaaggtcgctaaatgataaattagcgaccttcttatttatgcggcatattttctctcggtaacttgtgcaaagcggtgacgcatttggtgtacaacatttgtaattacgccggcaactgtcacttcttgccagttttgtatacgtaaattcggttcgctaacatctagtgaaaaaagaataatttcgtttataccttcattattctcaatttctttaaagaactggtaaaatttatattcgccatttttctcaattacaagcagatcgtttactaaatattgagccgattgctcaacaatcagtaaatcatccaattcaatcccccaagcgattaggttaggatttttaacctgtataaaaaaggtttctgtcgggcgtttaatgcaaagtgaattaagatctaatttgattgaacgttcgctattcatatcacggtacattggtatcggttgatatgataattcacgtgtaagcggtcgaattgaagccatctttgttatcctctatctaaactgtgtgtttatacaggttattttactgattaaaaaaacagtgtcaatcttgttttgaaatttttttgtaaaaaaatccagtgttttgtttgttttatcgtatggagagaatattgaacaagcggtggaatttggcacagaatttgtaaattgcgggcaataaaaaaagcacccgaaggtgcttttttaagaaaattggcagtaaaactgttattataagctttctgtgaaagtacgagtaattacgtcacgttgttgttctggtgttaatgagttgaaacgcactgcataaccagaaacacggatagttaattgtggatatttctctgggtttttaaccgcatcttctaatgtttcacggcgtaaaacgttaacgtttaagtgttggccaccttcaactttgattgtcggagcaacgtttaccggtacttcgcggtatgaaatttgacctaattcgctgattgcaacgatttggtcttctttataagcatcaccttttgcagcgatacagcgagcttcgtttttctcttcatctaataaccagaaagagtttactaagttgctgtttgaagattctgtaatttgtacgcccttgatcattttgatactcctaagtattggctagataattataaaattttttgataaattcaaattttgtttatgtggtgaattttatcattttttttgaagaattctactaaaagttgaaaaatgtaatcaaaaaattatcaattgactaaaaaacaatctgaaatgtagaaaaaacttaaaattgtttaacactttttaacaggacaagctatgaataattggacggaagcgctaggcgaagaaaagcaacaagcttattttcaacaaattttacagcaagtacatcaagaaagaatgaatggtgtaacggttttcccaccgcaaaaagaagtatttagtgcctttgctttaacggagtttaaagatgtgaaagtggtgatcttggggcaagatccttaccatggtccaaaccaagcgcacggtttagcattttcggtaaaaccaccggtcgcgccgccaccttctttagttaatatgtataaagaattggcgcaggatattgagggctttcaaattccaaatcacggatatttagttgactgggcaaagcaaggcgtgttgttgttaaacaccgtactaacggtgcgtcaagggcaagcgcattcacacgccaatttcggttgggaaattttcaccgataaagtaattgctcaacttaaccaacaccgtgaaaatttagtctttttattatggggcagccatgcgcagaaaaaagggcagtttattgaccgctcccgccactgcgtattgaccgcaccacatccatcaccgttatccgcccatcgaggatttttaggctgccgccatttctccaaagcgaacgcttacttaagagaaaaaggcattcaagaaattaactggcagttaccgatgaatgtataacaaatcacaagcggttaaatttgcggatttttttgcaagtctatatgtcaaatctcccccaacccctctttgttaaagaggggggactgtttcagtgtaatcagtgattccgtgattaaaataataacagcgcaaggctctgctggcacgaatgtcctcacttgtgcctttattatttgaaagagacttgagccacagagtggctcattcagccgaaggctgatcgtaaccacgtacggtttaccgtgcgtgggcaataagtggttacaattatgtagtagttatacagcgccatattttaccttgcacgagccgtgcaaggctgattaagcctagccctgttagggctatagagccacagagtggctcggattaattaacgccatacggctcgtatgacgttaaaacgaaaaagggcttatcaagccgaatgcacttgtgcgtattcttcgtcggtgaccggtgatagccaagtaaccttttttccctctctataatttgtgatagctaaatgcactaaatcactgtcggcacttgcgccgtgccaatgttcaatattctcagggatattaatcacatcaccggtttgaattgcttgtgctggttttcctcgttcttgataccagcctttaccactcgttacaatcaatacttgccctttcgggtgcgtatgccaattggttcttgcccctttttcaaaggttacgctaccgatagaaaattcattattgtgatccgcatccaatacctcggttaaaaaggtgctgccggtaaaaaattcaggggaacgaggttcgcctttcgggaaaagtgtttgcatagggttatccttttattactccttataaataggtgaatttgcaaataactatattgtaaaattattactgggtaagtactttattttcttgtactaaattagtatagaaaaaattaatccttcagtcctaaataattgatttagattagattcaagttctcttaatttatttttttcatcatgccaattgcgtaatgagattatgatacctgaatctttattatttaaaataagtttattgactaaactttctaaatatactgatttaaaatatggtgataaatgtttttgaatcttttctttaattcttttttgatcagttaatgtataatcgccctctttaaattttgaaacgcttacatcagtttttctaacctccaaacctgagttttgtttaggaatacgttttttaatgtcatcgatatctatacttatatttaatatcctattgtttatattttcataagtaaggtcttgccatttttcatatgtgtcactaagttttttgtatttcttagtcaataatatactccatatacctaagaatatactaatgacacttgatattaaggatgtgcattctgatgttaatattgaggatatacattctgatactaatattttttccatatataagttctcctaagttgatatttttttctgaatcagaaatttttctaagatagcatcgtttctgaatagaaaatagattaaattactttaaatccccaatcgcattcaaaatacgtttgtccgaaatcgggtatttagtgccaagttgttgggcgaacaggctgacacgtaactcttcaatcatataacgaatttctaacacttcgtcagggattgctttagatttcggcagtttggtgagtaattgcttataagcattttctacttgttccacccgtaacatcttcgctcggtcggtgttggtatccgtgccgagtttatccaatcgcttgtcgatagcggttaaataacggtgtaaatcggcaaggcgttgatagccggttttggtcacaaaattcggataaaccaaaccgcttaattgcgctttaatatccgacaaggcaaacgccatggtgaagtccattttgcctttcattcgtttgttgagttcaaaggcaagtgtgaggattttctctacttgtagcgcaatttctgcggtagtgtcgtttaagttgcctcgtacaaattcgtgtaattcattgaatttttcttcggtccaaacaaagccgccgaattcatccaccaatttatccaccgcacaagcgatacagtcatcaatcaattccaacactttaccgaatggggcaaagtacaacccaagttttgctttgttcggcaatttttcgtgtaagtatttgattggtgaaggcacgttgagcaatagcaaacggcgtaaaccggctcgcattgcacgggcttgctcgaattcggtttcgaataattttacgcccactgcggtttgctcatcgacaattgccggataagcttttacgctgaaattggcttttttctgctcgtagaattgcggtaagttagcgaaattccacaaatgtacaccgctttgctcgataccgtcatcagcaatggtcgaaaggctttcttgcacctgatctttcagggcaaacttcagttcgtccaagttttcgctttcttgcagttttttacctttttcatccaccacacggaatgtcatacgtaaatgtggtgcaagttgcgacagatcccacagctccggatcaatggttacaccagtcatacggcgaagctcgtaagccagactttctagcaatggtttttgatacggttcggctctgcctaaaaacgcatctgcatagttcggtgccggtacaaaattacggcgagtggctttcggtaatgatttaattaacgctaccactagctcatggcgaagtcccggaatttgccagtcaaagccctccggctccacctgattaagtaaaggcaacggaatatgcacggttacgccgtcgtgatctttaccaatttcaaattggtaacttaatttcagtttaagctgaccttgataccagaaatttgggaaatctaaatcgctgaccgtattggcgttttcattcattaagaatgatttttcaaagttgagcaattcagaatctttttgacttgcctttttccaccatgtatcaaaatggcggctggataccacttctgttccaatgcgttgatcgtagaagtcgaatagggtttgttcgtccaccaagatatctcgacggcgcgatttgtgttcgaggtcttccacctctttgatcaagcggttattttctttgaaaaatttgtaattattatgccaatcaccctcaaccattgccgaacgaataaagatttcacggctgacagtcggatcaattgaaccgtaattgacaagacgattcgctaccaccggaataccgtagagcgagactttttcatacgccatcactgcgcctttggatttcgaccaatgtggttcgctgtaactacgttttattaaatgtccggcgagtggctcaatccattccggttcgatttttgccacggttcttgcccataacttggtggtttctaccagttcggacgcagcaagccacttcggctgctttttgaaaagcgccgaattcgggaacacataaaaatgcgcatttctcgccccgaggtagtgcattttttcgctgtctttcagcccgatatgtgacagcaaaccggttagtaaggcagtgtgaatttgctgatagtttgcttcttcactattaatcggcaagcccatttctcgtacagaaagacgtagttgatgataaatatcctgccattcacgtacacgcaaataattgagaaaatctttctgacattgcttgcggagctggtttttggtcagttctttttgctgagtttgaatgtaatgccacaaattcacaaacgccaagaaatcggagtctttgtcagcaaaacggcgatgtttttcatccgccgcttgttggcgttcttgcggacgttcacgcggatcttgaatcgaaagcgcagagacaatcatcatcacttcgtgtaatgaaccgttttgtgccgcggcaatgaccatacgacctaagcgaggatcgatggggagttgggcaagttgacgaccgattgcggttaatttattgccattaatcgcgcctaattcttctagtaaacgaataccgtcctgcacctgtctggtatccggacgatcaacaaatggaaacgcctcaatatccgacaaaccgagcgaggtcatttgtaaaataaccgaagcgagattcgtacgcagaatttccggatcggtaaattctggacgagcgttaaaatcctcctctgaatagaggcggatacaaatcccttcgctagttcgtccacaacggccttttcgctggttggcggaggcttgagagatcggctcgataggcaaacgttgcactttggtgcggtagctatagcgagaaatacgtgccgtaccggtatcaatcacatatttgatattcggaatggtgagtgaggtttccgctacgttggtggctaaaatcacacgatttagaccgcttggctggaaaatgcgttgctgttcggctgccgaaaggcgagcgtaaagcggtagaatttcagtgaatcttagctcttgtttttgtagcgcttcggcagtatcacgaatttcacgctcaccgctcataaaaatcaaaatatcgccgcgaccttcggcttgaagttcatcaacagcgttgagaataccttgtagttggtcttggtcatcttcttccacaattggacgataacgcacttccactggaaaggttcgtccggaaacctcaataatcggcgcattattgaaatggcgagaaaaacgctcgacatcaatggtcgccgaggtaatgatcacttttagatcggggcgtttatgcagaatttgtttcagatagccgagaataaaatcgttattgagcgagcgttcgtgcgcttcgtcaataattaacgtatcgtattgattgagatagcggtcgttttggatttcggcaagcaaaataccgtccgtcattaattttactagggtgttttcgcccacttgatcattaaaacgaactttataaccgactgttgcacccatttcgctttttaattcttcggcaatacggtttgccaccgaacgagcggctaaacggcggggttgagtatgtccaatcaagccttttacgccacgcccgagttccaagcacattttcggtaactgagtggttttacccgaaccggtttcaccggcaatcaccaccacctgattttctgcaatcagttttaagatttcttcgcggcgagcggaaaccggtaaatcgggataagtgatttcaaggctggaatgctgtgcttttctggcttggaaagctgcttgtgctgagagaatttcacgttcaatttccgcaatcacattgtttttggcttcttgttttttgatggcagaaataccgtgaatacgagcacgcaaacggcggtaatcggtattagtgagttcttttaagttggcgattaatgctttctgactctcatcaagcggtctatttttgaaatttttttgcgaaggtttcattgtcttgtcttaactatgtattgccttaacgatatttggcattatgcgagatattttgagacaaattatagcctaaattgaggggaaacagtaggtagaagaaaccgcttgcaacgctcacttaataagagagggggaacaagcggtctaattttgaataaattttaccaattagcctttaccgattaatagagaaaggataccggcagcgattaatggaccgactggcacgccaccaagtaatgccacgccgataatggtaccaactaataatccggtgactaacagcggttgactacccattaaacttacccctctgccacctaaccaagccaccgcaattcctgcaaccacggcaagcaacatcttccaatttaaaaattcagagaatgaggggagggaaattttaccggatacaatcgggcttaatacaccgatagtcagaatgataatcccaatgcttaaaccgtgcttatctaaaaagggcagatatttgctgaggaatgtttgttgcaccagtaacagcaccgccgcagcaatggtaattgaattgttgtttccgaccacaccaagaaaaatcagtgcgacaaggaaaagcgagatagggttgaattgtagggacatagcttgatatgaatgagattaaaatattatcctcgtttctctcaaaagtgagtaagtgagggggcagaaaatcagtgattttcagatagagagggatttgctgatttttatcaaatttagaccgctatccctctctctgccggttcgctgaacgcttcaccggctgtctctctcccgcaagcgggcgagagtaaaatttagccggcaaccattaccattgccgggcgaagtacgcggccttgtagggtataacctttttgtaaaaccacgctgatatggtttgcttcgataccttccgccggttgcatagaaattgcttggtgaagttccggattgaagacttcgccgacaacaccgaccgcttccacaccgaatttagccagagtagagataaattctttatgggtcatttccacaccgtcaaccaatgcctgtgttttttcatcggtgactgccgtatcaagcgcatttaagccacgctcaaggttatctactacggttaataattcttttgagaatttttcaagtgcgaatttatgtgctttttcaacatcttgttcggcacggcggcggatattttggatttccgcttgcgcacgtaattgaatatctttttcacggttgtccgcttccgcaatataagtttctaactcattaatacgtgcataagccgctgctaattcagcttcgacaggttgttcttgttgtacttcggctgtttgttctaattgcgcttcgtttgcaacttcaacttgttcggcttgagcttgtgcattttcgttttgagctgtcattttaaatcctcttcgtttcaaatatataaatgaaaaatcattactaatatagcgttaaatttgctgatttcaaggtaaaagcggtaatgtgaataaattattaaaaataatttgcaaaaaattgccgttttgattagaaaatccttgcaaaatctagggggtggcttaaaatcgccctcgtcttttaagcccttaggcaaggctatattttttactcatcttttctttaacggagaaaacttaaatgaaaaaattagcgggtttatttgcagcaggtttagcgacagttgcattaacagcgtgtaatgaagaaaagccaaaagcggctgaagcagcggctcaaccggcagcagcgggaacagttcacctttatacttggactgaatatgtgcctgaaggcttgttagatgaatttacaaagcaaaccggtatcaaagtagaggtttcaagccttgaatctaacgaaaccatgtatgcgaaattaaaattacaaggtaaagacggcggttacgatgttatcgcaccttctaactacttcgtttcaaaaatggcgaaagaaggtatgttagcggaattagatcacgcaaaacttcctgtaatcaaagagttaaaccaagattggttaaacaaaccttatgaccaaggtaacaaatactctttaccgcaattattaggtgcgccgggtatcgcatttaactcaaatgactataagggcgatgcgttcacttcttggggtgatttatggaaacctgagtttgcgaataaagtacaattattagatgacgcacgtgaagtatttaacattgcgttattaaaattaggtaaaaaccctaatacaaccaatccggaagagattaaagcggcttacgaagagttaagaaaattacgtccaaacgtactttctttcacttcagacaacccagcgaactcatttatcgcaggtgaagtatctgtaggtcaattatggaacggttctgtacgtattgcgaaaaaagaacaagcgccggtaaacatggtgttcccaaaagaaggtcctgtactttgggttgatacgttagccattccggcgaatgcgaaaaacaaagaaaatgcgcataagttaatcaactacttattaagcgcaccggttgcggaaaaattaacgttagaaatcggttatccgacttcaaacgtagaagcgttaaaaacattaccaaaagagattaccgaagatccggcaatctatccgacagctgatgtgttaaaagcggcacaatggcaagacgatgtaggtaatgcaatcgaactttacgaaaaatattaccaagagttaaaagcggcgaaataattcgttagcctaacggataaagccctcgagaagcgattttcgagggcttttcgtttttacaagcggtctaattttgcaaaatttttgcgaaaaacagccgcttgttgccgtataataacctccgtattttgaaagaggtaattatgaatctgcaatggcaaaaatatccggaaaacacacgtaaactatttaaactcacgctgccgatttttatttctcagctctcggtagcggggatggggcttgccgatattgtgatggcggggctagtgagtgacgatgatgtgtctgcgattgcggtgagtaattccatttatttccctctctttttatttgtattaggtttgcttaatgcaatcacgccaaccgtttcttatttaaacggatcgaaccagcgtcatttaattgcccaccaaattcgccaaggtttttggttggtttgggcgtgtgcaattcctttgattttcgtgttcctaaatagtcattggattttagattatatgaatacgccgcaagctttttcgattaaatcgcaacaatatttagcgattatggcaatcggtgttgtgccggcactattggcggtcaatttgcgttgtatgaatgacggtttatccaatccgaagccggcaatgcgtatcactttcttaggattattgctgaatattccgctcaattatatttttattttcggtaagtttggattaccggaaatgggggcggtcggttgtggtatagcaactgcaattgtgaactgggtcatgttcttattgttattccattacagctacactaataaatctcagaaagatatcggcttatttaaccgttggtttgaaatgccaagcggtcaaactttgctaaaaatttgcaaattgggtttgccgatcggctttgcgacttttaccgaagtgatgttgttttcggcgtccgctttactgctttcgccgctcggttcacaagtggtggcaagtcatcaggcggcactgcaaaccagttcgttattatttatgattccgatgtctttcagtattgcgaccacaattgtggtaggaaaaaccttggggcagaaacaagtcgaagaggcaaaaattattagctatcacgctctgattaccggtgcgctgtttgcattagcggcagcggtcgtgattgtgattttagatgaaattattccactggcatttaccagcgacccggtttcgattgcaattgcagcgcatttattgttgtttgcagcggtatatcaaattccggattcgttacaagcggtggcaaacggtattctgcgtggttataaacataccaaaccgattttatatgtcacaatgttctgttattgggtgatcggtatgccgttcggctatattttagcgcgaacggattggattgttgaaccgatggcggcatcaggtttttggtttattttctgtgtcagtttaagtattgccgccggtttgttaatttaccaaatgcacaaaatccaacaggttcctgcggatcaattactagcaaaattagaacgcattaaataatgattgaatattgagtaaaataatgaaaaccctttctccgattgaactgccgttaaattgtactgcattaattgaagcgtccgccggtaccggcaaaacctttaccatggcaaatttatatttgcgtttgctactaggaattggttgtgcgcctttaacggttgagcagatcttggtggtaacctttactaaagcggcaaccgaagaattacgtgatcgtattcgtaaaaacatcaaagcttgtcgtacttttttacaagaatacgatgcggaaaaagcctatgatgccaatgatttcttcttccaattaggtcagcagattgaaagtgtggaagaggcgattctacgtttacgtattgccgaacgcgagatcgatttagccagcatttttaccattcacagtttctgccaaaagatgttgtttcaatttgcgtttgattcgggtatgcgttttgacagcgatttgcagccggatgagagtgatttgttacgccgtttaagtgaagaagtttggcgtgaaatgttctatccgatggggctgaccgaaacggcggcagtggcggaatatctcggcacaccggacaatgcttttgcggcaattcgtgtctttgtgtctgccgaattaccattattgtcggatgaacaacactggttgaatggcgatctcgctactcatttggctgccttgcagcattttttagtggatgctaaacagcattggttggcacacggagaagaaatcagtcgcttaattgaaaccgaattagcgaaaaaatataaaaccggcgagaaaaaagcacttaatcgccgttcttaccaaactcgttacttagaaaaatggcgtgcttccgtggacgaatgggcggcaagctcgctttcctatttgccggaagaacagtttgagcgcttctgtcaggattttctaaacgaaaaagcggaagagggcgcagaaccgttagttcatccgcattttgcaaaaaatcagcaaattctgaccgcttatcaacagcagtttgccaataaacaaaagccgttattgctctaccaattcttactcgcagtgagaacaaagttagcggattataaagcgacacatagtgaaaaaagttttaacgatatgctcagctttcttaatcaagccctaaaaggcgagagaggaacagcattagccgcacaaattcgcgcgcaatttccgtttgcgatgattgatgagttccaagataccgacaaagagcaatatgaaatcttccataagatttttatgcaagaaaaacatacaaatcaaggatttattatgatcggcgacccgaaacagtcgatctataaattccgaggtgcggatattttcacttatttgaccgcttctcaacaggcgcaacaaaaacgcacgttagccaaaaactggcgctcgttgccaccaattgtgagcgcaactaatcgtttatttgaatttccggaagctgctgcacacagttctttcttgtatcaaggtattcagtttcactcggtggaagcgaaagcgagcgaagctgaattaatcggtgctgactatgtaaattgttatctacaagcaaaatttgatgaaaaattagcggcaaagcagtgtgcttaccaaattcagcagcagcttaagcaaatggaagcgggtgaatttggcttaaaatttaccaatactatggaagagattaatgcgtttcaggcaaaagatattgcaattttggtgcgtagccactcgcaagctacattgataaaaagtgcattagccgaactgggcattcgttcggtatttttgtcggaaaaagaaagcgtctaccaatcggaaaccgctaaagaattattgtgggtgttgtatgcctgtttaaatccgtatcatcaacgccatttactcagtgcgttaggcacaaccctttgggggctgtctgcaacggagatttatcaactgaaaaatagcgaattgcagtgggatgaacaggtagggcgctttattgcatatcagcaaatttggcaacaacaaggcattttaccgatgttgcataagttatttatgcaagagggaattattgagcgcttacgagctaacccgcgtgacagtgatcgccgcctaacggatttattgcatttaacggaattactacaaaatgctatgccgagcttagaaaacgaatcagcgttagtgcgttggtatgaacgtcagttggcaaaaacggatagcacggaagagcatattttacgcttagaaagtgaagaagaactgattaaaattgtgaccattcacggttcaaaaggtttgcaatatccgatcgtttggttgccgtttatcggtaaaaaaaatcagggttctaaagcaagcaatttggctatctaccgtgatgaacaaggacaagcgcattggtatttcgggaaaccgtcagaagaaatccaagtgctgatggatcgggaagaattagctgaagatctgcgtttgctttatgtagcggttacgcgagcagaatcacagcttaacttgattttgccgcaacgatttgaagacggttggaatgcggtgcattatttgctgagcaatggcgaaatcggtttagataaaagctataaagctgaaacgggtacagcggactatttgcaacaaaaagggattgattgtcaagcggttgaattagacgaaaaaattgcaaatgatgaatggcgaccggctccgtttgtgtcagagactttatccgcttgtcatttttccgggcagattcagcagatggggctagtaaccagtttcagtgcattgcatcaacaacatgaatgggcgatgcaacatcacacggaatatagtatgccgaaagcatttgagaatgctggacaagattatgaccagcaacaagtgcttacgcccgaagctgataatcttttcacgttggaaaatgaagaaacgaatgcctattcgtcttatcaatttcctcacagcacaaaagtcgggaatattttacacagtttctttgagcactgtgacttccaacaagcggtcgattttgagcaaattcttaccatttgcgagcagttaggtttagatgaaaactggcatgaaccattacaacaatggttcgaaaaggtgcttacaacgccgtttagtgaggcagaatttgcgctaaaagatgttccgatgacaaaacgtttgaatgaatggcagttttatttacgtttaaaaaattcggatggattacgcaagctaaatcaattgttaaagcaatatagtgcggtttcggcaaaattacctgaattgaatttacctcagctggaaggctatatccgtggttttgttgattgtatcgtacaaatgcatggtaaattttatctgatcgattataagtccaattttttaggttatttagcacaagattacagccgacaaaatttggaaaaaacgatcgggcaatatcgctatgatctgcaatatctgctttatacactagcgctacatcgctatttacgggtacgtttgggtgatcagtatgagtatgagcgtgattttggtggcgtggcatatttattcttacgaggaatgaacggcacaaccaatagcggtgtatttttcgaaaagccttgcaagcagttaattgaaggtatggatgaaatattcggttaatgacacagagaaaagggctaccggttggtagccttttcatactgtattcagtataagtttaaaaatatactttatggcgtattaaatattatatatactgttgtccgtataaaaggaggtgttatgctaatcaatgatcctaatagtttagccgtttacctacgtgatattcgtaagcagcagaaacaatcacaaaaaatgattgctcaacgagtcggtttgcgacaagcaacgatttctacattcgaggcccagcctgataaagtcacaatagaaacgctatttaaaatagttcattctcttggtttagaaattcatttagaagaaaagcatacgaatatgtttaataggagcgatgaatggtgaagtgtttatgtgtgttaatgaatggggaattagttggtttttttgagcgtactatgtccggttcgcatttattccgttatgcagatgagtggtttttatctccaaatgttagacctatttctctttctatgccattaagaagggaggtttatcaaggtaaagaagtaattaatttttttgataacttattacctgatcaccctcaagttagagctagaattgctgcgcgatttcaagctgaaacacaacaaccttttgaattgttagctaagattggacgagatgcaaccggagcaataaccctattagaagaaaacacagaaattcccaatcataaagttatttatgcaacggaattaaacgaaaatgaacttcattcgttattattaggctatcagcaaaatgcaccacttggcatgttggatgaagcacaagattttcgaatttctatcgcaggggctcaagaaaagacagcattattatggtataacgaacgttggcaattaccccatggattaaccccaacgacacatattattaaattaccgataggtaaaatacaaacacctaaatatcaattagatctgtctcaaagtgtagacaacgaattaatttgtttacgcttatgtgctgccttcggtttaccgactgcaaatgtaaatttattagaggtcggggatgtgcgagcattggttgtagaacggtttgatcgtaaattacattcttcaaataaatattttttacgcttaccttatgaagatttttgccaagtattcggcttagcgccaacccaaaaatatgagagtgatggtggtatcggtattcgacacattatggataaacttttgtattccagtcatacttcggatcgtgcacaattcatgaaaacccaatttttattttgggtgcttggagcaatagatgggcatgccaaaaacttttctattgcattgaagtcgcagagtcgttatcacttatcgccaatttatgatgttatatcggcttatccaatgctgggaggtaaaggatggcatcagagtgatttgcaacttgcgatgagtctgtatagtacccaaaaaggtaagaaatggagttggcaaaaaatacgaccggtacattatctgtctaccgctaaatctgtcggatttaatcagttagaaatgaaacatattattgaagagatttcagatacggcattaaaaaagttagattttgtagctgataggctgccaataaatattaatgaacaagtaagagatcaaatttttaatggagtcaaaaaacagattgataaaatcaaattagataggatttaataaaagagctaccggttggtagcccttatttttgtaaaaaaggaaagaaattcgaccgcttgtttagcttaacgcgacaccgcttaattcaataaagaagccggcgatagtggcactcattaagtttgctaatgtaccggcaatcactgattttaaaccaagacgggcgatgtcagagcggcggtttggcgccatactaccgataccaccgataagaattgcgatcgcactgaagtttgagaaaccacataaggcaaaggtaataatcgctttggttttgtcggttaacaccacagccgcatccggttgtaagtatttggcaaattctaaataaccgacaaattcgttcactgctaatttcataccaatcatttggccagcaataccggcttcttcccatggtacaccgattaagtaagcaaccggtttgaataagtaaccaagtaggacttgtaaggttaaaccttcaataccgaatgtattacctaaaccgccaattaggccgtttaacaatgcaatcaccgcaataaaggcaattaacattgcaccaacgttaagtgctaacatcatacctgaacttgcaccgtttgcgagtgcttccaccacattgtgcggttgttcaaggtcaacaccttcatcaatcgtatctttaaattgctcggtttgcggatacattaatttcgcaaataataaaccggcaggtgcagccataaatgatgccgcaatgaggtaagtaagcggaacccccatacctgcataacccgccatcactgaacctgcgatagatgcggtaccaccacacataatggcgaataattcagagtcggtcattttattgataaacggtttaaccactaacggtgcttctgtttgaccaacaaagatatttgctgctgcagacattgattccgctttagatgtaccaagcgctttttgtaagccgccacctaaaattttgatcacccattgcattacaccgatgtaatacaacacagaaattaacgcagagaagaaaatgattaccggtaatacttttaccgcaaaaataaagcctaaattactcggatcggctaagttaccgaagacaaaagcaataccgtcattaccgtaattgataacgttactgatacagtttgccgcagctaataatgcattgcgacctgctggcacgtatagaataagcgcagcaaaacagatttgaatagctaacgccccaaatacggtacggaagttgatggctcgccggttattggaaaagagtaagcctattgccagtaacacgaagataccgataacactcattaatgtactcatactaaacacctcataaaaaattaaaaataaaaagttaaattaataaatcgtgacaattttggttatgccgcatgcttttgcaaaagcggctaattcatctgtttgttcaatcgttggaacaaacggtttaagtccttcttcatcccgtgcgcctttggtatgtactcgaataatttttagcagcacatcaggataatcagtgagtagcattgcaacttttttaattaatgctttggcatcaaaaaagtcatttacataaaccaatctgacttcttccactttaccaagcggtaataatttggctaaattttgcaaattacgttgcaggttttccggtttgatatgattaatcgttggaatgatttgttccggcactttcccttgctgatttttgcgatcaaagcagagtgtctgtaagccttcgccgtcaccttttagatcaaataaaaatttatcggtaacctgaattaacggctcaatcgtttcataatcaaaaaagccactactatctaaataacaagtcagcccttgctgtttaagcgtttcgaataacggcactaactttttgtgatggatagttggttcgccgccggaaaccgttacgcctcgaataaacggcacggcatccatcacttgctcgtacaagtattgcaagctgacttgttttgcttccggcgtatgacagggaatggtttccggattatggcaatacaggcaatttagtttgcaaccttgtaggaaaatgctggtgcggttaccttgtccttctacattcgagaacgggataatgcggtgtaatggcaccagaatatcggataacgccggcatcttattcatttgcgctaacgttttcttcatctcgtaattgacggtcaaagaccttagcacaatcatccgtgcctgcgccgtaccaggtggtatcacgtagcaccgcctctcctttgcgataacgttctacttcacttttcttaactaagtaaccggtaacacgaattaaatcagtatttttgagataagtcgtgatatagcgataaccgttggcaaacgaaccgtcaataatatcgactaccgcatccaaatggtcggtataggtttggtcaaacgcaaataagtcgccagttcctgacgggaaatatttgtggaatggtgccgattgttttaaatgtgccaataaggttggctcttcaccgacacgaatacgatgcgccggtgtattcattttatcttcggcgtgattacttgccccaacttgtgcgtgtaataagtattggttattggtgcgttctacatataagccttggtgtgcatcgttgatttctttcaacttatccataattaaggttgcaatttcgtcgcctcgtttactttggccgaaggtttcgtttaagccttctttttgtaagaggtgatttgtcgcatcggctaaaccgacaatcgcaatcatactggtgaaattcgtgcgtttaataaagccttctttcacaaggaagtcggtttcaaagaaattactttcttccacaaggaatttatgacgtttatccatcgttgaaagggcgagttttgctactttcggcaacaactcattaaccatttcatctacactgttacaggcacgaccgatagtccctaaacgtaagcgagttagggtataagcaccgccgcactcaggtaaggcgttgtaacaacttgcgataccgtagtcttcacctaaatcggaaatgtaataagcatcgttagcaaaagacggtttagaaaccagtaagcaagcttttgcggctaactcggcaaattcacgagaggttttgcttttgtcataacgaatactcatatttggggtcggattctcaagctcaatcaccgctttaaggatcaagcgaccggctttggtatcataagggccgacatttgcgtggcagaaagaatccggtacggttttatcaatatgatttaagaaacgtttgatcttgatatagtcttgttcttcatcggtaatgaacggatcgagtaatacgtctaagcgaccgatataaaccgggtaggtggtaatagacggcacgtgagaatagataatgagtaaaccgtctaatgcttcatcaagggtggttggcggcggtaaatctaaaaatttacagcctttttggatataaacattataatccggcaaaatgtaacgaggacgataaatggcataaccttcattaagatcacagatcatttggttctcgatatattgccattcttcttcggtgtaacccaacaattcggtaggattaaacagacgttcggcaatgtttccgaggatcattaatttttgatgataggtgagcgaatttgatttaaccgtatctaaaatatcttgtaatgaagattgcatattatagcctcaagtgaatcagaagatttgggctatattgtacggatttgctcaaaaaaatactgtgaaatagatctcaattttcgatttcgaaaaaaacaaaagcaccaaaaatagcttatttctggtgctttcttcgacaaacaagcggtctatttctttctaaatcttgcaaaagacaagatcagacaaaataggcctagcgcataaattagccagcttccagttttagcgaatagggtttcgcctttagtcagctgaatttgggcagttaatacattcgcttcaaattgaggaatctgttcgataatttcgcctttagcgctgataaccgctgtaatcccggtgtttgcggcacggagtaacggtttacctaactcaagtgcgcgcattcttgccatttggaaatgttgccaaggaccgatagaggcaccaaaccaagcatcgttggtaattgttaataaataatccgattgttgcgcttgttggttttgttgcatttgatgaccgaaaattacctcatagcaaatcgccatattaaatttacgatttttagcgaaaagcggctgttgcacaaattcgccttgcgataaattaatcggcagaataaacacatcacgcatccaatccaataccgatccgaaaggtacatattcgccaaacggcactaaatggtgtttgttataacgcatggtattgtgcaagttatagggttgcgatggattacctaacaccaccgcactattaaataattgctcgctttcgtcttggtagagtgtaccaataattacttcactgcctttttctgcagcaacttgttgaagttgactaagtaacggataaatttgcgtttctaacgccggaatggctgattcgggtaatacaattacatcactcttacctaataatgggctgattaaacgctgataggtttgtaacgtataatcgaaatgtgccggatcccatttcatcttttgctcaatattaccttgtacaagacttacgttaagcggttgtttttgctcatcaatttgcacaaatggaataaatttagttgtaaatgctaatccgcatagtattgctaaggtggcaagagaagcggtcgtttttgtagatttttttactaataacacaaggcaaccgcttacaaccatcacaaagaatgtgagcccttcaacacctaacagcggtgcaatgccggcaaacggaccgtcaatttgcgtataaccgaactgtagccaaggaaagccggtaaagactacgccacgcagatattcggtaaaggtaaaaatcgccgcaagtgcaaaaggattacggatttgaaaacgctgggcaatatagctgaatagcaaattataaatagcgaggtagcaagccaataaaaacaccgcgatatagctcaccacaagcggtacgccaccgaattgggtcatactgacgtgtacccaatttaccccgacacaaaaacaaccgagtgaccaagcaaaagttgcccaaagtgcggtttttcgctgcggaagtatcgctgcccaaattaagcctgcggcggaaaggtaaatgagtccccaaatatcaaaaggggagtaggcgagtgtcccaatgcctccgaggacactggcaagcaaacaagcggttaaaattgatggattttttacaaatttcatttgaggtagttagttaagtaattaagaaatatgcttaagagaaacaatacaaacaaaaggtgaggataaaacctcacctatatattatgctttgtttattattcttcgttggtgaccagctgttccattttttccagctgttcatccggtacggtaacacgtaattgaatcagacgacggctatcggcagaagtgactttaaaatcaataccttctaattgaatttgttcgcctcgctgtgggagatgtccaaatgcctgcatcactaaaccgcccactgtatccacttcttcatcggtaaattcagtcgcaaaggtttcgttgaatttttcaatatcagtcagtgccgatactgcataagtatggcgagaaagctgacgaatcggctcgatttcttcttcatcaaattcgtcttcaatatcgccgacaatttgttcgagaatatcttcaatcgtaactaagcccgataccgcaccgaactcgtccaccacaattgccatatgaaaacgttccgaacggaattcttttaacattcggtcaacgcgcttactttccggcacaataaccgctgggcgcaagatagcttgcatattaaacggttcggaatcagaacgtaggtatttcagcaaatcttttgccaataaaataccctgtacagtatcttttccatcatctagtattacgggaaaacgtgagtgagccgattcaataatcaaatccacgcaggcttcgagcggtaaactggcatcaatataaacaatttgcgggcgagggatcataatatcacgtacacgaagttcggagatttccattaccccttcaatcatttctttggtatcgctatcaatcaattcattttcaaccgaatcgcgaataacttcgactaaatcttcacgatttttaggctcggattgaaataaaccactaaaaatagaatgtaaaaacgatttcttatcttgcgaattcacgctttgctgttcatcactcattgtatattctcttgaaaaacgaaagttctctacctttgattaaaggtgagagcaaggctaaaaattatcataaattgaggtgtttgataataaaattatttctattttacttaaattagcatagcataagacgagaaattctcatattgattcaattttaaggagcttcttaatgaaattagcgaagattgcagttgcggttgcaacactggcggtcagttcattttctgttgccggtactttaactacatcggatagcgtagagttattagcgtttgatggtcagaaagtagcgaaaggcacggcaggattatcaattgatagtaaggtacatcaggtggctgtgagtgtagctgatattgttgacggcagttatttctcaattgatccggtgattctaacattcaacggtacagatgaagatgcaaaaattgttacaccaaaattcacctcacattttgccgtagataagtttagaaaagagctaaatttcaaaatagaaactgcatcaggtaaagaaattgcttacaaacgtgatttattgaaaggtgaaggctttgcaccaaactctcgagttgaagataatcttgcgaaatacaacgcaagtaaagcggttgcttcagtatcgagttttgctaatgctgctttagaatcaaaaggtcaaatggtgattgaaaccgccaacgtgaaagaagaacaactacagattttattcaaaaaagcggataaagaaacacaaaaacgtttcttggaatgggctaaaaaacaacaatagtttttatgaacaaagctcaagcctcagcagaaatgctggggctttttttataaaaaatttgaagcgcatcacatttttataacaaaaatgtgcggaatgtcacaaatttacattttcccgtttgcgaaaaaagttcgtttttatatagtgcgctacgaaaacgtttgcgttttcaaacatttatatgcttatctcattattccgtttaatgtgtccataagggggacgatatggaaagatcgttaaaaggcgcctgtattgctgaatttattggaacggggctgattatctttttcggtgtggggtgtgttgctgcagcacaattagccggtgcaacatttggtttatgggaaattgcgattatgtggggtgtaggggttgctcttgccgtttatacgacagcgggagtgtccggcgctcatcttaatccggcagtcactgtagcactttggaagtttgcttgttttgatggtaaaaaagtacttccttatatcgtatctcaatttttaggcgcatttacagcggctgccttagtctatttcttatataaagatctcttttctgctgcggaagcagcgaagaatattgtgcgcggtgaaagcgtaggttttgccggtgttttttctacttatcctcatgaacatatcagtgtggtgcaagcattttgtgtggaagctgtgattaccatggcattggttgcgttaattttagctttaactgatgatggcaacggtgtacccaaaggtcctatggcaccattattaatcggtttattaattgccgcaattggtggtgcgtttggtccgcttaccggttttgcgatgaatccggctcgtgatttcggcccgaaagtgtttgcattcttggcgggttggggtgacgtagcatttaccggagctcgtgatattccttatttccttgttcctctgattgcaccatttgtcggtgggttgattggtgcgtggggttaccgtcgctttattggtaaaaacttaccgtgtaactgcgaaaaataaattcacatctttattaaaaagctattaaggtgattactatgactaaagaatacattattgcattggatcaaggtactacaagctctcgtgccgtgttattagataaaaatgcgaacattgttgaagtggcacaacgtgaatttactcagatttatcctcagccgggttgggtagagcataatccgatggagatctgggcaacgcaaagttcaacactaaatgaagtggtagcaaaagcagggattacgtccgataaaattgcagcaattggtattactaaccaacgtgaaaccactattgtatgggaaaaggagaccggtaaaccggtctataatgcgattgtttggcaatgtcgccgtaccgcagatacttgtgcaaaattaaaagcggatggacatgaggcttatattcgtaaaacaactggtttagtggttgacccatatttttcaggcacaaaagtaaaatggatcttggataatgttgaaggtgcgagagagaaagctgaacgaggcgaattgttattcggtacagtggacacttggttagtttggaaattaactcaaggccgtacgcatgtgaccgattataccaatgcttctcgtaccatgttatttaatattcacactaaacaatgggacgataaaatgttggaattacttgatattcctcgttctatgttacctgaagtgaaaaattcatcagaaatttacggtgaaaccaatatcggtggtaaaggtggtgtgcgtattccggttgccggcatagcgggcgaccaacaagctgcactttatggtcatctatgtgtggaagcaggacaagcgaaaaacacttatggtaccggctgttttatgttgatgaataccggagatgaagcagttgagtctaaaaatggcttagtgactaccattgcgtgtaatgcaaaaggtgaaccatgctatgcgctggaaggttctatttttatgggtggtgcatcaattcaatggttacgtgatgagttaaaaattattcatgacagtaaagactcggaatatttcgctactaaagtggaaagtacgaatggggtttatgtcgtaccggcatttaccggattaggtgcgccatattgggacccgtatgctcgaggtgcgatattagggctttctcgtggtgcgaatcgtaaccatatcgtgcgtgctacattagaatcgattgcatatcaaactcgagacgtactcgatgcgatgcagtccgatagtggtaaacatttggctacattaagagtagatggtggcgcagttgccaataatttcttaatgcaattccaagcagatattctgaatgcgaatgttgaacgtccggttgttcgtgaggtgactgcacttggtgcggcatatctagcagggcttgcggtaggcttttggaaagatttacaggaattacgaggtaaagcttcaattgaacgtacttttattcctgattccgatgaagctaaacgtactcgacgttatgcaggatggaaaaaagctgtgaagcgtgcgcttgaatgggaagaagaagtgtaaaagagtatgagttaagcggtctgatttgcaaaaaattttgtaaattggaccgcttgtttatttataggtatatcatctagacatataaaaaaacgatcttgatcaagatcgttttttgttatcacattatcatttgctcgcttagcgaataatgcctcgcgtagagcgtttgaagaattcaaggaataattttactgaaggttcattttcggcaaattgttcgatttccggaatggcttcttcaatcgttttaccgctacggtaaattaatttataaacgttacggattgcgtgcattgcaggtttatcaaagccacggcgttttaaaccttctaagttaacaccaaacggttgtgcgtggttaccttgcgccatcacatatggtggaacatcttgacttaccattgaaccgccacctagcataacgtgtgaaccgacaacaacaaattggtgaatagcagacataccaccaacaataacaaaatcatctaatgttacatggccagcaagcgtaccattatttgcgataatacaacgattaccaattgtacagtcatgagcaatatgagtattgatcataaataagttttcatcaccgattcgagtgattcctccaccttgcactgtgcctcgatgaattgttacgctttcgcgaatacggttgcggtccccgataattactttagttggttcaccttgatattttaaatcttggttgatctcaccgatacttgcaaattggaaaatttggttttgttcgccaatttcagtgtgtccattaatcacaacatgtgaatgaataatggttttggcaccgatttttacatttttaccgataacacaaaatgggccaatttcaacgtgagcaccaatttgagccccttcttcaataactgctaatgggctgatttttgcagtagaatcgattaatcgcatagcgtctcctttgctactgggaggaaattatttacgagcacacattaaatcagcttcacaagcaagcctgccatcaacgtaagctttgccagtgaatttggtaataccgcgcatttcttttaaaaattcaacttcaagtacaagttggtcacccggcacgaccggacgtttaaaacgtgcattatcgatcgccgcaaagtaataaagttcatccggattcatcttgccatgtgtcgcaaccgctaatacgccggttgcttgtgccattgcttcaagaataagtacgcctggaaaaatagggttagcagggaagtgaccggtaaagcaaggttcatttaccgtaacatttttaactgcttttaaccatttaccttcttcataatctgttacacgatcaactaataggaatgggtaacggtgtggtaacatattcatgatctcggtaacttcaattactttaggttctctattttcttgtacttcaattgtcatttacttgacctcataataaggaaattcaaaatttaactaagacttcaaaagagtgatggacgctaaaaaaacgcccataactcttgaaagtcaattattcactattgtgcgaaatgcttttcaagcgttttcaaacgtttattgatttcatcaatgttcatcgtcagagcggctgttttacgccattctttattggtttgtgctggtatacctgatgagtaaatacctttttcggtaattggtttcatcaccatactcataccggtaataatcgcaccgtcacagatttccatatggccgttaattacgcttgccccaccaatttgacagaagcgaccaacttttaaactgcccgccataattacgccaccagctactgctgtaccaaaaccaatatgtacattatgcgcaatttggcataagttgtcgataatcacgttatcttcaataacggtaggatctaatgcgcctcggtcaatacaggtacatgcaccgatttcaacatggttaccgataatcacaccaccggtttgtggaattttaatccattgacctttatcgtttgcataaccgaagccgtcagaaccgataactgcagaagactggattaaacagtctgtaccaatttgaacattatggtacaccgatatgtttgcccataattgagtacgtgcaccgattttagtgtttttaccgacaaaacaacctgcaccgataatcacatcgtcgcctaattctacaccactttcgataaccgcatttgcaccaatcgaaacattattacctaattttgcatccggtgaaataactgcatgggatgatatttgacttgcggctttcggcgttgaatccatatattgtgcaagtaatgcataagcaaggtaaggattcttaacaataattaaattttgagattcagcacaaaattcaacatctgcttcgctgacaataatcgcacccgcttgagattgtgctaattgaggacgatattttgcatttgaaataaatgtaatttgtgatgaattcgctttatctaatgcggcgatgctagaaatagccaaatcggcgttaccctttagagtaccgccgatttgttccgccaattcaattaaacggaaattagccattattttttcgcttcttctggtttagcttcggtagccggtttagcttcgtttgcttttgctgccggttgttcgattttgatttctggatgttttgcttttaatgcatccaatactttttcagtaatatctttgctttcgtcttcagcatacagtgcaactgaaggtgggaaaactaaagtataacctttagattttgcaacttctttaatcgttgcattaatttcttccactacttgtttctgcacagtttgaggatccataccacctgcttcttgctgggctttatttaatttttcttggaaagcatctgcttttttctggaatgcttccgcttttttaccgaattctgcttcacgtttttggattgcagcaactttattttggaattttttgtattctgcctcgattgcattttgacgtgcttgaatctctcttgaacgtaaacgtggtgcatctttttctaatgcggcagattttttcttaagagatgcttctactttagcttgctctgcttgtaattttttagcatcgctttctaatttatctctttcagctgttaatgctttgttttcttcagctaattttttatcttcatcagcaaatttgtctctgccttctctcatgaatttgtcgaatttttgtgctgcatcaatagcgaccgggtgattttgtaataagtagcttgggtcaacaaaaccgatagtatcgcttgcttgagcaatacttgctgttgttaatgctgcagtaattgctgcgattttgaataatttcttcatttaaatatcctttatgttttaattaatcatgactgattaaatagtgtaagcggtaggatttgtcgcaaaatttgtaaaaaaattacaaaatccgaccgcttattttatatattagaatgtactaccgatgctaaattggaattgctcaatttcatcacctgagtattttttgattggtttagcataagagaatgataaaggaccaatcggtgattgccattggaatgcaataccagcagaggcacgtacgcgtttataatctttataatcaggtaacgtagggtatgctgattttttccacttcgtattccaaacacttgccgcatcaacaaataatgaggtgcgtacattgtgttggtatttttcgcttacaaacggagtcggagtgattaactctaaacttgccgttgccattgcgttaccaccaactacatcatcacttgcagaggtaaatgcattgttttgtgcagagtagtaaatcgctttaggacctaccgcaccgtatgcaaaaccacgtaatgaaccgataccaccggctgaatataattggtagaacggtacttttttaccaccaaagccattagtaaatgcagcacctactttagttgagattacccatttatgttcacgattaagagggtagtaatttctaaagtctgcatttactcgatagtatttgttatcagaacccggaatagttactttaccgcctaaatttgcaactgtaccttgtgttgggaaataaccgcggttaaggctgttataattccaaccgaatgagaaatcaaagtcgtccgctttaatacgtggatataggttatttccttgcacgattgggaagttcattgatttcacgtatttttcacgagtaaattcacgttcaacgttacttaatttatcgtgtgtataacctagacctaagtagtatgaattgttttcatctacagggaaacctaatgtgccgttaataccgtaagttttacgtttatatgatgcagaagtatcattatctgagttatcgtaatcttcatagaagatgttaccacccaaactcacaccatcttttgtaaagtacggttcggtatagcctaagttcacgctagtaccgtagtcgttacgtgtaccgcttaaacttacggttgaacccatacctaagaagttatcttgtttgatacctgcttggtagctaataccactttccgtaccataaccgataccaaagttaattgagccagtgttacgttctttaattttataaacaacatccacttggtcatctgtgttttgaacgcttggcattgtcatatcgacagtttcatagaaaccggtacgctctaaacgagatttacctaatgcaaccgcacttgttgataaccaagcaccttcttgctgacgcatttcacggcgtaaagttgagtcggcagtgacatcattgccttcaaagcgaatcttacgcacatagatacggcgacctgcatcaactacgaagttaatttgtacggtacgatcttgttcgttaaatttcgggtataaatctactttagctgagccgtaaccgtgatcacctaaaacttgtttgattccttcttcaattgccgctaattcactcttacggaataattgacccggagtgaaatcttttaacaatgcgttaagctcattatctaatttagcggtatcaccgataatacgaatttcactgatattgtattgtgcaccttcacgaacagtataaactaaatcaacttccgtttttttatcgttaaagtttaccgctgtgtcttgtaaggcaaattgcgcatagccgcgatccatatagaaatcacgtaaagtttctaaatctttattgtacgcttgttgttcgaatttactgctttcaaaaatattccaccatgaaacgtcaggttgaatatctaggcgtttggttaattcttttgagctaaaagcttggttgccttcaaatttgatatttttcacataggcaacatcaccttcagtaacgtttaattttacatttacaccaccgttttcagcacgagtcgttgtcgtgtcgattttcgcttcataacgaccgatagaatggtaatgttctaataaaccttgtttgaagccttctaattttgcagcatcaaaaacttcgcctttactgataaggttagcttttagattgtcttgtagcggatctttaggaattgcactattaccttcaatatctacactgttaattaaaggacgttccgcaactttaatcactaaggtattaccttcgcgagttgcacgcacgtcttcaaagcggttttgtacgaaaagctgtcttaccacatttgctacatcgttatcggttgcggtttgaccaactttaacgggaagactagaaataatcgcttgcccagtttcaggctgaacgccatctacacgaatatcttttacaacgaaaggtgccgctacaacaccgttcgcaagtaaaagcgaagaaagtaataattttttcattgaaattatcctataaatgtttgcaaaattatgagcggaaacgaccgcttataacctatgaattaaaaatgaatgagatcatttataaaggcaaaagccattaagccaagaacaaatacaacgcctaattgttggaatcgcatttgaatcactgatggtattggcttgcctcttaccgcttcacccgcaagtaaaatgagttgtccaccatcaagcggtagaattggaaaaagattcattacgcctaaattgacactaatcaatgccataaaacttacataatagatccaaccaatttcagcagtggccccagcaccttttgccatagaaataggaccacccatattttttaaagaaagctcgccggtgagtaaattaccgataaattgcaagatagttttcactaaacccgcgactttctccaaacttttccagaaagcactaagaatatcatactttaattctgttcgatacttatccgcaagtggctcgtagcttggtacgataccgattaaatagcgctcgtctttcttctcaggttgtaacaccagttgcttgacattaccattttgttcaacggttaacacaagcgtatttccggtttgaacttgttttactaaatccaaccaatcaaaaggttgttggttaacctgtaagattttatctccagcacttaatccagctttttgtgcaggagagttttccgctacctgtttgatttccggttttacgatactacttttggtacgaatgcccagagtagttaacggattctctttcgtaccatcgacatcccagtttgaaaggtctaattggaagcgttgcaatctatcttcatcaattagcgaaccttcaatttcaaccgattctttaccaactgaaccaatgagcgccagtgttgcctcttcccaattttggacattttgtccagcaactcgttttaattcaaattctgttggcagtttagcttgagcggcaatcgtgtccggcaaaacttgcccgataaccggttttagtgtcggcataccgtagctaaacactaaccagtaagccatgatcgcaaagacaaaattcgccataggtccagcaacgataataaacgcacgttgtaaaacagatttattctctaacatctgttctttaggcacttggtattcgctttcaccgttatacatttgcacatagccaccgagtggaatcagtgaaaaggcaaattccgttccttgtttatcgatttttttaaataatactttgccaaagccgatagaaaaacggatcacttttacgccacatttacgtgccgcccaaaagtgaccgtattcatgtacaaaaaccagtacgcaaattaagataaaaaatgcaataacagaagtcataacatcctatagtacaaagaaaaagaaagttgcaaagaacggaattgcagcagttaagctatcaatacgatctaaaataccgccgtgtcccggaatcaaattactgctatctttaatattcgcttggcgtttaaacatactctcagcgagatcacctaatacagaaatggcaacggtagccatagaaactaaaataaacggcagtgttgctaattcacgtccaaatacgttatgcggtgcaagttctaagaagaggaaagcaatgacacatgaagtaattaaaccgccgattgcaccttcccaagatttccctggagacactttgggtgccaatttacgtttgccaaatgcacgaccaaagaagtaagcccccgagtccgcaccccaaactaataagcaaacataaagtaataagtatgttccttggaactcatttaccgcatagttattaaaacgtagcgcaagagcggcaataaagaacggaactaaagtgcaaaagccaaagctaaatttggcaataaccgatttcgcccataagtttgccgatttaggatagctcacaactaaaaggaaagcgataaaccaccagatacaagagataaaaagtagaggtgtggtttcatccgttaagaaacgagcggctcggatataatcggtatttgcaaaaattaatagaataaacaaacaaacggttacaaaagcaacgaccgcacgcggtaatgaacgttttaaaccggcaaattgagcccattcccacattgctgcagcaattacggctgcaagcacaagtgttagcggaagtggtgaaagaagaaaaatagctgctaataccgcaatgatcataacgatagcagaaagtacacgttccttaagcatttataaaatccctataattattagcaaccgccgaaacgacgatcacgttgttgataagcgataatggcttcgctgaaagattcatcattaaaatcaggccataaaacagggctgaagaaaagttcggcataggcaatttgccataacaagaagttactaatgcgctgttccccactagtgcggatcaatagatcaacttgaggctgttctccggttactaacgcattctgaaaacgttcagccgtaatatcggaaatactgatttcacctaatttgacttttacagcaagttgctgagctgcttgggttatatcccaatatccaccgtaatttgccgcaatatttaagattaaaccggtattctctgcagttaatgcttcagattccgcaattcgtttttgtaaactttcactaaaaccttttttatcaccaataatttttaaacgaatattatttttatgtagttttttaacttcggaatccaatgctcgcataaagagcgacattaacgctgaaacttctgcttcaggtctgctccagttctcgctactgaaggcataaagtgttaggactttaatcccatgtttggctgcaaaacttaccgcagaacgtaccgcttttacaccattttgatgaccaaaaacgcgtaattttccttgttgctttgcccaacgcccgttgccgtccataataattgcaacgtgttgaggcattttttgaggatcaaaattcacagaagttctcgcttttagaaagttaattgataggttacataaatgaagataactatatcataggatgacgttctaagatagacgctaggagaattgacagtataaaaattaaaaagtttgcggataagtaaaatagatagacaggaagtaagtacttcctgcataaaataggttagaagttatcttttttctgacgtaatgcaataaattgagctaaatcgactgcttgtaagaacggattaatttgcagctctctagctaaagttgtcggcagagtcggttgcttgcgagaacgaagaatctccgcacgttcttgaatttcaaatagcccgcaacttggcggcaagaccgcttccgcaaattttagattgcttaacgtatattcatgtgcagggaatatttcgacaaattcaggcaatgctttaaagcgttgcaatgcatcaaattgtgcttggtaatcaccggtaaatacacgaccgcaaccggcggagaatagcgcatcgccacagaacaaatattcattaccgaataaataactgacgtgctgagcggtatgaccggcactttcaatcactcggacatcataatcaaataaagtgaaatgatcttcaggttgaacaatatggttagcgaactgagaaacttcttgcgatccataaactgctaattgagggtagagagagagcagttcaggcataccatcggtatgatcatgatgattatgtgttaataaaatagcggtcaaatttagctgattttttgcaataaatgtcaatacgggtgcagcgtctgacggatcgacaataattaggttattatctttttgaattgcccaaatatagttatcggagagtgccggaatgggggtaatgtttagcataatactttcctctataaaagaatacatggggaaaaccccatgtattcatcaaaaacgaattattttaagaagagtgccgctgcaccacgagtaccgcctgagtcaccgtgaatcgcttttttgaagactggtacttttgcactacgcattaaatgaggcggaagcgcttttggtaaagagtcataaatatgatcaaaattagataaaccgccgccgaatacgatcatatccggatcaagaatcgtaatgagattactgatactgattgccattaattcgatgtatttatccacaaattcgacaattttcggctcttttttatagaagcgttcgataatttcttttgcggatacgctttcaccgacaagatctctaaatagcatctcaaagccacgaccggaaatataagtatctaagcaagcacggttaccacaaccacattcataaatcggcgcattatcccaacctaatagttttaaagcatgataattcagttgcatatgaccgacttcacccgccataccgattctgccggaatgaattttaccgtcaaacacaaaaccgccgccaaaaccggtaccaataattaaaccgagtacggttgagaattgttggttattcggatcccaagcttccgaaagggcgaagcagttagcatcattttctgctcgtatttcacggcctaaacgttcgcttaaatcttttaaaatcgctttgccgtcagccactcgaatattggtaatttccgcaataccggtttcacgatttacaaagccgggtaaacctaaaccaacagaacctttttcgccgaatttgtgatcggcgttacgcaccaaggtttcaaccgtatttaaccaatcttcataattggtttgcggtgtcggcactcgttcgctatacaacttttcaagctgttcattaaatgccgccaactcaatttttgtcccaccgatatctaaaccgtaataaatagccataattagcctcgcttttgaaagattttgaaagtttctaagaaaggaatcacccaaacaaacacgataatgtggaatacccaagaaattaacgtgctaacaaataaatcgatagggtagtgcatacctaaacgtaagcggctgatgagcatgaggcccgcccataaaattgcaaaaatttgggcaaaaatgaccgcttttccgcttaaaccgaatagcaacccgccgaatactaataaccaagaaacggcaaaaatggtatgacctgaagggaatgaataacctaattcacccgcttgatgttctgcaacgaaatcagcatcagctggatgcgttttttctgcaagtgttaacactgcttgagcctgttcttcttccggtagcgcataaaattgttctgtttgtgcttggaacatttccgtaacaaatggacgaggctctttaaataccgctttcgctccttctttgatgatttgcgtaccgacgacggagcttgcacaaataaagccgactaaaaaccacgcatgacgtttacgagtgagccacattagccaaagcataaagagcacacaggtaattaaagcgtaaggagctgaacccgtttcggttaagaaaaataaccagaaatcaagatcgtaaagacggtaatctattcctccaaatgtccatttccaacctgtcgcccaagtgaataatggcacaagtaacatcaaaaaagtgaaaatcgagagttttttaatcacggaaagttccttataaaaaagaccgcttgcaagcggtcagatttggctaataaattacgaaattgctttcgttgcttttggtaagctgattttcttctcttcgctttggcgataaagaacaagaacgtggccgatagtttgcacgttagttgcttttgtttcacgcacgatcgcatcgataattaattgtttggtttcacgttccgcacctgaaatttttactttgattaattcgtggtgatctaatgcgttttcgatttcagctaacacgccttccgttaagccgttaccgccaagcatgacaaccggacttaagtggtgtgctaaaccttttaaaaattgtttttgtttcgttgttaatgtaatagacattgtttttttaaacctgtggtttgttgagaataaaatttggcgtagaaaatagcacaaaaggggcgaattttaaagtaaaatgcagagaacaacaaacaaaataaactagaaaaggactgattatgtcaacgttaagtgttgcgatgattgtaaaaaacgaggctcaggatttagcgaaatgccttgaaaccgtacaaggttgggtgaatgaaattattgtgctggatagcggtagtagcgatgaaacggtacaaatcgccgaaagtttcggtgcaaaagtgtatgtgaataccgactggcaaggctttggtaagcagcgtcagttagcccagcaatatatcacaagcgattatgttttatggctggatgcggatgagcgtgtaacgcctgaattaaaacagagcattttacaagcggtcgaaaaagatgaaaaaaatactgtctatcaagtaagtcgtttaagcgaagtattcggcaagcaaattcgtcattcggggtggtatcctgattatgtggtgcgtttgtatcgtaccgattttgcgaaatacggtgaagaattggtacatgaaaaagtccattatccgaaaaatgccacggtgaaaaaattaaccggtgatttactgcattttacttataaagatattcatcactatttagtgaaatcggcaagttatgccaaagcatgggcaattcaacgtgcgaatgcggggaaaaaggcgagtttattagacggtgtaacacacgctttaggttgctttgtgaaaatgtatttgttaaaagcgggctttttagacggcaaacaaggttttctgttagcggtgctttcagcgcattcaacctttgtgaaatatgcggatctttggaacagaacacgtaactaattgcaaaaaatcgtgaaaaaaagaccgcttgttgtgtgtagcaacaagcggtcttgttaattaaatatcctcttcctgatcatagccgtcatattcaaagtcatccttggctaatgatgcacagccatattgctctaatttatttttagtaaagttagaacggaatgccgagctattgttattcaagctaattacaccaatagtcgcattattacattgatgtttattgataaaaacgaggttgtagccggattcacggatataaccggttttattaattgccgcgtcgaaaatttcttcacgtactaatgcactggtattttgcataaatacgttacgtttgccggcacgaatatatgctgccttcgtattagagagctcttggattttggcattgttcagcgaatattttgccagtttaactaagtccatcgcactcgaaatattggcgctagataaaccggaactatcgctaaaacgagtagaacgcatacctaattgctgtgctttttggttcatcttttggatgaactgcgaacggctcatcccggcagaacgagaaagcgcatgagcggcataattatctgaatggactaacattgcttttaataattcgctgcacgcaatcggcgtatattttggtagtttagtaccggtgcctttgatgtaatcgaaatcttcgtccgaaattgaagcgctacagtttttatttttgttattttctaaaaaaacattcgccgtcatgagcttagtaacagaagcaatcggctgaacattattcgctgagcggctttctaaaattttatcgtgagtaaaatcatacaccacataagattgggcaatactaagggttggaaaaaggaaaaaaacagagagaaattttttaaacatattatgattcatcgagttaaaaattagcctgtcattctaacaggcttttgttatgctcgctatggattaaacaattcttaggaatgccaaaggttctttacaaaaggcacaattgtttttagcgcttccgagatcgaaattaagcctaaattcatttgttgcgctttttcttttgcttcgggcggcataaaggctaagtgtttaccttcttcattgatcggacgccaacggcgaggtaacgcagataaacggcttggataaaagccgatagttgcgacattcagtgtgccagcgatatgcagaggtccggttgaaccggcaataaacagatcggcacaagcaatcgaacaggcaaaatcttgtaacccgtcattcttatcatatacaactgctttggttgcagtaatttgtgctgctaattggtgagctttttcgctttcgcctttaccggcagtcagcacgatttcacaattagtttcactggcaatgctattaagcatttgcgcatattgttcaatagataagctggttgcagatccgccggtggatgcatgcacaaacagccatttacaagcggtcgaaatttgcagattttttgctaatttggctttttgttgtgcaatctgttcttcgctgaattgcaagtagggcgctttaggttcaactactgcaatatggtgcttttgcagaaaggcacgagctaaatctagattatattcgctttccgcttttgccgattgcgaacggcgttgcgttaaacgttggttatatagaaattgaaagactttggttgccggcgcaaggcggtgtttaatgccacttttccaagttagtttggcattgtaccagtcggaaacaaagcagattaccgcatcaaattgggcatttttgatcgcttgtaaaacacggttgaactcggttttgtcttttttattcggtgtatcaataatcacgttatcaatcgaagggcatagttcggcaagcggggcagtataacttggtactaaagctgtaatttctacattcggcatagattgtttcagcattgcaaatgctggaaaacacaccataaaatcaccgattttgtcattacgaatgacgagaatttttttcatttatattttaaccttttaaaacgaattacgtattattttagcatttttttatgtgagtttttggtaaaaaatcatgaaaatttgaccgcttgtttagtattaaacgttagattaaaaatcattacgagatttctctctaaattttagatgtaatttttacaaaattaaactagaatagacggaatgacacaaatgcaaccgtttgcgtcagttgtcttttattgtgaaaatttataggaattcgtatgtcagcaacaattttagaatctctcccattaggtcaaaaagtaggtatcgcattttcaggtggtttagatacttcagccgcattactttggatgcgcaaaaaaggtgctgtaccttatgcttacactgcaaacttaggtcagccggatgaagacgattacaacgcaattccgaaaaaagcgatggaatacggtgcggagaatgcgcgtttaatcgattgccgtgcacaattagcacgcgaaggtatcgcagcaattcaatgtggcgctttccatatttcaaccggcggtattccttatttcaatactacgccacttggtcgtgcggtaaccggtacaatgcttgttgcggcaatgaaagaagatgacgtaaatatctggggcgacggttcaacctttaaaggtaacgatattgaacgtttctatcgttacggcttattaaccaatccaaaattaaaaatctacaaaccttggttagaccaacttttcattgatgagcttggcggccgtttcgaaatgtctcaattcttaatcgctaacggttttgactacaaaatgtcggtggaaaaagcatactcaaccgactcaaatatgttaggtgcgactcacgaagcgaaagacttagaagaattaagcaccggtatgaaaattgtaaaaccgattatgggtgtagcattctgggatgaaagcgtagaaatcaaacctgaaaccgtttcagtgaccttcgaagaaggtgtgccggtagcattaaacggtaaacgtatcgaagatgcggttgaattaattttagaagcaaaccgtatcggtggtcgtcacggtttaggtatgtcggatcaaatcgaaaaccgtattatcgaagcgaaatctcgtggtatctatgaagcaccggggatggcgttattacacatcgcttacgagcgtttagtaaccggtatccacaacgaagatacgatcgaacaatatcgtatcaacggtttacgtttaggtcgtttactttaccaaggtcgttggttcgatccacaagcgttaatgttacgtgaaacggctcaacgttgggtggcaaaagcgattaccggtacagtaactttagaattacgtcgtggtaatgacttcaccattttaaatactgaatcaccaaatttaacttacgaagcagaacgtttaagtatggaaaaagtagaagatgcaccgttcacaccagcggatcgtatcggtcaattaaccatgcgtaacttagatatcgtggatacacgcggtaaattaggcatttatactgagacaggtttattatccgttcaaaacaacgtattaccgcaacttggtaaaaagtaatcttgatctaatgcttcagaaaatttagaatcaatcaaaagccccaatagtttacgctttggggctttaattttttcatcagtttttaaattaagcggtcaaaaattaagaattttttgcaaatgaaattagttgaaatatttacagacggctcgtgcttgggcaatcccggcaaaggcggtattggcattgtgttgcgttataacgggcacgagaagcaagttagcaaaggctactttcagactaccaataaccggatggaattgcgtgcggtgattgaagcgttggcaatgttaaaagagccttgccaagtgcagttgaattcagatagccaatatatgaaagacggcatcactaaatggattttcaactggaagaaaaataactggaaaaccgccaacggtaagccggttaaaaataaagatttgtggatagcgctagatcaagagattcagcgtcacaaaattgagtgggcttgggtaaaaggacactcaggtcatcgtgaaaatgaaatttgcgatgagttggctaaagcaggtgcaaataatcctacattggaagatgtagggtacaatgcggattagccaaaagaggcaagcggtcaaattttgcaaaatttttgcaaatttgaaccgcttgtaaaatttttcggcatatattatgcgttttttacgaagtttgctctacgcaaacgttttctttttttgtagaatataggttcttaacctttagaggtttttatggttgacattattattatcggattaattgcattttctatcttagtaagcctttggcgaggttttgtaagtgaagtgctttcacttgccggttgggtcgtagcgttttttgtggcaagcaatttttatccttaccttagcggctacctcacgcaagtaaattcggtatatcttcaaaactcagaatacttacgtaatggcatcgcagctgctgttctttttattatcacactgattgtatgtggcattattagcgctctgctaagcaaattagtggatacaacaggtctatcagcgacagatcgtgtgttaggcggtgcgtttggcgcattacgcggtattttgattgttgcggcaatcttattcttcttagataccttctcatcagcaagccaaacggaattatggaaagagtctcaactcattccgcactttgactttattgtgaaatggttctttgaacaactacaagctaattccagctttttaaattcgactaaatagagaggttttttatatgtgcggcattgtcggcattattgggggatcgccggttaatcaggcgatttatgatggtttaacattacttcaacatcgcgggcaagatgccgcaggtatcgtcacaattgatgatgaaaaccgcttccgcttacgtaaagctaacggcttagtaagtgacgtatttcgtcaagagcatatgctcagattacaaggtaatgcgggtatcggccatgttcgttacccgactgccggttcatcaagtgtttcagaagcacaacctttctatgtaaactcacctttcggtttaactttagttcacaatggtaacctaaccaataatgctgaattaaaagaacgcttattcaaagaagctcgccgtcacgttaataccaattcggattcagaatcattattgaatatttttgcgcactatttagatcaatacccgacagcgcatttaactcctgaaaatatctttgaaacggtacgtaaaaccaacgaagtgattcgtggtgcttatgcgtgtatcgctatgattatcggccatggtatggtggcattccgtgatccgttcggtattcgtccgttagtattaggtaagcgtgttgtagaaggcaaaacagagtatatgtttgcttccgaaagcgttgctttagatattgtcggttttgaattcgtacgtgatgtaaatccgggtgaagcggtttatattacctttgacggtgaattacattcggcaatttgtgcggataatccgaaattaaacccatgtatttttgaatacgtttattttgctcgcccggattcagtgattgacggcgtatctgtgtatagcgcacgtgtgcatatgggtgaattattaggtgagaaaattaaacgtgaatggggacgcatgatcgatgagattgatgtggttatcccaatccctgaaacctcaaatgacattgcagtacgtatcgcaaacgtcttatataaaccttatcgccaaggctttgtaaaaaaccgttatgttgcgcgtaccttcattatgccagggcaagcgcaacgtaaaagttcggtacgccgtaaattaaatgcgatttcaagcgagtttaaaggcaaaaatgtgttattagttgatgactctattgtacgcggtacaacatcggaacagatcgttgaaatggctcgtgctgccggtgcgaagaaagtttacttcgcatcagctgcgccggaaattcgttacccgaacgtatatggtattgatatgccgacttgtgaagaattagtggcttatgatcgctcagtagaagaagtggcggaaatgattggtgtagataaactgattttccaagatctcgaagcattatacaaagcggttcaggcagaaaacccaacaattcaacattttgacgcatcagtatttaccggcgaatacattaccggcgatgtagataaagcttaccttgacgcaattgcacacgctcgtaatgacaaagcaaaagccaaagctgcaaaacaagcaaccaatttagaaattcataacgaaaactaaattaaagcataaaaacaagcccttgagtctgagatgattcaagggctttttgtattaatggctatataaaacgatgccccttgaaaccgaaatttcaaggggcagagcgttgcgagaaattcatctcttattgtaacaacgtttttcatttcgcagtgccattacaatgattaaatagtatcgttgacattgattgttgtcaatatacatttattacaatttatgataaaaattaaacgccttgtaaaaaaggattattacaaattataagaggtgaaattgtatgaaattgacgccattaaactatattttaggtcttgatttagggattgcttctgtcggttgggcagtggtagagattgatgagcaagaaaatccactaggtttaattgatgtaggagtacgaacatttgatagagctgaagtgccgaaaacaggcgaaagtttggcattagctcgccgtttagctcgttctgctcgtcgtttagtaaaacgtcgagcggatcgaattaaaaaagcgaagcgtttattaaaagcagaaaatattttactttcggcagatgaacacttgcccaatgatgtttggcaattacgggttaaaggtttggatcaaaagctcgaacgccaggaatgggcagcggttttattgcatttattgaaacatcgtggttatttgtcacaacgtaaaaatgaaagcaaaagtgagaataaagaattaggtgcgttgctttcaggtgtagaaacaaaccatcaaattttgcaatctgctgaataccgcacgcctgcggaaattgctgtgaagaaatttcacgtagaagatgggcatattcgtaatcagcgtggtgcttatacgcatacatttagccgtttagatttattggcggaaatggaattattgttccaacgccaaacggacttgggcaatccgcacacttctgcaaaattattggaaaatttgaccgctttattgatgtggcaaaagcctgcgttggcgggcgaagccattttgaaaatgctcggcaaatgtacctttgaacccaccgaatataaagcggcgaaaaatagttattcggctgagcgttttgtatggctgaccaagttgaataatttgcgtattttggaacaaggggctgagcgtgcattgactgataacgaacgttttgctctgctcgatcagccttatgaaaaagccaagtttacttacgcccaagcacgtacaatgttagctttacctgatgaagcaatttttaagggcgtgcgttatcaaggcgaagataaaaaagctgtcgaaacgaaaactattttaatggagatgaaagcctatcatcaaatccgtaaagcattagagaatgcagatttaaaagcagaatggaatgaacttaaaaataattccgaattgcttgatgacattggcacagcgttttcattgcataaaactgatgaagatatttgccgttatttagatggaaaattatcggaaagcatattgaatgcgttgttagaaaatctgaattttgacaaatttattcaactttcacttaaagcattacaacaaattttaccgttgatgttgcaagggcaacgttatgatgaagcggtttcagcgatttatggtgatcattatggtaaaaaatcagcagaaattaaccgcttgttaccaactattccagccgatgaaatccgcaatccagtagtattacgcacactgactcaagctcgcaaagtgatcaatgcggtggtgcgattgtatggttcacctgctcgtattcatattgaaacaggacgagaagtgggcaaatcttatcaagatcgtaagaaactggagaaacaacaggaagataatcgtaaacaacgtgaaagtgcggtgaaaaaattcaaagaatattttccaaatttcgtgggagagccaaaaggtaaagatattctaaaaatgcgtttgtatgagttgcaacaagcaaaatgtttatattcaggcaaatcattggaattacaccgcttattggaaaaaggctatgtagaagttgatcatgctttgccgttttctcgcacttgggatgatagctttaataataaagtgttggtgcttgccaatgaaaaccaaaataaaggcaatttaacaccttatgaatggttagatggcaaaaataatagtgaacattggcaaaattttgtcgcacgagtacaaactagtggtttctcacatactaagaaacaacgtattttaagtcataaactagatgaaaaaggctttatcgaacgtaatttaaatgatactcgctatgttgcccgtttcttatgtaattttattgctgacaatatgttactgacaggcaaaggcaagcgaaaagtgtttgcttcaaatgggcaaattacggctttattacgtgggcgttggggtttacaaaaagtacgtgatgataatgatcgccaccacgctttagatgcggttgtggttgcctgctcaacggtagtgatgcaacagaaaattacaagatttgtgagatatgaagagggtaatgttttcagtggagaacgaattgatcgtgaaactggtgagattattcctttgcatttcccaagcccctgggcattttttagagaaaatgtggaaattcgcatttttagtgaaaatccgaaattagaactggaaaatcgcttacctgattatccacaatataatcacgaatttgttcagccgttatttgtgtcgagaatgccaacccgaaaaatgacagggcaagggcatatggaaacagtaaaatcagccaaacgtttagatgaaggtttaagtgtattaaaagtgcctttaacacaacttaaattgagcgatttagagcgaatggttaatcgtgagcgtgaagttacattgtacgaatctttaaaagcccgtttagaacaatttggtaatgatccagcaaaagcttttgccgaaccgttccataaaaaaggcggtgcggtggttaaagctgtgcgagtggaacaaacgcaaaaatcaggcgtattagtgcgtgatggcaatggtgttgcggataatgcttctatggtgcgagttgatgtctttaccaaaggtggcaaatacttccttgtgccaatttacacttggcaagtggcgaaagggattttgccaaataaggcggtaactgctaatgttgatgaaattgattggcttgaaatggatgaaagttatcaatttatctttactatgtacccaaatgatcttgtcaaagtaaaattgaaaaaagaagaattctttggttattacggtggtttagatcgagcaacaggggctattgtcataaaagaacacgatttagaaaaatccaaaggaaaacaaggtatttatcgtattggcgttaaattagctttgtcatttgaaaaataccaagtcgatgaactcggtaaaaatatccgtccttgtcgtccaactaaacgacaacacgtacgctaactgaatccctacactcttcgagtgtggggattttttgtatttaaggaagaaattatgacttggcgtagtattttaattagcaagggcggaaaactttccttgcagaaaaatcaaatgttgattcagcaagagggtaatgaatttactgtacctttggaagatattgcgattgtagtggtggatagtcgggaaacggttattacgattcccttattatctgcttttggtttatacggcattacgtttttaacttgtgatgaacagtttttaccttgtgggcaatggttgccatttaatcaatatcatcgacagctcaaaaccttgaaattacagctagaagctagcttgccacaaaagaagcagctttggcagaaaattgtgcaacagaaaatccgaaatcaagcgacagtgttgaagatttgcaaatttcaagcagaatccgaccgcttgtctaaaatggcagagcaagtaaagtcgggtgataaagagaacttggaagcacaaagtgcggtaatttattttcaaactctatttggtaaagggttcaaacgtaccgaagatgagaatatggtcaatagtgccttgaattatggttataccgtaatgcgttctgcggttgcccgtgcgcttgtgttatatggttggttaccccaaatcggtttatttcatcgcagtgaactgaatgcatttaatcttgcagatgattttattgagccatttcgtccgttagtagatttattagtggtgcaacttgcgaatgatgataagttggcgttcaatttatcgcctattttaaagcagcgcttaattaaggtattaaattatcagcttttatttaaacaagaaaaagtgaataccttaaccggtattgagcgaagcgtgagttcatttcaatctgcattaactcaacgaaatgcagatttgttaaaacttcctgaaattctaccgcttgcggagcatcaatatgagtgagaatgtgtttatgcgtatgattgtattatttgatttacctgtaacaaccaaagccaaaatgcgagccgcaaatcaatttcggcaatttttgctgaaagatggctaccaaatgttacaactttctatttatactcgaattattcgagggcgagattcaatggaaaaacatcataaaagactagtagaacatttacctgaagagggttcaattcgttgcatttctattactgaaaaacaattcgccaatatggaaattctagttggagagaaaaaattgcaagaaaaaaaggtgaattcgaaccaacttttactgttttaaggcaatttttttaataataaaaaagccttgaacccttactgctcaaggctttttagagtcccgattatagcactgcgaaatgaaaaagggagctacaaccctaagaatgttgttatcaatattgattcaattatagcactgcgaaatgaaaaagggagctacaaccactatgtttgccttatctgctattggatcattatagcactgcgaaatgaaaaagggagctacaacgacagcattaatatcgcgatccgcatcctcattatagcactgcgaaatgaaaaagggagctacaactataaccgataaattgccaatcatcggtaaattatagcactgcgaaatgaaaaagggagctacaacaaaacgtgagagaatttattcatttttggaattatagcactgcgaaatgaaaaagggagctacaaccgctgttggatatttgagtggccaacacttattatagcactgcgaaatgaaaaagggagctacaacttcgtttaccgcatcatagttaaagccttcattatagcactgcgaaatgaaaaagggagctacaacaaaaaatgcgaaaaatggcagcaatattgaattatagcactgcgaaatgaaaaagggagctacaacggaatttatgagccatgtaatatctatcccattatagcactgcgaaatgaaaaagggagctacaactacaccgtttgagcaagaagtgccctgattattatagcactgcgaaatgaaaaagggagctacaacctttcgctctcgctttggctcgccccatttattatagcactgcgaaatgaaaaagggagctacaacagtggttgagggtaatgcctaatgtatgcgattatagcactgcgaaatgaaaaagggagctacaacattctgaccgggtttaacagatatgctgtcattatagcactgcgaaatgaaaaagggagctacaactaggacggagcttataccttcgtaaagcaaattatagcactgcgaaatgaaaaagggagctacaacgcagtgaatgaagtgatgtaagcatataaaattatagcactgcgaaatgaaaaagggagctacgactcctgacgaagtcgtgtaccagagtcgaattgtagctatgtgaaataactaagaaagcttatttatacacctgtggtattgagtattcaatttgctgtttgatttgagcgtagattggtttgaactcttcgcagcgagatttatcaacattagctttttggtggttatatttttcatgcatttgctcaaagtaaagacgtgaggattcgtctttttcgatcaattgagcattgtgttcgccaattaactcttttaataaattttgctggaaatagagcatcgtcatgctttcggcaacagaccaattgtcatagatttgttggtaattcggttttgcaagatcggggaaaaggcattgttcaatattatttaactgacgaaccaagattttcatatcggtagcggagattttgtatttggcgtgttccgtataagcggtcggattttcagcagaatttgcaaaactggtgtggcataaagctgcacaaatcaaggtaaataaagtttttcgcattgtatttattcctatgtctgtttggcgcagcatagcatagatcttttatttcgcgcaaaaaataaaccctccgaagagggcttattttagtggaaatcgttatacgataccttgttctaacattgccgttgccacttttttgaagcctgcaatatttgcaccgtttacatagttcacgaaaccgtctgcttctgtgccgttttctacacagttttcgtgaatagctgtcatgatattgaatagacgttgatcaacttcttcacgagtccaagataaacggattgcgttttggctcatttctaaacctgaagtcgctacaccaccggcatttgccgctttacccggagcgtaaagaattttcgcagcgataaacacttcaacaccttcaagtgttgttggcatatttgcgccttcagcgacgcagaaacaaccgtttttcactaattcttttgctgcttcaccgtctaattcattttgtgttgcacacggaagcgcaatatcacatttcacaccccatggtttttgaccttcaaagtattggatgccttgttcttgagcgtatactgataaacgttcgcggcgttcattttttaacactaataaatctgctaattgtttttcagtcatacctgaatccgggaataacacataaccgtttgagtcagatacggttaagactttcgcacctttttggattgctttttctgcagcgtattgtgctacgttacccgagcctgaaataacaacacgtttgccttcaaaaccttgacctttagttgctaacattgcgtctgcaaagtaaaccgcaccgtaaccggttgcttctggacgaattaagctaccgccccaagttaagcttttaccggttaatactgaggtaaattcattacgtaattttttgtattgaccatacatgtaaccaatttcacgcccgccaacgccgatgtcgcctgctggaacgtctgtatctgcaccaatatggcgagataattccgtcataaatgcttggcagaaacgcatgacttcagcgtctgatttgcctttcgggtcaaagtccgagccacctttaccaccacccatcggtaatgtagttaatgcatttttgaagacttgttcaaatgcgaggaattttaaaacacctaagtcaactgtcggatggaaacgaataccacctttataaggaccaatcgcagagttcatttgaacacggtaaccacggtttacttgcacttgacctttatcatcaacccaagttacacggaaagtaataacacgctcaggctcaacaatacgttctaaaataccttgttgagtatattgtggattttttgcaaggaatggtgctaatgaaccgaaaacttcttccactgcttggtggaatggtgcttggttaggatcacgttgtttgattttttggaacaatgcgtttaagtcgctcataaagtactcctgttatgtttgaattttagtaagaaataggttgtgttttgctatgtctcggagtctagcaagcaatttttaatttgaaaagatgtaattaaaaaaatttatcaaataaattacaaaaatttagtcaactgattaaaaaatgctctgctgttgattttttatgatttttaataggggtaaatgctcaaaagttaagttgaaattgatgatttgattgcaaatttggttatgttgtacaaaaactaatggttgggttaaggattagaaatattaatgaatgattttcgacataaaaaaaagcccacatctgtgggctaatgaattattccgctttagtcgcttcaatcggtttatctaatttaatatcacgaactaaaccttggttatcgaagtaaacaaagagagtatgctgaataggatcgttatacccctcacgtttaatgaaaacataatcccaacggttttgtgcaaatacgtcttgtaacataggtgtgccaagtaaatattgcacttgggttttattcataccgacttgtacttgatcaattttgtcttgttctaaatagttaccttgtggaacatcaatacgatacaccactttttttacggtagaacaagaggtaacacctacagcaagcagtgcgatagctaaaagagatttcattttcataatatttattgacctttgaattgttcaaaatgattggatagataatacccaaactcataaaaattttccattatttattgcgttccaactggtcacgcaaatttgctggtaaccctttgattgttaatgtatcgtttagttcatcccaaattaaacgttcgccgagtaattccgcattaaaactaattgttacgcccttacctgagcctgaatatttggttaaggtttttaatgcattacgaactggtggaatattttcttcaagcccgtattcttgctcttgagtaaattgtgcaaaattaacttcgttaagtgtcggtagcgcttcagataattcacttaaggcgatttcttcgccgctgttaatttgccctttacagtattcaaatacttgctttttcacttctcgagtttgcggggcagataattcaccttgatcacagtagtcactcaccgcttgtaaaagcgtttgattttgtaattgagggttaaaaccttcttccgcactcagaaaatccataaagaagtccgcaatttttcgtccgactcgccctttaataaaggtgagataacgatttgattgtgcattgatttttaattcagtcagattgatacggcaagcgatatcatactgagtaatatccaaatattcggtgcgttttatgtctaattgatcgtcgactaacattgaggtacggctatcaatcaatgcgataaataaataatcagtggctaaaaagttataacggcaaaggataaaggttccgcctgatgcaaaaggatatttcgctaattcgctagagagcattttggcacaactgtgactgaacggtaaaaaatcagtttcctgttctaataagcgattaagttgctgagcaaaaatagattcatttttaaatatgccgtaagcctttgctttactttggtaagcttggtgaagctgcaacatcatttgctccacttcaggactaatggcaagtagattgtcgcgaagtaccgtatttaactccggtgtttcaccttcggtttggtgaatctgatgaaggacgatttcagtaacattaatgctcatactatttctcttgagattaggggtagaaataaaaggtgggagatattatcattaaacgtactatttttcattactaaaagaaggaattcatatgactaaagttattcatacagaaaaagcacctgcggcaattggcccatacgtacaagcggttgatttaggcaatcttgttttaacctcagggcaaattccggttaatccgcaaacaggcgaaatcccaactgatatcactcaacaagctcgccaatcattagaaaatgttaaagcgattatcgagcaagcaggtttaagcgtagcggatatcgtaaaaacaacggtttttgtgaaagacttaaatgattttgcaacagtgaatgcagagtatgaagcatttttccgtgaaaataatcatccgtcatttccggctcgctcatgtgttgaagtcgctcgtttaccaaaagatgtcggtttagagattgaagcgattgcagtacgcaaataagcggtcatttttagagaaaattttgcaatgaaaaacattacgccaaattggcatgcgcctgagcatattcgtgcctttactaccgtcagaataggcggcgtcagccaagtaccttttgatagctttaatttaggtgatcatgtcggcgataatcctaaggatgtacaacaaaatcgccagttattggtagagcagttcggtttaccgcattttccactctttttaacgcaaacacacagcactcgtgtgattcgcctaccgtatgacggcgataatttggaagcagatgcggtttataccgatcaaccgaatcaggtttgcttagtgatgacggcagattgtttgccggttcttttctatagtaaagatggaaaagaagtggcggcggctcatgccggatggcgaggtttatgcgatggcgtattagaaaatacggttgctaaattcgcttgttcgccggcggagatttgtgcatggctaggaccagcgattggtccaactaaattccaagtcggtaaagaagtgattgagcagttctgtgcttttgatccgcaagccgagctggcatttattgcggacccgacaacaagcggtaaatttttaggaaatctttaccaaattgctcgacagcgattgaataaacttggtattaccgaaatttccggtggagagcattgtacttttactgaacaagaacgctttttctcttatcgaagagataagcagactggacgtatggcaagcctgatttggcgttctgaataaagcacaatttatagcgagtatgttttttatgcgggtgttcgcctaacgctagacgaacacccaaaatttccctataatccaacctcatttcttaatccccccttagctcagtcggttagagcaggcgactcataatcgcttggtcactggttcaagtccggtaggggggaccaacttcacttttccactctttcgttttctttcgtactcttacactcaagccttgatattactagctttatcgtactttttcattattttttcttacgtattctttcgcattcattcgtttacagccgtgaattttagttatacatttagttatacggagcatataactaaaaaaatcgtataactaaaagggctaaaatggcgagattaactaaaccacttactaataccgaaatagagcgagccaaagctaaagagaaggagtatacactttctgatggtggcggactttatctacttatcaaatctaacggcgctaagttatggcgctttaactactataaaccgcttactaagaaaagagccttaataagttttggccgctatcctgatatatcactacaacaggcgagaaaacagcgagatgaatgtttatctctattagcggtaaatactgatccactggaacaccgccaacagatggaaagagaagagcaagccaagctagaaaataccttgttgaaaatagttgagctatggcatagcaaacgcctcgatgatgtaaagcacggggagattcaagcagaaactctacggaaaaacagggcaatcttagacaagcatattttgccaatgttaggtcatttagcgataacagagattagcccaagaattgtagtcagtgcgctagagccagctaaagaaagaggtttaggcgatactctcaagcgtgctattcgattattgaatgaagtgttaaatttctcagtaaatgcagatttgattgagtttaataaatgcctgaaagtaagcgatcatttcagtacgcctaaagccgtgaataacccaaccattccgccaaaagaattacctgcgtttttagaagccctgagggatagcaatttgtccttacaaacgaagttattgattaagtggcagttgctcacaattacccgcccaaaagaagcctgcgaagcgttatggcgcgaaattgattgggaagctaaaacctggacgttacccgctgaaaaaatgaagatgaagcgcccgcacgtaattcccttaagtaaccaatcattgcgcatacttgaaaagatgaaaaagattacaggtaacagccctttcatatttcaaagtgagataaagcccaagcaaccaatgaatagccaaacagcaaatcgagcaatcaaactactaggctatgaagggcgtttaactgctcacggtttaaggtcgatagcttctacttacttgaatgaacaattagtcaattatgacgtggtagaggcttgccttgctcacgttatcaaagaccaaaccagaaaggcttacaaccgttctgattatctcgatcaacgagtagaagtaatgcaacaatgggcggattatgttgagaagtgttctattgggatttagtagagcattttcagaacatgggggaattaacgatttttacctatactgtataaatttattccctcctctctattaggaagcatatttttaatagtccaatagtccaaaacaccctttttaaggtatgaaatcattatatatcaataagttagatgtaaaattattggactatcattggactaaaatcaccatttttggactaaaataccccctttttggactatttattgaaaatttagtacggcaaataggatacttttaaggcgaattatattttacaaactcaaatgaatacggaataatgcgtaaaacaacgcaattttaaaaaattgaggtattaaaatgaaaatgccaaaaccaccagcttatgacgagttactccaagcaccagtaaaccataatgactttttcaattacttagctgaatttaaagcgacggatgagaaagggcggtatcttgcgtgggataagttcaagcgggtaaatcctaatgatagtttgcaaaaatggctggcggtaaagatgaaccgcaaaacattacagaaaacacttaagataggcgatatttcttttgctttttgtgtacctgatagcttacaggcgacactacatttcattgataaatcaactggcggaagtgttggcgtgagtagcctcgagggcttaagtaagcaagaacaggggcgttttttgttgaaatctttagtgatggaagaagcgataacctcagcacagctagaaggggcggtaacaactcgaaaagtagctaaggaaatgttagaaacggcaagaaagccaagaacaaaagacgaaatgatgatagtaaataactattatctgatgcaagaagccatagctcgtaaagatgaaccgcttagcattgaattgattcttgagcttcatcgtattgcaacgcacaacgccattgaaaataaagccgtagcgggagagtttaggcaagatgatgaaatttatatcgctgatgaatacggagataaaatccatcaaccgccaacgcataccgagctaaatcatttaatgacagctttttgtgattttgccaatgatgaacatacgggagagagtgggaattttattcaccctgtaatcaaggcgatcattcttcatttcttgattggctatatccaccctttcggagatggaaacggaagaaccgctagagccttgttttattggtatatgctcaaaagcggatattggctatttgagtttatttctgtaagtagattactgaaagaagccccgaaacaatacgccatgagctatatagatacggaaacagacgagttagatatgacgtattttctttactatcaagctaatattattaagcgggctattgctgatttagaaaactatatcattaataaacagcgtgattttagtaactttgtgagcgtgatagcggactttaccgccaagacaaaaatcagtcatagacaaatccaaattttgcaaaaagcggttaaagaaacaggctatatcttcacggcaaaagaaatcagcaatgaatacggtatatctgagaacacagcaagaagcgatttaaaggcactactagacttaaatctactgggacaattcaagataggaaatgctatcgggtatatttccccgaatgatttactagaacgtcttaaacgtgcttaggtaactgtttataaaaacaggttttcctttattagcacgaaagaaaacgatataatacgcaatattacatagccttaaatggctttccaatttgagcaactaggagcggactaattacccgagccgaaaagaaactacccctattagcttcctgttgctcactctcttaatagggcaacgtgtaggggcgtttatggcaaaatcacaggattattataataaattacctgattgttcaattgttgattatgaacttatcccacttcctgaagcttgcttattatggtgcggggtgagctttgaagatttagctgatgaagttaaacttctgacaaatatatcacaaagtatttataaacacccttatattccttgtttagaaaagaaaacaagagttataaatagggcaattaacgagggtaaattaagagtagttagagaacacggagagggtggagaaattattacagactatttaggtaacataaaaagagataataaaggcaatcctttaattgatcacgttgcttatgatcgcaggcatttttggattaaagacttaaaagcttttatttctgaaaatttcccaaatgatcgccctaaaacaattttctatgatgaggaattaaaaccatctgtaaatgttgaagacaatttaaaattacaagcaaagatcaatgaactacaaataacactggcaagcgaacaaagcaaaatccgtgattatgagttagcaatgcaatcattatctcatcaaacccaattagctaaaacagcacaacaggacgcagaggagcgattagaaagaggacgtgagttgtatcgacaattacaaacggcttataatcaacttaagctcccccctgaaagtaatataaacttagataataccctttacttactaggcgaagttatcaatgcagtaaaatccaagcataagcaatggacacagtctgcgattattgatgaaatttttacactacgacaaggaaaatcaataacaggattagaacagagaacaatcgaagaatacttttctaatgcaaataaacggctaaaagccaaataaccgcaaacgcccaaattatgagggcgttttttattgccaaaatctctttattttcaattagttattttcgcaacgagaaaatctttttcggctgcgatgacctttctgacacgctctaccacaatacgccccgaatgattaactaataaatcgcaaaggagcgtaagaatggaacatatcccatcaatcgaaactaaccaacctcaaactatggcaactccgccaaagcaattactcaatgttcaagatgtgcgcacagtaactggtttatcagttactactatctacaaactcgtgaaagatggcgcattcccacagccgaaaaaatgcgggcgatctactcgttggcgtttagcggatattcaagcctatatcaattcgtagggggagcttatgaacgctaatactacacgtaaagaaaagctaggaagctatttattagcaagccgtaacggcttttctgaactggacggaatgagggaattaggcattaccagcggtcgaaacgagatcaacgaactagaagcgattacacagactgaatttattcgtattcaagaacataaccaaaacggaggcacatattttcgctatttcttagcggataaaacacaagcggagagattaatcactttcctaaatggaaaagcagtaagtcgtaacgcagcgattccctatccgccaacggtggcggaatctgtacttaatcaattagcaacgccaacacaggcgcaattacagcacaaagtgcgtaaaccggtgaaaggagtgtaaaaggagtgattcagtatgaagtgtgaaatagccaagatgaatacggtattaattcagcacgcatttgattactacgctgccggcaataagaacgtattcacgtttaagagcctgtacaacgatgaagaaccctacccgcttgaggagcttatcacttgccttaatacgcgcattcagattttagaagcggaacagcaagaaaaacacaccgagagccggcagacttcaatctggctatatgcgaaaagaattaagcaattggaaacgattagaaaggggaaaatgagatgaaaggattaaatgagcaattaccgattgaagcggtatttcctaaagtgtttcgtaaagaaaccgttgcaatgacaaatactctcaaagtagcggaatatttcggaaaacagcataaaaacattttgcaacgtcttgaaaatttagactgttcagaagcatttaaccggctgaattttaagcccgttaagtacaccgaccaaaagggagaaagccggaagatgttcttaatgacccaagacggctttacgcttttagttatgggatttaccggtaaaaaagcaatgcaattcaaagaatcctacattgcagaatttaaccgaatgaaaaagcaacttgatagcaaagaccgcttaagagatacgtaacacttacttaatgaagcgattgatttcaaacagcagacctctgaaaaagaagatccgcacgcttacagccgcgaaaatactctcgtttattgtgtagcgttgggcatgagtaaaaagaaatggttatcacagaatggttatccggcagatgttgaaatccgccaatttctcacaccggaacaacttgatttaatccatttactggttacggaaaacgctaccatgattaagttaggcttggagtacacagtacgtaaaaatcatttacaagcaagtgcgttgcattactggcgcaaactagcggcaaataaggaaaaataatgacaacaacctaacacccaaacaagaagcctttgcgctgaaatatgttgaattaggtaacgcaagcgaagcataccgccaagcctacaatactgatgaaatgaagccggaaaccgtccaccgaaaagctaatgagctgatgagtaacggcaagattacggcaaggattgacgagctaaaggcagaacatcaagcacggcacaagctgaccgtcgatgacttgctaattgatctagacgaagcgagaaacatagcaaaagagaacggcaatgctaatgcaatgatttccgccacaatggcaaaagcgaagttattggggcttgataagccaacgttagaagtagcggtaaatggtacgttagacaatatcccgacagttatcgaacttgttgcacctagctttgataactcgaattcttggagtccataaaaacgccctcaaagcgacactaagagggcgaaaacaaaaatttaaaaaaggtatttaaccgatgaatattttacagtacatcacaacaaatagcgacacaatcgacaataatccgcaaggttatttagatatggttcattccgtactatcggcggaatttgcaaaaaatgaagaaaattcgaccgcttgtaaaaagaattgctttacaagtttagcgaataaggtttatgctactctcgctttcgcaaaatcggaagccgagcgtggaaactcgaataatttacttgtggcgaacactagcacgcctttcaatgaccgtgctttttttgttcgtggactaaacacacctaaagaaaatgaccaatccaaaaatggattcgttacatttctctctatggtagcgtttagtgggcaacgtttaatcgttggctgtgttccacaagtcgcagttttccaccccgctaaacgctatcgccaagccgtggaaagcaaagcgatagactctaaaaatttacttgtggagctatcagccatgatctacctattcaaagccgtaagccgtttagacttacgcaacacgtcaaaaccgatttcatcattcccttgctataccgtgcgtattaaagccaatagcttagaacaagctaaagctaaggtctgccctttctttgccgttaaagaggtggtttatgcgtaacacaaataaattgattgaagatattcgtgagcaaaccgacaacctcgatatgctccttacctatgcgaatagtttatcaagtgcgattagcgtcgatcattctgagtgcatcagtgtagatggcgaaagcgaatttacttatagcagcgatattgccgacggcttacttgcgcttaatgattaccttattgggcagattaaacaggcacaccgccaacgtgatcaacagatttatgaattaatcaaagttcacgaagcacagaccgaagcattgaacgcttacaaattggcggaatgtgaacgaaaagcggtggaggtagcgaaagatgagtaaccaacaagcacaatttaacgaaggaatggctaaatgttggcaagcggcgaccctattagatgctatgtcaaaatcacgtcttcaagatatggatggtgtaagtattagtatagcaatcgaaggaattcacggcattcttatatctgccttatctgaaatggaaaatttaaactttaagggaggcgagaatgagtaatctagaaaccctccattcaatcaagcagccgttagatatggcgaagatattccttgagattgctttaaccggcaacggtgcggtacgacgtgaaaacggtacgctgatgagcagagatgaaatactggcggaagccttccaatacttagatgaagcgcacacttacttacaggaagtgatcgaagaggtggagtatgaacaaaatccgcttttatgatgaccagttagcaaaaacgaacgctttcaacgattggattattctagcaggaagagacgtacataaagcctattaccgatggaataaagagactaaccattcagaagcaggcaaaggcgaaagatgggcattaattcgtgatagcttcaagctaggcaatgatatgattccgtgcttgttggatagcaaagatttgggccaattagaccgcttgttacttgcgccggcagcacaacgattcattaaaatattccaagtgggggaactccccactttggcgaaagataaagatgattttcgcacccgagtattgatgaacctcgcagaacattgcccgaatcttaccgccgtagaatggctagatgaaggctttaatacggaaaacctaaccagcgaatatcagcgcattaagaacggacagcacgctaccgcagagcttttagagcaacgcacacttaaccccgaagatgataccgctccacgtgtagaaatgcgtaagcgtggcggattaaaaggcttgtactatgttactactcgtattgtggacggtgagaaagtcgaaagcgaaaaatggttatccgattttgtcgaggtcatcggactaggcaaaggagaaagtgaacatttcattattttgcaaaaagagaagcaagaacgaccgcttgttatgccgctaaaagatattggtgagcgtgacggctggcagtatttgaaacgtaatgatgtgacggtaactactaagcaagcactacgggcggaattagccgattatttgcaatttaaaagccgaaccgccaagcagtattacattaccgacaaaaccggctggaatgaagatttaaccgcttttaccttgccaaacggggaaaccttagggcaaccgcaaaccccgaccattttccgcaatttaacgcagaatatcgaaggatatagagtaagcggaacaacagcggactgggtggagaatatcgggcgttattgcgtaggtaatccgtcgatgatgttatcgattggcgtggcattaagtgcgccattattgaaacctttagaggcggacggctacggcgtacacctttacgaagattcaacattcggtaaaacaaccgctttaaatatcgcttcctcaatttacggacacccaagagaaactcgtacagcatggaacgctacaccgttggccttacagaacgaagcctttagccgtaacgggctatttatgccgttagatgaaatcagcgaagccagtccgaaagccgtcgcacagaccgcttatagcttgtttaacggacaagggaagttacaaggtgcgaaagaaggtggaaatcgcaagtcgattaaatggctagtagcgaatctctccaccggtgaggaaggtttagagagctacctcaagcaacaagggataaaggtcaatgccggccaattagtccgcttactcaatatcccgatgaaacgagcgacagagtttcacggcttggcggacggtaaaacgcacgctgacgcgctcaatgcaaacgtcatgcgctattttggtgcggtgggtgtagattggctcacttatctagtccaagcggaaaaaagcgcattgagagcgttatacgacaaagtaaaacaatctcgattaaagagcttgccggataattcagaacctcaaattaagcgggtgatggcggatagattcgccctcattgaaaccgccttattattggctaaggatatcttacaatggacggaaaaggatatatcaaacgctatcacggctaacttcaatgaatgggtaaacgcttatggctggcactcgaaaaagcatacacagatcattgaacaagtgaacggttggctattggtaaatgctgatactcgttttgaagagtttccaccggacggcacacagaagcctatcagcaataaagccggttatcgactggtagaagatgaccgttattttgtcttcaaaagcgtatttgaagatgaagccttacaagggcagacgaaagaggttgcacttccggtattagttaaagcgggcattcttcataagggagagggcaacggctacgcatacctccaacgaataccacacaagatcaacccaaagagaacccgagcttatctgatagagattctcaatgagaatagcgacgaatagccatatcattaaactacattcagaccgccattattggcggtttttttgttatgctttattgtttataaaatgcactttttatacaacctgtataaatttattctccctttctattaggaagcatatttttaatagtccaatagtccaaaacaccctttttaaggtatgaaatcattatatatcaataagttagatgtaaaattattggactatcattggactaaaatcaccgtttttggactaaaataccccctttttggactaaatgcttaagctaaaaaaataaaagagccaaaaaacatttagtccaaaaaccacctaaaatagtccaaaatgtaaaaaaatagtccaaaaaattttatgtaacctattgaatataaaaagaaaagttggattttggactaattggactattggactacgaatttttccttatataatagagagggtggaaggtatgaaaatcttatacagtggttttatgactgccactacaaagcttttagtataaaaggtactcctgaggggataccctttccacggggttggggccgcgcggttttcggcagattttacgatttttaggcatcatcatcatttaaaaatattttcattgagcaataagctactacactctaggaacaagccggcataaggcttttacctcattttataagaaaccttccattcagcacaaaggcttaaaagatggcgattgatgtcgaattaggtataagccgtcggctgacacctctcctaagttagaggatgttaggagacaaacaaagaactaactttcttacgctaaagaattggttataaagtaggctaattggtgggtgactttttgatttagttatacgtttagttatacggaataactttggttttgcttggggtgttgtgttgcaatgctttgtgtgggttggttcaaactcggtagggggccaacttaacttttctactctttcgtcttcttacgttttcttattctcaagccttgattttactgtcttttatttctttttcccgcattgtgtttttgtacgtgtaactacaaaatttagttatatttctttattggtttaatgtgaccggcagcattaacgtatcaagcacaaaacttagtggtaaatcaaccactgccggaatactcaaaattccgccgctttggatagctttgaagtctttgctgactccggcataagccgaataatcgccttctgataggctgatgatagtgccgcaagcggttaaattttggctaaaaattgcaattgcagtgagttttagaaataaagtcttcattttgttcccctaattgccgattattctagctcaattttgataaaatcccacccgatagactgaattttgaggtagaatattccacttctattcataataataagaggattttatatgcaaacttacaacattgcggttttagcaggtgatggtattggccctgaaattatggctcaagcgattaaagtgcttgaagcaacacaacaaaaattcggttttaaattaaattttaatcattttaatatcggtggtgcggcaattgatgcgcaaggtaaagcattaccggaaaatactttaaaaggctgtgaagaagccgatgcgattctgtttggttcagtaggcggacctaaatgggtaaatttaccgccggatgagcagcctgagcgtggctcattacttccattacgtaaacatttcaagttattttgtaatttacgtccagctactttatataaaggtttagagaaattctgtccattacgtgcagatattgcggcgaaaggcttcgatatggttgtggtacgtgagttaactggtgggatttattttggtcagccgaaagggcgtgaaggcgaaggagcacaaaccaaagcatttgatacggaagtgtattataaatatgagattgagcgtattgcgcgtgtcgcttttgaatcggcaatgaaacgcaacaaaaaagtgacatctattgataaagcaaacgtattacaaagctcgattttatggcgtgaaacagtaagtgagattgctaaagaatatccggaagtaacacttgaacatatgtatattgataatgcaacaatgcaattaatcaaagcgccggaaacctttgatatcttattatgctcaaatattttcggcgacatcatttcggatgaggcggcaatgattacaggttcaatgggaatgcttccgtctgcaagtttaaatgaagacggtttcggtttatatgaaccggcaggcggttcagcaccggatattgcaggtaaaaatattgctaacccagttgcacaaattttatcggcggcaatgatgttacgttatagttttaatttaaatgatgcggcagatgcgatcgaagcggcgattcaaaaagcgttagcagatggctatcgcacaggtgatttagcggatgaaaatgcaccggtttctaccagtgaaatgggcgatattattgcgaaaaatattttagcttaaatagcagattcttcagtataaacaagcggtcgaaatgtgaagtttttttgcaaatttctttcaaatttcgaccgtttttctttatgtttaatgtagaaaatgatatttaatttataaaattaattaaccgtcaatttcttcacctgtttcatcccatttaaagttgagcgcgatagagtttaagcagaaacgtaaacctgtcggcggaggcccgtcattaaatacgtgccccatatgcgaatcacagttaccgcaacgaatctcggttcgatgacgacctaaactatagtcatctagataacgtaatgcatcgtctgaaactgcttcgtagaaacttggccaaccgcaaccggcgtcaaatttagtatcagaacggaataatgcattgtggcaacgagcgcaacgataagtcccgatgcgttcttcatgtagaaatttaccggtaaacggtatttcggtgccgtgattaattaggatttcaacttgttcttccgttagttcatcaatatctttaatcatattcactcctaagatagaaatttttctccaattctaccgtttttttaccactttagcgttacaaattttaaaattttgacatagatcacaaaaaatttatctgttatatttgtttcggttcttttagttgtaagtcatactggagtatgtgctataattcaggtacttcttaaagcattagaagaacaattttgtttaactttaatataggtagaaaaatctatggcaattaaaattggtattaacggcttcggtcgtatcggtcgtatcgtgttccgtgcagctcaacttcgtgatgatatcgaagttgtaggtatcaacgacttaatcgacgttgattatatggcatatatgttaaaatacgactcaactcacggccgtttcaatggtactgttgaagttaaagatggtcaattagttgttaacggtaaagcaatccgcgtaacagctgaacgtgatccagctaacttaaaatgggatgaaatcggtgttgatatcgcagttgaagcaacaggtttattcttagatgacgctacagcacgtaaacacattactgcaggtgcgaaaaaagttgtattaactggtccatctaaagatgcaactcctatgttcgttaacggtgtaaacttcgatgcgtatgcaggtcaagatatcgtttctaacgcttcttgtacaactaactgcttagcaccattagctaaagtaattcacaataaattcggtatcaaagaaggcttaatgactacagttcacgcaacaactgcgacacaaaaaactgtagatggtccatcagctaaagactggcgtggtggtcgtggcgcttcacaaaacatcattccttcatcaacaggtgcagcgaaagcagtaggtaaagtattaccagcattaaacggtaaattaacaggtatggctttccgtgttccaactgcaaacgtttctgttgttgacttaactgttaacttagaaaaacctgctacatacgaagaaatctgtgcagaaatcaaacgtgcttcagaaaatgaaatgaaaggcgttttaggttacacagaagatgcagtagtatctacagacttcaatggtgcagttgaaacttcagtatttgatgctaaagcaggtatcgcattaacagatactttcgttaaattagtatcttggtatgataatgaaactggttattcaaacaaagtattagacttagtagctcacgtttataactacaaaggctaatcttagttagtttgatatattaacgccactcttagtttaagagtggcgtttttgtttttaatcgattggattttgttatccagcggtaaattaagttaaaaactaagcagttttgctattcaagaaaattagtcattgaagtctggtaggcttttttgttatatttataaatatttttgctcctttgtgagcattattttttatacttgcaaaatcaccaaattcatttaatggatcactttatatgtttaaaaaatttctaggattgttttctaatgatctttctatcgacctcgggacagcaaatacattagtgtatgttaaaggtcaaggtattgtgcttgatcagccttctgtcgtggcggtacgtcaagatcgtattggctctttaaaaagtattgcagcagtaggtacagatgcgaaattaatgttaggccgtacaccaaaaagcattacggcgatccgtccaatgaaagatggggttatcgcagatttctttgtaacagaaaagatgttgcaacactttattaaacaagtgcatagcaataattttatgcgcccaagtccgcgtgtattagtttgtgttccggcaggtgcaacgcaagttgaacgtcgagcaattaaagaatcagcaattggcgctggtgctcgtgaagtttatttaattgaagagccaatggcagcagcgatcggtgcgggtttgcctgtacatgaagcaactggttcgatgattattgatatcggtggtggtacaacagaagttgcggtactttcattaaacggtatcgtattctcaacgtctgttcgtatcggtggtgataaattagatgaagcgattgttgcatatgtacgtcgtcatttcggttctgcaatcggtgaagcaactgctgagcgcattaagaaagaaattgcgatggcaattattcgtgatgaagatgaagtacgtacgatggaagttcacggtcataaccttgcagaaggtgcgccacgtactttcgaattaaattctaagcatgttttagaagcgattgagcaaccattaaatggtatcgtagaagcagttaaatcagtattagaacaatgtccacctgaattggcggctgacattttcgagcgtggtatggtgttaactggtggcggtgcattattacaaaacttagatgtattactttctgatgcaacgggcgttacagtaattgttgcagaagatccattaacttgtgttgctcgtggtggcggtaaagcgctagatatgatcgatatgcacggtggtgatgtatttagcagcgatgagtaattccgcttttaattgatatgaacgatcataatggataatgacagtaaatgctcattatccattgttcattatcactcaccttaatttcatttaaaaatttaacaatgaaaccaatttttgctaaagccccttcactaggtactcgcctatttcttgcaatcataatctctatagcgttaattgcctttgatggacgcagtagtgcgctgatccaattccgaaatatgcttgaaactgctattggcggtttatactatttttcaaatacacctcgttcggtacttgatggcgtaagtaataattttattgataacagtaaattacagttagagaatcgagctttaaaagagcaattacgtgagaaaaatgcggatcttttattactggatcagttaaaagttgaaaaccagcgtttacgtttattactcagttctccgcttcgtcaagatgaatataagaagattactgaagtgttgactgcagagatggatgcctatcgccaacaagtgattatcaatcgtggtaagagcgatggtgcttttgttgggcagccggttattgatgagcgtggtgttgttggtcaagttatctcggttggagaaaatagtagccgtgttttattgattacggatgtgacccatgccgtgccggtacaagtattgcgtaatgacgtgcgtggtattgcaaatggaacggggcataatgatgagttatttattgataatttacctcgttcggtcgatgtaattaaaggtgatgtgctggtgacatctggtttaggtggacgattccctgaaggctatccggtcgccattgtggaagcagttaaaaatgatacgcagagccaattcgctcgtattgttgctcgaccgttagcttcttttgatcgtttacgctatttattattattgtggccgacaagcgaagagttacgtaaagcacaaagtctttcgccgcagcaagtgagagaggttgttgaagaacgccgcaatagcttgaatccattagatttattaaagaaaaacaaaaaagagcagattcgagatgagcagccaaaagaggagcttccggagaatagtgatgagccggtaaatccagcttctcagccagaagttgataatgatgaaaaccaccatactgaacaaggagcggaataatgcgagcgaacccaatttttcaaattttggtattaatctcgatttttatgattgcgttcgtgttagagattatgccttggcctattgggtttcaaggtttaagaccgaactgggtggttttggttctgatttattgggcattagcattgccaaataaggtaagtgtcggaacagcatttgtcgcaggaattatttgggatcttgtattaggatctattttgggtattcatgcgttagtactgtcaattgctatttattttgtagcaaaatatcatttgatactgcgtaatctctcattatggttacaagctattttagtgatgctgtatgtgattgctattcgtttcttaatttatttcgtagagcttgtattacatagtgcggaatttaattcacaagaaattttaggtgcaattattagcggtattttatggccatggattttcttattaatgcgccatattcgtcgtcagttaggactccgctaaggagatgtcaaatgagtagcttatcttttgatttttctgaagattttcgtcctttacccgccagaatgcgtccacgcactctggcggaatacattgggcaatcccatcttatcggagaggggaaacctctccgccgtgccattgaagcagggcattctcactccatgatcttctggggaccacctggcacaggtaaaaccacattagctgaaattattgctcatcattttgatgcagaagttgaacgtctttctgcggtaacaagcggtgttaaagaaattcgagaagcaattgaacgcgcaaaattgaaccgtcaaaccggcagacgcactttattatttgtagatgaagtacatcgttttaataaaagccagcaggatgcgtttttaccgcatattgaagatgggacgattattttcatcggtgccaccacagaaaacccttcctttgaattaaataatgcgttgctttcccgagctagaatttatattttaaaaccattacaagcggtcgaaattcaccaaattttgcaaaatgcgctattagataaagaacgtgggttaggtaatgaatcttttgttctggaagatgatgttttaacgttattggctgactatgtaaatggtgatggtcgttatgcattaaattgtttagagcttatgtcggatatggcggaacaaggcattcatggcaaaattttaaataaaacgctgctcacagaagtcttaggtgaacgccaagctcgttttgataaaggcggtgatcgtttttatgatctgatttccgcattacataagtcggtgagaggatcttcgccggatggtgcattgtattggtatgccagaattttaactgcgggaggcgatcctttatatgttgcacgtagattactggcgatagcttccgaagatatcggcaatgcagatccaagagcaatgcaaattgcgattaatgcttgggattgttatacccgggtcggtgcttatgaaggtgaaagagcgattgctcaagctattatttatttggcagtagcacctaaaagtaatgcggtatataacgcttttaatgaagcgaagcaattagccaaagaggcgaaagattatgatgtaccggagcatttacgcaatgcgccaacgaaactaatgaagtctttgggctatggtgcagaatatcgctatgcacatcatgaacctaacgcttatgctgccggtgagaattattttcctcctgaattgaaggatacgcagttttaccacccgacagaaagaggcatggaaaaacagataaaagaaaaaatgttatggctgagagcacaagatgcggcaagtgcaaagcaacggtataagcggtaagatttttgaattttttgcaaaattttagtgaaatttgaccgcttgttttggttaaacaatatgaatttatagtttaagaaatagaaaatatgtttgatattttgtttccggcttggttagccggtttattgttagcagttatcaccgctccattaggtgcatttgtcgtgtggcgtaagatggcatattttggtgatacgctttctcattcggctctcttaggtgtggcactaggtatttttctcgaaatagatccttatattgcagttatcattatgacgttgattttggcgttattactcgtttggttagagcatcgcaccgcttattctcttgatacggtgttgggtattatagctcactgcagtttatcgctcggtgtgattaccattagtttactggataatgtacgggttgatttgatgtcttatctatttggtgatttactggccattgattttaatgatgttatttttatcggtatcggctcagtattaattgcttcagtattggcatatttttggaaaaaattactctcgattacgataagtccggagcttgcgcagattgaaggtttaaatgttgctcgcttacgtttacttttgatggtgcttaccgcattgaccattgcattaagtatgaagtttgttggggcattaattattacatctcttttaattattccatctgctattgctagacgctttgctaaaacgcctgaggcgatggtgggctatgcaatcatatttagcatcttttctataaccggtggattattattttccggttggaaagatacaccggcagggccttccgtggtcgtttgtgcaggagcgttatttttgctatctctagctaaaaaggaatcagaataattatcgaagggaattgccggacattgtccggcttcttatagtgaaatgaatataaaatagcacgataagctataagatttttgatctacttctattgaattattttgaagatttgtgaaaatagttagcgtttgaccggcttgtcagtcggtctttcttttttcccctactttttggtcttagcgaagaataaatttatgtgtcaactactcggaatgaattgcaatacgccaacagatattactttttcctttgaaggatttcgtcgccgtgccggtttaacagaccatcataccgatggttttggtatcgccttttttgaaggtaagggggtgaggattttccgagataatcgcccgggggcttcatctcctatggcggatttagtcagcgagtatcgtatcaaatcttataatgttatttcgcatattcgtaaggcgacccgaggtgatattaatttagaaaatactcatccatttattcgtgaattatggggcgagaattgggtgtttgcgcataatggtacggttgaagatgtaagaccttgtccggattgccattaccagccgatcggaacaacagactctgaagcggcattttgctgtattgtgtctcgtctaaaagaaaaatatccggtaaaaccctcggaacaacagatttttgatgcggtagttgagattacttcggatattgcaacccatggtgtgtttaattttattttatctaatgggcattggatgatcgcacgttgttccacaaacttattctatgtcacccgtaaagcgccgtttagtaaagcattacgcgatgatgatgtagaaattgattttagtaaatacacaacaccaaatgataaggtgaccattattgcgacccaaccactgactaaaaatgaaaagtggaccaaaatgaaaaatggtggttatgtgatgtttaaagatggtgatctgtttcatgagattgaaggtaccttaccggataaccaatcacatgtgtaatgttataggtatgaatacatctgagttatttggcgacaagtaatttttgtttaccaaattttacaatggatacactattaataatggccaaaagtaatctatttgctactaaattattttttagtttatcaacaaaaattataaaagtaattgatttgctattttatgaacgaatgttcagtgtaaatgattgcttttttctaaaataagtttacaatacaagacctaagattcttcaggctaataagaagtattttagacagtcgtagagacaaaaattttattcattatgcttataaaaaaggccagacatgatgtctagccttttttatttatattaaagtcgttattatgctttaatcaataatgcgacagcttcacacgcaataccttcacctcttccggtaaagcctagtttctctgttgtagtcgcttttacatttacctgcatcacatcacactgtaaatcatccgcgatagtttgacgcatttgatcgatatacgggcgcattttgggcgcttgagcaataattgtcacatcaacatttccgactttgtagccttgtgcgcgaacttgacgatatgcttcaatgagtagcttacgactatctgcatttttatattgcatatccgtatccggaaatagtttgccgatatcacccagagctacagcacctaataaagcatcagttagcgcatgcaaagcgacatcgccatcgctatgggcgatgaagccggtatgataaggtacttcaacgccgcaaatcattaacggacgatcttgcccgaatgcgtgtacgtcaaaaccatgtccaattcgtaacatttctagttctccatataatgggtcaaataaaattcagctaaggctaagtcttccgggcgagtaattttcagattatcgctacgcccagtaattaattgtggtgtgtaaccgctcatttccattgctgaagcttcatcagtaatggtatatccattctctagcgcatatttaatcgcttgttttagcgtgttcaccggaaagaactgaggggtaagagcatgccatagtgtggagcgatcttccgttgcaatgattttattgccatttgcacgcttcatcgtatcaatcacaggcgtggcaagaattgcgccatttggctctttgacttgcaaaagtttgtctaaatctgaccgcttgaggcaaggtcttgctgcgtcatgtactaatacccaagcatcttcatcaatcacttgcaacgcattgaataccgaatctgcacgagtttcaccgccaaatacgatttgaattttaggcgcgttcaagatagatagctcggtataatattggtctgtttcagagactgctactacaattttctgaatatcgggatgttcaagaaaaatattgagcgtatgttctaaaattgtttttccctgtaattttagatattgtttcggcagaggcgcattcattcggcttccgacaccggaggcggggattacggcaataatttttcgcatcaatgagtttccttactgtgaacgaggaacaatacgatagaatgtttcactaccttttaccatctcacgctctaaacgtgctcgttcttccaacgcatttacaccatttttaaggtcattgatttctgccgcgattaagctattacgcgcgcttaattttgcattttcttccgtaagaacttccactgccgtttgtgcgtcttggtaatcgctccagccgtttttaccgaaccagaaactatactgaaaaaatgtcagtagtacggcaaaaaagataattagtaatcgcattctatgtctcttgagagttaatcgagtaaagcggaattctaccttattttgcaaaaaaataaaaaaatcttatcgcttactgtgtgatacttcataaaaggtacgaaaaattaataagtagtgcagtttttctttgatttcacgcaaatttttcaagtaattttagagtaaatcttcaaaatttgaagtagttaacattttttattcctcgaattagttagaatcgccacagttattaattttcaacttttacaatcataaagaggtgattctatgttaagccgtattgaacaagaactagcacaactaggtattactaacgtaaaagagattgtacgtaaccctagttatgagcaattatttgaagaggagatgaagccggaattagaaggctttgaaaaaggcgtactcacgaattccggagcagttgccgtagatacggggatttttacaggtcgttcgccaaaagataaatatattgtttatgatgaaacatcaaaagatcacgtttggtggacatctgatgcggttaaaaatgacaataaaccaatgagtcaaacaacttggcaaagtttaaaagagttagtgactcaccaattatcaaataaacgtttatttgtgattgatgcattttgtggtgcaagccctcgccaccgcttagcggtacgaattattactgaagtagcatggcaagcacactttgtaaaaaatatgtttattcgcccttctgaagaagaattggcgaatttcgtaccggatttcgtggtgatgaatggctctaaagtaaccaatccgaattggaaagagcagggcttaaattcagaaaattttgtggcattcaacttaactgaagcagtgcaattaatcggcggtacgtggtacggcggtgaaatgaaaaaaggtatgttctctatgatgaactatctattacctttcaaagatattgcgtcaatgcactgctcagcgaacgtaggcgaagacggtgatgtagcaatcttcttcggtttatctggtacaggtaaaacaacactttcaaccgatccgaaacgtaaattaatcggtgatgatgaacacggttgggatgatgaaggtgtgttcaactacgaaggtggttgctatgcgaaaaccattaacctttcagaagaaaatgagccggatatttatcgtgcgattcgccgtgacgctttattagaaaatgtggttgttcgtgaagatggttcaattgattttgccgataaatcaaaaacagaaaatacgcgtgtgtcttatccgatttaccatattgataatattgtggaaccggtatcaaaagcgggtcatgcgaaaaaagtaattttcttaacagcggatgcgtttggtgtattaccacctgtatctaaattaacgcctgaacaaactaaatattatttcttatccggctttacggcaaaattagcgggtacagaacgtggtattactgaaccgacaccaactttctcagcttgtttcggtgctgcattcttatcgcttcacccgactaaatatgcggaagtattagtgaaacgtatggaagcagcgggttctcaagcatacttggtgaatacaggatggaatggttcaggtaaacgtatttctatcaaagatacacgtggtattattgatgcgatcttagatggttcaattgaagaagcaacaacacatcaattaccgattttcgatttagctgtgccggatgcattaccgggagtagatactgcgattttagatccacgtgatacttatgcggataaagcacaatggcaaactaaagctgaagatttagccggtcgttttgtgaaaaactttgaaaaatataccacaaatgatgaaggtaaggctttagttgcagctggtccaaaactttaagataaaatgattcctgtttgttagaaagaagcaaagcgctaagtgaaaacttagcgctttttatatagcatgaagaaataatataaaagcggtcaaattttgctatttttttgcaaaaaacagtaaaaaataaccgcttgttactatttattaaggagttcgtgaagcgcagctccaatttccgctaaacttcgcaccgtttttacacccgcttgttctagagccttaaatttttcatctgccgtacctttacctccactgataatcgcaccagcatggcccatacgtttcccttttggtgcagtaacaccggcaatatagcttacaaccggtttggtgacgtgcattttgataaattcagctgcttcttcttctgcggtaccaccgatttcaccaatcattacaattgcctctgtttccggatcagcttggaataatgtcaaaatatcgatgaagcttgatccaggaatcggatcgccgccaataccaacacaggttgactgtccgaatccttcgtctgttgtttgtttgaccgcttcataagttaatgtgccggaacgagacacaataccgatttttccttttttatgaatatgagcaggcataataccgattttacattcatcaggtgtgataatacccggacaatttgggccaatcattcgtacaccgctttcttttaatttttgtttaacgatcagcatatccaaggttggaataccttcggtaatgcagacaatcagttggatgccggcatcaatcgcttctaaaatcgcatctttacagccgggtgccggtacataaatgacgcttgcggttgcaccggttttttctactgcttcacgtacggtattaaataccggtaagcctaaatgggttgtaccacctttattgggcgagataccaccgacaagttgagtaccgtatgctaatgcttgctcactatggaatgtaccttgtccaccagtaaaaccttggcagataactttagtatttttatcaattaaaattgccatattatttcccttgtgctgctctgactgcaaattgtgccgcttgtgttaatgtagtggctgcaatgagacttaaaccgctgtttgcgagaagctgacgacctaattcggcatttgttccttctaaacgcacaacaaccggaagactgactccgacttcattaactgcagcaataataccttctgcaattaaatcacatctgacaatgccgccgaagatattgaccaagactgctttcacattttgatcggaaagaattaatttaaaagcttctgcaacacgttctttggttgctccaccaccgacatctaaaaagtttgccggacgaccaccgtgtaatttgacgatatccatcgttcccattgctaagccagcgccgttaaccatacagccgatatttccatctaacgcaacataattgagctcccattttgctgcttcagcttctcgaggatcttcttggcttgggtcttgtagagttttgagttcagggtggcgataaagtgcgttgctatcgacaaccattttggcatctaagcagagtaattgaccttgtttggtcagcacgagaggatttacttcaactagagcaagatctttttcaataaataaattggcgagttgtacaaaaatatgtgcgaattgtttaatttgatcgccggagagtcctaattggaaggcaagttctcggccttgaaatgcttgagcgccggtaagcggatcgatagttactttatggataagttcgggcgtttgctgagcgacatcttcaatattcataccaccggcacaggatgccataaatacgattttttgtgatgagcgatcaactactgcacctaagtataattcacgttcgatttggcaagtttcttcaatataaatcgtatttaccggttgtccatgagcatcggtttggaatgtgactaaatgctgcccaaaccatttatcgcagaactcacgaacgtctgcgtcattacggactaatttaaccccaccggctttgcctcttcctcctgcatggacttgacatttagccgcccaaatatctccgtttaattgttgaatggcggaaagcgcctcatgcgtatttgtacaggcaataccgtgactcactgggagttgatattgtgcaaaaatttgctttgcttgatattcatgtaggttcatataatttcctgtatagaatcatttttgttagaaattctttcagaaatttaatggatctcagttaaaaaagcaaattgaagatagcagggaaaatgcaaaaagatatgaaaatttaaccgcttatatttaacttataagcggttaaaaaatagtgagccgaagcagataagtattaggcaattccaaatgccatgcggatattgccttctatttgttcaagtagtgcaaagcgtttacgatacatcgaacgttttttgcttgggatgcgttcaagcgatttatcgctcgccacagacatttgccaataatcttttaggattccaccgctttcactaaaaatagcatcataatcaacaacataacgtttgctttggataaatcgagatttattttgatatttatgcggaataccaagtagctgcttatagccaagcacggaagcaagcaacttcatactttctaccattaaatgagcagggcgtaggccataacattgcttagttaattgtttcattaactctttggcattggcttggttagagccttgaatcacaccgataagtagtgcattttcaactagcccaaaagttaatagatatacaagctgttgtgaacttttttgatatagctccaatgcccaaaaaccttccataggttgatgttcattgatattcaaacgaagctcaaaatccgagatgatttcgccaaagcttattgacttttcccatagtggaggtaattggtattgagctaatgctttcgggagaaaggttaagttatcacaaattgcttgaaaacgttgtgttgcactaaaacgcttatccaaaaaacgatgcacaagaggataactataattaggtctttgattcaacagaggaataagtgccggattctgatttataaattgagtgaataaattaatttgtttttgatgtaaacgagaacgtaaccagaagcgtaaacgtttaagacgataagatttttgaggagtatcaggatatattttgtatgcactcgggtaattgtaatcagtcatatttctctaaatttgctcaataatgacgttataatacaataaaattgattaatttacaaagtgtgtgtgaactttattaaaaaaccgcttacaggatgctgtgagcggtttacttaattaagctgattagctgttaaatttcaagtaataaacgtgtcggatcttctaataaatctttgacagcaactaagaaaccaacagattcacgtccatcaattaaacgatggtcataagaaagtgctagatacatcattggacgaataaccacttggccgtttatggcaaccgggcgatctttaatggcgtgcatccctaaaatcgcactttgtggtggattgatgatcggggtagacattaatgaaccgaatacaccaccgtttgtaatggtaaaattaccgccggttaaatcttctacggttaatttaccgtcacgacctttttcagcaagctctttaatcgttttctcaatatccgccatcgataatttatcgcagttacggataaccggtgtgactaagccgcgaggggttgagaccgcaatactaatatcgaaatagttgtgatataccacatcatcaccgtcaatcgatgcattgatttccggataacgttttaatgcttcaacaaccgctttaatatagaacgacataaagcctaaacgtacaccgtgttgtttttcaaatttttcaccgtaagttttacgtaatgtcataatcggctgcatatccacttcattgaatgtggttaacattgccgttgtatttttcgcttctaacagacgttcagcaatacgtttacgtaaacgtgtcattggcacacgtttttcgctacgtgctgagtaagacacggtactgacagtgctttgctctgtgtcaatagcctgttttgaagcttgtgtttgacgttgtgctaaatgatgttcaatatcttcacgggtaattctgccgccaacaccggtacctttgactaaatgagcctcaatattgtgttcagccaataaacggcgaatcgctgggccttgagaatccgcatcggaatggtcatgctcaatagctgcagacttacgatccgccggagtcgcttcattcgttggtttaatcgtttcttgggtgaaatcgcctgcttggacggttgagattttgccgagtaattgtttggaaataacagtagcgccttgaacttggcagatttccgctaaaataccgtcatgcggcgctggtacttctaatacgactttatccgtttcaatttcaacgattacttcatcacgtttaattgcatcacccacattcttatgccaagtagcaacagtcgcatctgcaacagattcgggtaagtccggcgttaaaatttcaatagtcatgatttacgttcctttatattcgttaacacagtgttttagctgtgccgataattttgcaagcggtcgaatttgatgatttttttgcaaaattttgctgaaatttgaccgcttatttgttaaagcgttaaagcttctgccactaattgtttttgttgctgagtatgcaatgaagtatagcccaccgcaggagatgcagatgcaggacggcctgcataagttaacttcgctttttctgggactgatgcttcaaaattatgtttactgcaataccatgcgccttgattaagcggctcttcttgacaccaaacaaagtcttttacatgtacgtaaggttctaatacttttttcatatcctcatatgggaatggataaagttgttcgatacgaacaatcgctacatcagtttgttcgttttggcggcgttgttcgagtaaatcgtaataaaccttacctgaacacatcacaacacgtttcacttttttcgccttgatattactgtcaatttcgccgatcaccgtttggaattcgccatcaaccaattctgctaaggaagaaaccgctaatgggtggcgtaataacgatttaggtgaaatcgcaactaatggacgacgcattttgcgaatcgcttggcggcggagcatatggtaaacctgtgccggtgtacttggtacacaaacttgcatattttgttgggcacaaagctgcaagtaacgttccagacgagcggaagagtgttccggaccttgtccttcataaccgtgtggaagcaacatcactagaccgcacattctgccccatttttgttctccagagctgataaattggtcgataacgatttgtgcgccattggcaaagtcaccgaactgtgcttcccaaatggttaatgttttcgggtcggttgtcgcatatccatattcaaaggctaataccgcttcttcggaaagtaccgaatcccacacttcaaaacgcccttgatttgcgtgtaaatgagcaagcggtacataacctgtaccgtcattttggttatgtacaaccgcatggcggtggaagaatgtaccacgaccggcatcttctccggataaacgcacgtgcgtaccttcatctaatagggtagcgtatgccatcgtttccgccataccccaatctaataattttttaccttcgtacatctctttacggtcgttatagattttctcgacgcgagaatgtggtcgtaaactttcaggatattcgcatacacgttttgctagagtttggaaacgatctaatggaaatttgctttcatacggtgctgtccagtcataattgaggtattgcaaccaatcaaccgccgccatatccatctcacgccattccggtacaacacgatcaccgttatccaacgcatcacgatagttattcattatttcagtggcttgatcttggtttaatacgccttcggcaactaaacgatctgcatagactttacgcggtgtcgggtgttttttaatgatgctatacatcattggttgtgtagctaacggttcatccgcctcattatgaccatgacgacggtaagaaatcagatcgataaaaatatcgcgtttgaataaggtacgatattcgactgccattcgggcagcaaatgcgactgcttcaggatcatcaccattaacgtgaataatcggtgcctgaatcattttggcaatatcagtacagaattcggttgaacgagtgtcgttcgggttagaggtggtaaaaccgatttggttattgatcacgattcgaatcgtaccgccaactttataacctcgagcattagacatatttaaggtttcttgtactacgccttgaccagcaacagccgaatcgccatgtacggtaacagctaagactttattatactcagtgtcacgtatacgttcttgacgtgcacgtaccgaaccgataaccacagggcttacgatttctaaatgcgatgggttaaatgcaagggttaaatgcacacgttcgccgtccacatcgaaatcagatgagaaaccttggtgatatttcacgtcaccagtacggttatcatcggcgtgtttgcctgcaaattcatcaaataattccgccggttttttacccaatacgtttaccaacatatttaaacggcctcggtgcgccatccccatcaccacgtctttcataccttggcgaccagcatgacgaatgatttctttcatcattggaataaatgcatcgctaccttcgagtgagaaacgttttgctccggggaattttgcgccgagataacgttcaagaccgtcagcagcggttaattcggtaagtaaattgactttttcttcgtgcgagaacaacggtttatttaaggtgctttcaatttttgcttgtagccagttacgttgttccatatcttgcacgtgcataaactctaaacctattgtacccaaataggtttgttttaatgcatcggcaagatcactaaatttcattgtttctttgccataaacatatttaccaatcgtaacggtttcatttagatccgcatcggtaaaaccgtgatggcggtaatctaattcaggtacttgagaggttttccaacgataataaccaagagggtcgagttttgcttcaagataaccacggaaacggtgagcgttaatccattgtaataaacgaacttgtttggcgctggcttccggatcgataaccgtaacggattccgggacattttcacgggcgagtttacggaaatagtcacgcacttgcgaatggggttgttctacgacttgcgttttcggaagggtatcaaagatggtacaccagctagcatcaacgctagttgggtcttcaagatattgttcgtagatttcttcaacataagcttggttagaaccaccgaaaggtgaggaagctaaccagtcttcaaaatttttatgttgcatacagacctaaccttgtatatttgtgtgtttattgagttatgacgagtattatatacgctaatataaataaaatggattaaaacaccatgctattaggcgatttataaatcaatgatgctattatgcctaaaaatttaagtgaagaatgtgagctaagtcagatttttaacagattgataacaaataagcggtcttttttggcgaaaaatttgcaaaagaaatgctaaaaaagaccgcttatatttatatttaacactaatgactgcaatggcattgtccgctacagacatcaccgtgtaagttgtgatgatggttgtggtggtgagaataaaaggcaacatttttggcaaattggtcaccaaagaaatggataaaatgcggatcattggtcaccatttccggtgtgccggcacaacaaatatgcttattcacgcataaaacttcatcagtatttgccattacgatgtttaaatcgtgcgaaaccatcaaaattgcgcaatttaaccacgaacgagtattatttaatagttgatagagttcggtttgccctgtaatatccaccccttgcatcggttcgtctaaaactaataattgcgggcgatctaaaatagctcgagcaagtaaaacgcgctgcaattcaccgccggataatttctgcatactattttctgctaaatgcgtaatagaaaagagtgcaagagcttcttgaatcgcttgtgcagagcagttcggttttagtgatagaaatttttgcaccgtaattggcattgaatgatccaaatgcaatttttgcggcacataaccgattttaagccctttttgatgaataaccttgcccttggttggagcaagtaacttgagtaatactttaagtaacgtcgattttccgccgccatttgggccgacaatcgtcgtaatagaattcgcatataccgttaaattgatattttgcaaagctttttgaccaccgaaacttacttcaatttgttgaagttctacaagaggctcgcccttttttttaggctgcggtacaggagtaagttgttttatttgcattattttaaaaaaattaagggtataatataaaggcgaacaagttagctgatttttgtgatgctgacaagaatgaattttctaaaagaacttttgtcgaatttttttgtaataagtaaaagataatataggacatattttgcaacacgttattctagcaagagatcgtcgtcgaaagaaatcccgtttgaagggattacttttctttatggcgctgttatcgatttttatcggtattgtacttgctttaaaaaatcaaccatccattagcagcgcaacaaatcaagaacaatatgttgtgcttgatgaacaaactgaaaaacataaggatgagccggaacaagctgatgtggcggcaggggatcaaacaacggataatgaacaaactgatcctaattcagcagaagaggttggcgcggaagatgctaatgcaacctcttatgaagatttgctcaatgaaaaggatgatgaagtagaaggacaagaaggcacgacagttaacaaagaaactgaaaagccagaagaaaagttatcgccggaagcggagaaggtattagatgaaatcttagaggttgccgatgaagcattacgcattcaagatcagtttagttataccgtcggtcgcggcgataaattaaaagacgttttagagcagtctggtttaggcataagtgttgcgcgagcaatgatcaagcgcttccctgagcttgctaatttagatggtggacaacaattttactggatcttagataaccacggtgaattggaatatatgaactggttggtatctgaaaaagaagaacgtatttatgagcgtaaagataacggtaaatgggtttttcaaaagatacagaaaaaaggtgaatggcgacaagatgttgtgcgaggttcgattgatggaagttttgcaacaagtcttaaaaacgtagggttatctgaacgccaagtcaatcaattagcggtcggattacaatcacaaattgcaactaataaacttaaaaaaggcgatcgttttgcgatcttagtaaaacgtgaatacattaatggcacggtaacggatgtcggtaatgttgaaggaattttaattgtaagcggtaaaaaacgttattatgcgattcaggcagataacggacgttactatagcagccatggtgagaccttaagcaaaggttttgctcgtattccattgttgttcagtgcgagagtttcatcatcttataaccctagacgggttcacccgatcacacgtcgagtgagaccgcataacggtgtggatttcggtgtgccgacaggaactccgattattgccccgggtgatggtgtagtggagcatatcgcttatcaagcaaggggagcaggacgttatattaagatccggcacggacatattacaaccgtgtatatgcatctaagtaaaacgcttgtacgtgtagggcagaacgtgaaaaaaggtgagcgtattgcgctctcaggaaatactggtggatcaactggtccgcatttacattatgaattccatattaatggacgaccggttaacccgatgacggtaaaattacctggttccagttcaggtatggcaagcaaagaacgacaatctttcttaaaacgggcaaaagctgtagaagcgaagcttaaactttaattttttagggaatttacaatgaaaaaaaatgcgattgcattattaggtctatccatattaagtacatcagtaatggctgatgatgcaagcctcaaacgcacgttagaaagaatgggggcaacgaatgttaaaatcagtgattcggcattaccaggttttagaactgcagtttcaaatgagggagtagttcaaattagtgagaatggacgttttgtgattcaaggtcagatttttgaactgaaaaacggcaaagcggttgatattactaataaatccttacttgctgatttaaattctctagaaaaagagatgattatttatccggcgaagaatgaaaaacatatagtgactgtgtttatggatattacgtgtcactactgtcatttgatgttccaacgtattaaagaatataacgatttaggtattacgcttcgttttcttgctttccctcgtggtggtatgaatactcaaacagcgaaacaaatggaagcgatttggacatcaaccgataaagtaaaagcgttaaatgatgcggaaaacggtactttaccaaaagaagttaaaataccaaatattgtgaaaaaacactatgagcttgggattaaatttggcgtaacagggacaccaaatatggttgatagtagcggacaattaattgcagggtacgttgagccgaaagaattactcaaaatgctaagcgaatagcattaagttcttgaatacaagcggtctgattttgtaaaatttttgcaaaattataccgcttgttttatttataacgaaaagaagaaaatccagtgcaaaagctaatcaaacaacgatctaaactcacatctataaaattatcagaacatcctttactaaatcgactctatcaaagtcgtggtatctcttcgcctcaggagttagagcgaaccttgcaatttttacatagaccccatcaattagcgaatattgatgcggcggttgagttgttggtagatgcctataagcaacaattacgcattattattgttggagattttgacgcggatggtgcaaccagtacatcattggcaattttggcattacgtcaattaggctttgaaaaggttgattatctgattccggatcgtttttcacaaggctacggtctaagtctggcggttgctgaaatggtattagccaaaggtgcagatattgtgatgacagtggataacggtatttcttcctttgaaggaattgattttctaaaagagcacggtatcaaagttttagttaccgatcatcatttaccggcagaaagcttgccgaatgcggatgcgatggtgaatccgaatttggcggattgtactttcccttcaaaatctttagccggagtgggggtagcgttctatgtgatgttggcacttcgaggcagaatgcgtgaattaggatgctttaaagagcaagaacctaatttagcggaattattggatcttgttgcattgggaacagtagcggatgtggttccgcttgatcataataaccgaattttagttcatcaaggattaaaccgtattcgttcggggcattgtcgagcaggtattcgtgctttagcggaagtgtctaagcgagatttatcttctctacaagctagcgatttaggttttgcaattgcccctcgtttaaatgcggcaggacgtttggaaaatatgtcgttaggcgtagaactgctcattgcagagaatatggagattgcacgtcaattagcatttgaattggatagcctcaaccaaacccgtaaagagtttgagcaagaaatgaagacggaagccttggcaatttgcgcaaatttaccgagtttgatgcaaaaagaacaagcgcacggtattgtgttatatcaaccggattggcaccaaggtgtgatcgggattttagcttcacgtattaaagatcaatttcatcggccggtcattgcgtttgcacaagagggtgaaaacagtgaatatttgaaaggttcggcacgttcaattgccggattacatatgcgtgatttattagaacgtatagattcattatatccggatttaattattaaattcggtgggcatgcgatggcagcaggtttaacaattcatcaagagaattttttacgttttcaaaaagtatttgatgaaattattaatgaaataattgaaccggaacaattacaaggtgtcatttatacggatggggaattagcaccatctgaattaaatatcgaaatagcggaattattacagcaggcggggccttggggacaaaacttcccagagcctacgtttgaaggtgaatttcgtttattgcaacagcgtatactaggtggtaaacacttaaagttaatggtcgagcaacctaacggtggattatttgatgcaatttggtttaatgccgatttgcgttattttcctgatttatcgattaaacaagttaaattggtttacaaacttgatataaatgagtttagagggaataaaaatttacaattaagagtcgagacattaattatttagtttattctatttctaaccctagaataaaataatattgtgttgtaaaatctgctcgcctatataccgatggatggtatttagaacatatgaatgaagtttttaatctaacaaggaacaaccaacgatgaaaaatacgactgtttttcgcggattgttattatctggtatcgcattagccgtagctgcttgtggtaacttaagcaaagtgactgatgaaggtacgacagaaaatccagtattcccaaaaatctctgaatcagaattcaaccatgatggttcacaattcggttcatggccaaactgggaaaacgttcgtcaaatcgaacgtggtatgaacaaagaccaattatataacctaatcggtcgcccacactttgaagaaggcttatatggcgttcgtgagtgggattatgcatttaactatcgtgagaatggcgtgcacaaaatttgtcaatacaaaatcttatttgacaaaaatatgaatgcccaaagtttcttctggtatccgaatggctgtaatggtaactcatcatttaacttaagcggtgacttcttattcgatttcgataaagacacattaactgcgaaaggtaaagaagttgttgatagtgttgcgacacaattaaaatcatctggtgcgcaacaagttaaagttgcaggttatacagaccgcttaggttcagaaaaatataacttagatttatcacaacgtcgtgcgaacatggtgaaatcacgtttagttcaacaaggcgtaacagcacaaattaatgctgttggttatggtaaagcaagccaagttaaagcgtgtgatggtgagtcaggtcaagcattacgtgattgtttacgccctaaccgtcgtgtagaaatttctgcaaacggtggcgtgttaaaacaaaacgaaggtggtaatgttgcaggtcctaacggtccaacgccactttaccaaactccacaatataacagtaataaataatctactgtttcgtgagaacatagagtaaaatataagggcaatcaattttgattgcccttattttttcttaccaccctgtaataggagaatttttatgcgttatcaagcggttgcttttgacttagatgggactttactttcaccaaatgcggttattttagaatcgagtaagcaagccattcaaaaggcacgagagaaaggcgtaaaaattttctttgtaacaggccgtcatcatacggccgttcgtccttactatgcggaaattggtttggatacgccagttgtttgctgcaatggtacttatttatatgattttcaacatgataaagtgctgtcaggtaacccattaactgcagagcaagcttccggtttaattaatcaagcgcaagcgttgggtattcatacggcggtatattttcgtgatgcaatgacttatgagcagcttaatccgcatttcaccaagtttcaaaaatgggtacaatcttgtccggaagctgtgcgtccaaatgttcatcaagttgagaaatttcagcaagagattgataaaggtactacggtttggaaagtgttaattagtgatacggacttagctaaaatgcaaagttttgttgaaaaattaccgcttgatcaatttagcccggaatggtcttgggtggatagagtggatattaccagtgtcggtaatagtaaaggcgcaatgttggcagaattgctaaaaattgaaggaattgatccgcaaaacgtaattgcatttggtgacaatttcaatgatatttctatgttagaactggttggtttaggtatcgcaatgggtggttctgaggctgaagttcagcaacgtgcggataaaacaatcggctcaaataatgaagacagtattgccaaagaattaacggaattacttaatttataatgaataaactggttaatcatcctaagtattctattgctcgccgcattggatcttattttctcgtcatgatcgcgtttgcctctttaattagtggtatttcattaggcattatgtggagtaataaatctgatgcggggttgattaatgtttccggctcattgcggatgcagagttatcgtttcctctacgaaatggagcatcatccgcaatctattccgactcgtttaaatgaatatcgtcaaagtttgaattcgcctgaaattcaagattctttagcgcataaatgcctgttaccgaaagaagttacagaggcttatgtcaagctgcaagaaagctggcaagaaatggaatcttttatcgttaagcgagatagaagctcttatgaagccaatattgaggggtatgcgaaccaagttaataatttcgtatggttgttacaagaatttgttgagctaaaattaaaggtggcaattggcgtgattgcggtttctatgctattgattattgccttagcttattttggcgtatggtacactcgaaaacgcattattagaccgcttgaccagctagtgacagcaagccaacaagtaaaaaacgaagattttgaccatattcagctagcggtaaatgagccgaacgaattagggtttctttcttccgcatttacccaaatggcaagcgatttagctaaattatatgcttctcttgaagagaaagttgaggataagacccgccgtttgatgtcggtaaatcgttctctgttggtattattccaatgttctcagctgttaacggcaaagccggttaatcaaaacgtcttatttcaagtgttacaaactgtgcttgataatgaacaattacgtggaattgagattcaagtgtatggagcggattattggaatgtgaccattgataatgcaccggcacaagattggcgttataacgaaatcgccatagaaaacgagaaaattgcgttattacgttggaaaccatcgttattgtgtcctgatgaacgtttaatccaaaacgtatcggaaatgattgggcgtagcctgtatgttgtgcaagtgcagaaacagcaacaacagttagtattgatggaagagcgctcaattattgcacgagaactgcatgactcattagcgcaatcactgacgttttttaaaatccaagtgagtctattaaaacgtaatggtgaaaccaaacaagattgggaaaaacaaaaagcgatcttagatgactttgaaaaagcgctgaatgaagcatatagtcagttacgagagttactttctacgttccgtttgactattgaggaggctaatcttactcatgcattggagcgagtattagattcattacgtattcgaacatcggctcaaattcgtctgaattgtaaactcccttcacaaatttttagtgcgcagcaacaagttcatgctttacagattgtgcgtgaagcggtgattaatgcgattaaacacgctaatgcgagcgcaatcgatgtgattgctgaaactaatgcggatggtgaacattgcttgattattcgtgacaacggcaaaggcattgcaagcgatattgagccggaagggcattatgggctgacgatcatgaaagaacgcaccgctgagttaaaaggcgagtttagtatcaagaaccgtttggaaggtggtgttgaggtcatggttgtattaccaaatatgattaccgcataatttttataaaggaaggcactaaatgcagattcgaaaatcgacggaagcggatttcgaaaccattttaaatatttacaatcaagcgattccgactcatcaaattacggcggatttggaattggcgaccccgattaatcgccgagcttggtttgattttcatttaaccagcgaacaatacccgatttggacggtagaagacgaaaacggcattgccggctggtttagcttttcgccgttttacgagcgaccggcgtttgtgcatacctctgaaattagtatttatttagacggtagtgctaaaggtaaaggctacggttcgaagatcatcaagtttatgcaagcggaaatgctgaaacataatattcatactctgatggcatacgtgttcgaattgaatcaaatcagccaaaatctaatgcgtaagcacggctttgaacagtggggcagatttccgcatattgccaatatgggcaaagatgaacaagggcaggacaaatggcgtacgttattgatgatgtcttatcaaaaaggcattgaataagcggtcattttttatcaaatttttgcaaaaggatcataaatggaacaaactaaagtcgtgttagccacaggaaataaaggtaaagtcaaagaaatggcggatgtattagcgcaatttggctttgatgtggtggcgcaaagtgaattcggtattgaatcaccggaagaaaccggtttgactttcgttgaaaatgcgttgttaaaagcacgttatgcttcaaaaatgaccggattaccggcaattgcagatgactcaggtttagctgtagacgcactgggtggcgcaccggggctttattccgcccgttatgcaggtgaagacggcaatgatgaggcaaatcgcaaaaaattattagccgaactgcaaaatgttgcggatgaaaaacgtggggcgaaatttgtaagttgtatcgtttttctgcaacacgaaactgatccgacaccgaaaattgccttaggcgaatgtttcggtgaaattttacgtgaagaacgcggtcaaaacggttttggttatgattcgctgtttttctacccgcctaaaaattgtagttttgccgagttggaaaccagcgagaaaaagcaaatttcacaccgtgcgattgcattggatgtattaaaacaacagttactaaagtaagcgaagtcacgtttacgaggagaaaatatgattattaccaccacaccaacaattgatggtcatcaaatcactgaatataaaggtttagtgtttggcgaagtggtttccggtgcgaattttattcgtgatttttttgcgagtattaccgatgtgattggcgggcgttcgggcgcttacgaaagcaagttaaatagtgccagacaagaagcgttagccgaattggaaaaagaagcgaaacgtgtcggtgccaatgcagtggtgggtgtttcaatggaatatcaatcaatgggcggcgataaaggtatgtttattgtggtcgcaaccggcacggcagtggtgattcgttaaatctaatagattgtacgaatccaagcggtcattttttaccgctattttgcaaatgttcctataaaaaatccccgcatttggcggggatttttgtaagcgttatggttagaataaaccggtaatcaaaccgttttcatccacatcaatacgatttgccgccggcactttcggtaagcccggcatacgcataatgctaccgcaaatcgcaacgataaagccggcaccggcagagacgctaatactacgtacggtaacagtaaaaccgcttgggcaaccaagtaatttggcattatcgcttaatgagtattgtgttttcgccatacaaatcggtaatttatctaaacctaatttttccagatttttaatttccgctaaggcttcggcactaaaattcacatcatccgcaccatagattttttgtgcgatcgctttgatcttgttttgcacgctttcatttacgtcatagacgaaattaaaacggttctcttgttcatcaatcgcttttaacactttttgtgctaagtccacaccaccggcgccgcctttaccccaaacttcagtgagcgatacttccacgccttgtttcgcacaagcggtctgaattagggctaattctgcatcagtatctgacacaaagcggtttaatgcgaccacaaccggtaagccgaatacatttttgaggttactgatatgtttaagcagattaggtaaaccttgttgtaaagcggttaaattttcttcagctaaattcgctttttcaacaccgccgttatatttcagcgcttttaccgtggcaacgaccaccgccacatccggtttaagatcagctaaacggcatttaatatcacagaatttttctgcacctaagtccgcaccgaaaccggcttctgttactgcataatcacctaaatgtaatgctaaacgtgttgcggtaaccgagttacaaccgtgagcgatattggcaaacgggccaccgtgaataaaggcagggctgccttcaatcgtttgtactaaattcggtttaatcgcatcttttaataatgccgccattgccccatgcgcatttaaatctttcgcataaaccggctgtttatctttagtgtaagcgactaagatattacctaaacgcgtttttaaatcagcaagatctttcgctaaacagaaaattgccatcacttctgaagctacggtaatatcgaaaccgtccggacgaatcacgccatcggtcggattgcctaaaccccccaatacgttacgtaattgacgatcattcatatcaataacacgtcgccataacacacgtttggtatcaatatttaacgcattgccttggtagatatggttatccaataacgctgctaagaggttattggcactggtaatggcgtggaaatcgccggtaaagtgtaggttgatatcttccatcggcaacacttgtgcataaccgccgccggccgcaccgcctttcacgccgaataccggacctaacgacggctcacgtgccgcaaccacagcatttttaccaagttgatttaacgcatcggttaaaccgatagtgacggtcgttttgccttcgcctgccggcgtcgggttaatcgcagtcactaaaattaatttaccgtttttagccggtaatttaaacgcatctgtagggttaatttttgctttatatttgccgtattgttcaatttgatcggcatttaaacctaatttttccgcaattttattaatcggctgcataatggcagcttgagcaatttctacatcgcttttcattcatcctccagtgtggcaaacgtttgctttttaaaactacgctagaatatgctaaaatctatctaaaataaagaactgtaacagctatttaacaaaaaaagatgacgaatcaattaacgccaaacttttggcagacaaaaagcctacttgaaatgaatgatgcggaatgggaagcattgtgtgacggttgtggaaaatgttgttaccgcaaatatattcaaggcagaggaaagcgagagcgtttgtattatacttcggtcgcttgtaatttactggacgtggataacggacgttgtaccaattatccgaatcgtttcaaaattgaacgggattgtaccaaattaaccaagaaaaatttgcctgatttcggttggttgccgaaaacttgtgcttatcgtttactttatgaaggtaagccgttatttgattggcatccgttgatctctaacgatccgcaatcggtaaaaaaagcgaatattctcattccaaacggcattcacgaaaaagatgtgatagattggtttgaatttgtgattgatgaggtttaagctaataagcggtcatattttgtaaaaattttgcaaaatatgaccgcttgttatttggataattttaataatgataagagggcaaacacaatgaaaacagcattagtcactggggcaacagcaggatttggcttagccatttgtaaattactgattaaatcaggttataaagtgattggtaccggcagacgtaaagaacgtcttgccgagctacattcgcaattaggtaataatttcttaccgcttgcatttgatattcgcgatgaagaggcaaccactcaagccttaaataatcgcccggcaggctggcaaacagtcgatttattagtcaacaatgccggattagcgttagggttggaaccagcttataaaaccgatttaaaagattggtatcaaatgatcgatactaatattaaagggctggtgacggttacccgtttgattttaccggaaatggtagaacgtaatagcggacatatcatcaatttaggttcaatcgccggtaattatccttacccgggtggtaatgtttatggcggcacaaaagctttcgttaaacaattcagcctcaatttacgtgcggatttagccggtacgaaagtgcgtgtaacgaatgtagagcctggtttatgcggcggtacggaattttcgaacgtacgctttaaaggcgatgacgacaaagcggcaaaagtatatgaaaacgtgaactatgtcgcaccggaagatattgctaatattgtgttatggctgaatcagcaaccggaacacgtcaatattaaccgtattgaagtgatgccgactgcgcagactttctcaccgcttgcggtagcaagagggtagttcacttactaaaagcggtctaaaacagaccgtttttaaatactaaataaaagaaatttttacttgcatatcgtagagttatgtactattttaatagtacataatatttcttatagagagaacacgatatgtcagacacacttcttaatccttacttcggcgaatttggcggaatgtatgttccggaaattctcgtaccagtcttaaaacaactcgaagctgcttttgttgaagcacaaaatgatccgttattccaagcggaatttaccgatttacttaaaaactacgccggtcgcccgaccgcattaacgctttgccgtaatctcaccaaaggaagtaaaaccaaactttatcttaaacgtgaagatttattacacggcggcgcacataaaaccaaccaagtattaggacaagccttgttagcaaaacgtatgggcaaaactcgcattattgcggaaaccggtgccggacaacacggggtggcaactgcattggcgtgtgcaatgttagatttaccttgtgtgatctatatgggggctaaagatgtggaacgccaatcaccgaatgtattccgtatgcgtttgatgggtgcagaagtgattccggtacaaaaaggctcttgctcattaaaagatgcttgctgtgaagcgatgcgtgactgggcggcaaactatgaaacaacccattacttaattggtacggcggcaggcccgcaccccttcccgactatggtgcgagaatttcagaaaatgattggcgaagaaacgaaacgccaaattttagaaaaagaaaaccgcttaccggatgccgtaattgcagctgtaggtggcggatcgaatgcaatcggtatgtttgcagattttattgaggaaaaagacgtgcaattgatcggtgtagaaccggctggcaaagggattgaaaccggcgaacatggcgcaccgcttaaacatggtacaaccgggatttatttcggaatgaaatcgccaattatgcaaactaaggacggacaaatcgaggaatcttattcgatctcggcaggtttagatttcccatcagtcgggccgcaacatgcttacctcaattcaattggacgagcagagtatgcctcaattaccgaccaagaagcgttagatgctttccaggcattagcacaacatgaaggcattattccggcattagaaagttcacatgcattggcttatgcgctgaaattaattgcacaaaatccggataaaaaacaacttttggtagtcaatctttcagggcgtggcgataaagatatttttactgtagataaaattttaaatgggggaaactaatatgagccgttttgatactttgtttgctgatttaaaagcaaaaaacgaaggggcatttgtgccgtttgttaccctctgtgatccggattttgatcgttcatttgagattatcgaaacactgattgctaacggtgcagacgcgttagaactcggtttccctttttctgatccactgttagatgggccggtgattcaagctgcgaataaacgtgcattagacggtggttacagcaccgatgcctgttttgaaatgattgcaaaaattcgctcaaaatatcctgaaattccgattggcttgctgctttgtgctaacttagtcttcgtaccaacccaagaagtgtttttcaagcgctgtgccgaaaccggcgttgatgcagtgttaattgctgatgtgccggtacttgctgccgaagaatttacgcaaactgctaaaaaacatggtattcaatcagtcttcatttgtccgccgaatgcggatcaggcaacgattgaacgtattgcacgtttaactgagggctatacctatttggtttctcgtgccggtgtaaccagtgccgagaaccaagctcacgctaaaaatttagataaccttattgaaagcctcaagcggtcaaattccgccccgattttgcaaggctttggaattgctaaacctgaacaagtcaaagaagcattagcgcttggctgtgatggtgcgatttccggatcggcgattgtgaaaattattgaaagtcatttagataatcaaacgcgtttactggcagaattggcaaattttgtgacagcaatgaaaaatgcgacttatcgcacataaataatagataaattattgggttagctagagaaaaaatttgtaccttagtagtggttggggtttactaaggtgcaaatttttgtttttggaagtgttgtcgttaataaagtttgaaatgataagtggtcgattactgacgctctcttgcaaataagtagccgtttaaacctacaatgatcatgtttaaaattgccacaatataagctttggttgtaaaaccataaagcacaaatcctaatccccaaacgatattagagagacgcaaagttatcatatctctaataaaaaatgaaagaataagaataagaaccgaaccataactaagaaattcaacaatgctcatctgttatcctgaaataagcttaaaaattataaggcggctattctacacaaaaatgaagcgttgatatagcatctgaagcttttaaaagcagtttaaaaggataatttacaaaaaaattggctaaatatttatacagtattataataaaaaggctgtttgctcattttgggcaggcagccttaatgctttttatatatatgaacaaattagacaataaaatcattcatgctttcagtgaagaaggcttattaagtaacaatattcaaggttttcgtcctcgtgccgctcaactagagatggcgcaagcggtcggaagagcagtaaaatttgcgacaccgactgtggtggaagcagggacaggcacaggtaaaacttttgcttatttggtaccagcattgctttccggcaaaaaaaccattgtttcgaccggttctaaaaacctgcaagatcaattatttaatcgagatctgcctactattcaaaaagctttaaaatataaaggtaaagtcgctttattaaaagggcgagccaattacctttgcttagaacgcttggatcaagtggtggcaatgggcgtgctgggagataaatcagtattagcggatttatcgaaagtcagcaaatggcatacttcaactaaaaccggcgatttaagcgaatgtatcacgattgcggaagatagcccgattttaccgcagttagtgagtactgcagaaagttgcttaggttcggactgtccgcattttaaagattgctatgtggtgcaagctcgccgcaaagctatggaagcggatgtggtggtggtcaatcatcatctgttttgtgctgatatggcggtcaaagaaaccggcttcggtgagttaatcccagaggcggaattgatcatttttgatgaagcacaccaattgccggatatcgccagccaatattttggtcaatcgctaagttctcgtcagctattcgatatttgtaaagatactaatattgtttaccgtaccgaattgaaagacctcgctcagttaggcaaagcggcggatcacttacaaaaagtggtacaagattttcgtttgttgatgggggcggaaggtacgattcgtggtaatttgcgagagttgtttaacgaccaaaaagtagtggacggtttaactaaggttgcggaaaacattgattttttaagcgatgtgattaaaaaatcactcggacgctcggaaacgctcgataaaattttcgaaagattggcggaagtcaaagttcaattaaaaaaattgagcgatactactgtcgttggctattgctattggtatgaagccaacggacgttctttcggtttacatatcacgccgttaactgtggcagacaaatttggcgaacaactcaaaaatcagcaaattggttgggtatttacttcagcaacgcttgaagttggaggcaaatttgatcacttctgtcagcgtctaggcattgagaatgtggaacaattggtgctgcaaagcccttttgattacgcgaatcagtctttgctttgtgtgcctcgttatttgccggataccaataaatcacacaccttaactgaattaggcaaaatgttgatgcccgttattgaagctaataacggtcgttgctttttgctttgcacttcctattttatgatgcgaggtttagcggattttctgcgtgaacatagtaaattaagcgtgttattgcaaggggaaactagcaaagcccgcttattggaaaagtttattgcggaagaaaatagcgtattggttgccacccaaagtttctgggagggaattgatgtgcgaggtgatgcgttatcattggtgattattgataagctgccatttacttcgccggatgaaccgctgctaagagcccgtatggaagattgtcgtttacaaggtggagaaccgtttaacgatattcaaattccggaagcggtgattacgcttaagcaaggcgtagggcgattaattcgtgatgtaaccgatagaggcgtggtgatcatttgtgattcacgtttagtgatgcggaattatggtcaaacgttcctgaaaagtttgccgccgtcaacacgaacacgtgatttaaataaagtgattcagttcttaaaaaattagtgagcaagcggttaaatttgcaaaattttttgcggatctgaccgcttattttggaggatactcacatgattgttcgtatgctcagaatgttgatttccttagcgttactctttgcgatgctatacgctggaaaattacttagcattctgattccgattggtatttccgatagtatttggggaatgctattactgtttagctgtttagttatcggtgttgtaaaagttgaatgggtaacgccaagcgcaagaccgttaacacgttatatgacgatcttctttattcctatctgtgctgaaattatcgaacatcttgatactttacaggtacatttcacctcatttgtgttcgccaatatacttagtaccgcagtttctttagtcttaattggactgtttgcgcaatggatttttcaccgtaaataatagaagaaggtaatatgatatatttttattctctcttaactattttcgcctttcttgctgggcagcgtatcagccaaaagttacgttcgtccgtacttaatccttttgtgattgctttggcaatcgtcattttagtgattgtgatgggtaaagtgccttatgcggaatattatcagggcaattttccgatcaacaatttacttggtgtatctgttgtagcgctcgccttaccattctatgagcagttaccgcaaattcgtaaaaaatggcgtcctattttagcggttgttgtatttggaagcgtatgtaccatgttaaccggtgtattatttgccgtgttactgggcgcaagtccgtctattcttgcggcaattgtacctaaatcggtttctacgccgatagcaattgcgatttcaagccaaattggtgcaagttccgcagtaacagcggttggcgtgctggttgctgggctgttgggctcagtatttggatttagcttcttacactatattggcgtacgtaatgtccgtgctattggtttaacgatgggggcagtttctcatgcgttaggtacaggacgttgtatggaatacagtgttaaaaccggcagctatagttctatcgcattggtattaagtggcgtactttcgtccgttttagcgcctttcgtgttcagacttgtattagctttattctattaatttggtatctcattcaattcagggtacaatgccccgatttttgaaaattaagaatggacattatgcaagaaaaagatctttcgacctttaaaacgtttaaacgtttatttccaacgattgcgccttataagtggggacttgttgtcggggcaatcgcgctagtgctgaatgcactggtagattcggggcttatctatctcttaaaaccgttgttggatcaaggatttggtcaggcagatcacagttttttaaaacttatggctgtgttagtcgtggtatttattttagtgagaggtatcacgaactatattgccggctattgtttagcttgggtttcgggcaatgttgtgatgactttacgtcgtaatattttccaacatttaatgtatatgccggtcagttattttgaccaaaatccggttggacgctctctttctcgtgtaacgtatgatacggaaatggttgcgacttcttcttcacacgctttagtcactatcgtgcgtgaaggggcatatttaatttcattatttgtggtgatgatttacaccagttggcaattatcgttagtgttatttgttatggcgcccgtcatcggtatattaatcggtattgtgtcaaaacgtttccgtaaattgagccgtcatatccaaagttcaatgggtgaattaaccgtaactaccgaacagatgttaaaagggcataaggttgttttatcattcggcggtcagcaagttgaaaaagagcgttttgatcgggtaagtaatgatatgcgctgtaaagggatgaaaatcgtttcggcagatgggatttcagatggcgttgtgcaattaattgcgtcttttgctttatcggttgttttatatgtagcgacattccctgaagtgatgagtgaaaatcttacggcaggttcgtttaccgtggtgttttcatctatgatggcaatgttacgtccgttaaaatcgttgacgaatgtgaattcacagttccaacgtggtatggcggcttgtcaaacgttatttgaattcctcgatttgaaaacagagaaagatcttggtactcacgaagttacacgagcaaaaggtgatgtggtattcaataatgtttcgtttagttatgaaggtaaagacgaacgtgcattatatcgcatttcttttgctattccgcaaggtaaaacagtggcattggtcggtcgttccggctcaggcaaatcaacaattgcaaatctattaacgcgtttttatgatattgatgaaggtgaaattacattggatggcgtaaatatccaagactataaattagcgaatttacgtgaacaatgttcggtggtttcacaacaagtgcacttattcaatgacacgattgccaataatatcgcttatgcagctactgataaatatagtcgtgagcaaattatcgctgcggcgaaagcggcacatgcgatggaatttattgagaagcttgatgacggtttagatacggtgatcggcgaaaacggcgccagcctttcgggcggtcagcgtcaacgtttagcgattgcccgtgctttattacgtaattcgccggtattggtattagatgaagcgacttctgcactagatacggaatccgaacgtgcaattcaagcggcacttgctgagttacaaaaagataaaaccgtgcttgtgatcgctcatcgcttatctacgattgaaaaggctgatgaaattttagtcgtcgatcacggacaaattatcgaacgtggttctcacactcaattactcacacaaaacggggcttataaacaattacatagccttcaatttagctaatcgaacgaagtctccctttcgggagacttttcgttttttacaagcggtcaaaaatggctaaaaaattacaaatttttaacagaattagaccgcttataaggtagaatagccactcacgttataaaaggttcgctatgaaaaaattttcttttttagtttcgctcggcgcgatgttagtgttaacgggctgtaattcggtgttagatgcacctacaactgttcagacaccgaccgcacaaatcccacatgctgatgccaaatggcagcaacatcttaatcaattagcgcaaattaagcgttatcaagcaaaagggcaattcgggtacatttcacctgaagagcgtttttcttcacactttgattggcaataccaatcagtaaataatttcggcttagagctttcatcaaatttatcgacaaagtcgatgaaattacatcgtactcaacgaggattaaccgtttcggacagcgaagggcgctcacgtacggaagcggatgttgatgcgctgatggaagaaattatcggcgtttcgtttccgattgatcaatttgcctattgggtaaaaggtcagccggaaaaaaacggtaattatattgtgaatgaaaaacgtcaactttcacaatttagttatctgattaatggtcaagtgtggcaagcgagctatgttgaatatcacgaagatcgccaaccgaacttaccgaagttaatcgtattagagaatggtcaacaaaccttaaaaattcgtattgatcaatggacgtattaatgaataaagtcactttacctagcccggctaagttaaatctttttttatacattactaacagacgcacagacggttatcacgagttacaaaccttatttcaatttttagattttggcgatgaaatttcactggaagtaaatcagagcggtgaaattgaattgttaaacgaaattgaaggagtcgaaaaagagcagaacttaatttatcgagctgcaaaattattacaaaatcataccgcttgtacgaaaggtgccaaaatcggcgtaaccaaacgtttaccaatgggtggtggcgttggcggaggttcatcgaatgcggcaaccgtactggttggattaaatcatttttggcaaacaggcttaagtcttgaagagcttgcagaactaggactgagcttaggtgcggatgtaccgatttttgtgcgaggcgttgcggcttttgcagaaggtgtcggcgaagtgttaacaccttgtgagccggaagaaaaatggtttgtggtgttaaaaccgagtgtttctatttcgactgccgtcgtttttaatgaccctaatttgcctcgaaatacgccaaaacgtagtttagcagaactgttagagaataaatgggcaaacgattgcgaaaaagttgtgcgagatcattattcagaggttgaagatcttgttcaagaattggtagaatatgcatcgtttcggttaacgggcactggtgcttgtatttttgccgaatttgattcaaaagaagacgcgcagaaagtcttcgaccgcaaacctcaaaacgtgtgtggttttgttgctaaagggcagaacatttcgcctttgcacaaaaaattaaacttaattccctaacttccctttgtaaattcaaggatcaattccaatgccagatatcaaactgtttgcgggtaacgcaacgccagaacttgcaaaacgtattgcagagcgcctttacatctctttaggcaatgcaacagtcggtcgttttagcgacggtgaaattcaagttcaaattaatgaaaacgtacgtggttcggatgtgtttattatccaatcgacttgcgcaccaactaatgacaacttaatggaattgattgtgatggttgatgctttacgtcgtgcgtctgcaggtcgtatcacggctgttatcccttatttcggttatgctcgtcaagaccgtcgtgttcgttcagcgcgtgtgccgattacggcaaaagtggttgcggacttcctttcaagcgtaggtgttgaccgcgttttaacctgtgacttacacgcagaacaaatccaaggtttctttgatgtacctgtagataacgtatttggttctccggtgcttatcgaagatattcttaagaaaacggatttaaataatccaatggtggtatcaccggatatcggtggtgtggtacgtgcgcgtgcgatcgctaaattattaaatgacgcggatatggcaatcattgataaacgccgtccaaaagcaaatgtatcacaagtaatgcatattatcggtgatgttgccggtcgtgactgtatcttagttgacgatatgatcgacactggcggtacgttagttaaagctgcggaagcattgaaagaacgtggtgcaaccaaagtggttgcttacgcaacgcatgcggtattctcaggtactgcagcaatgaacttagcgaacccagcattagatgaagtagttgtaaccgatacaattccactttctgatgaaatcaaagcattaaacaaagtgcgtgcattaacattatcaagcatgttagcagaagctattcgtcgtattagcaacgaagagtccatttctgcaatgtttgacgcataatttctgataagggcgagttgaatactcgcccttagtttatctatttctttctattaaccgaagagctcatcatgtattccctcattcgtaaatgtctgtttgctatggacgctgaaaatgcgcataatttttccgttcaagcgcttaaacttgtcggaaaattaccttttgatcctttacccattcctcataatccagttgaggtgatggggctgcagtttaaaaatcctatcggtcttgccgccggtgcggataaaaacggtgaagcgattgacggttttggcaagttaggattcggttttattgaagtaggaacggttacaccggttgcacaagacggtaatcctaagccacgtcaattccgtcttttggaagcggagggcattatcaatcgtaatggttttaataattacggtgtggatgtgttggtagaaaatgtgaagcgttccaaatatgacggggtactcggaattaatattggtaaaaatgcctttacgccaattgagaacgctttggatgattaccaaatttgtttacgtaaggtgtatgagtatgccgattatattacggtgaatatttcttcaccgaataccaagaatttacgttcattgcaatacggtgatgcattagatgaattgctgagtgcattaaagcaagaacaatcaatactttcgcaaaagtttgcaaaatataaaccgcttgttctgaaaattgcaccggatttaacggatgaagaagttgcttcggtagcggatagtttggtacgacataagattgacggcgttattgccggtaataccactttatctcgagaaccggtagcaggtttaaaacatgcggaacagcaaggtggcttaagtggtaagccattaaattcgctcagtacccatttaatccgtaggttggcgaaggaattaaacgggcagttgccaattattggtagcggaggtattcattctgtctcctccagtcaggaaaaaattgatgcgggtgcaagtttattacaagtttattcggcaatgatttatcaggggccggcgctgattcaggagctggccaaacagatcaaacttaataaatagccttaaacaagcggttaaaatttgtaaaaaaattgcaggttttaaccgcttgtttataggaaagacaacggttggcgcaggtcaaaaaaatagacaaaataggtcaattttgttatcttgttagccaaaatttttctacaaattttcaacattttttatagtgtgataaaaagtgtttaaaatcaagtagatatcgcaagatattcactcgaatagaaaacaggtttttacattttgttaaactttctgtgtgttttatgtttagtctaatcgaatgaatgtctataatttcatcaaacgataagtttaagtatagagaacttatcactcattatttacttaaaataaggacaacctatgtcagagttagaaagagatgtagatccatttgaaaccaaagagtggttagaatcacttgattcattaatccgtgtagaaggtgttgaacgtgcacaattcattatcgatgaattattaagccaagcgcgtaaagatggcgtgccggttcaatctggtgtgacaacagcatatgtaaatactatccctgtgtctgcacaaccagcttacccgggtgaccacaaaattgaacgtcgtatccgttctgcagtacgttggaacgctatcgcaatggttttacgtagccagaagaaagatcttgacttaggtggtcatatttcaactttccaatcagcagcaacaatgtatgaagtgtgctacaaccacttcttcaaagcggcaactgaaaaaaatggcggtgacttagtattcttccaaggtcacgcagcaccaggtatgtatgcacgtgcttatgttgaaggtcgtttaacagaagaacaattagacaatttccgtcaagaagcatttgcggatggtttgtcttcatacccacacccgaaattaatgcctgaattctggcaattctcaactgtatcaatgggtttaggtcctgttaatgcgatttatcaagcacgtttcttaaaataccttgaaaaccgtggcttaaaagatacgtcagaccaaaaagtttacgcattcttaggcgatggtgagatggatgaaatcgagtctaaaggtgcgttaacatttgctgctcgtgaaaaattaaataacttaattttcactgtaagctgtaacttacaacgtttagacggtccggtaaacggtaacggtaaaatcgttcaagaattagaaggtttattcaccggtgcaggctgggaagtaatcaaagtattatggggcagcaactgggataaattattcgcgaaagatacttcaggtaaattagcacaattaatgatggaagtagttgatggtgactacttaaccttcaaatcaaaagacggtgcttatattcgtgaacacttcttcggtcgttacccagaaacagctgcattagtagcggatatgacagacgaagagatttgggatcttcgccgtggtgcgcacgacagcgaaaaactttacgctgcatatgcgaaagcacaaaaatcagataaaccagttgtgattttagctcaccaagttaaaggttataaaatccctgaagcagaaagtaaaaatactgctcaccaatcgaaaaaaatgtcattagaaagcttaaaaggcttccgtgactacttcgaattaccgttaaccgatgagcaagtagaaaatcttgagtacatcaaatttgctgaaggttctgaagaatacaactacattcacggtcaacgtaaagcattaaacggttatgttccggctcgtcgtcctaaatttgacgtagagtacaaagtacctgcattagaagaattcaaagcgttacttgaagaacaaccacgtggtatttcaaccacaatggcgtttacacgtgcattaaatatcttattaaaagataaaaacattggtaaaacaatcgttccaatgatcgttgatgaagcacgtacattcggtatggaaggtttattccgtcaagtgggtatttacaacccgcacggtcaaaactatacgccttcagaccgcgatttagtggcttactaccgtgaagcgaaagacggtcaagtattacaagaaggtatcaacgaattaggtggtgcagcgtcttgggttgcagcggcaacgtcttactctgtaagcaaccaaccgatgattccattcttcatctattactcaatgttcggtttccaacgtgtgggcgatatgatgtggttagcgggtgaccaattagctcgtggtttcatggtcggtggtacgtctggtcgtacaacgttaaacggtgaaggtttacaacacgaagacggtcatagccatattcaagcgggtattatccctaactgtattacttacgacccatcatttgcgtttgaagttgcagtaatcatgcaagacggtatcaaccgtatgtatggtgaaaaacaagaagatgttttctattacatgacaacattaaacgaagtaatggatcaaccggcaatgccagcaggtgctgaagaaggtatccgtaaaggtttatataaattcgaaaccgttaaaggtaaaggcaaaggtcacgttcagttattaggttctggtgcaattatgcgtcacgttcgtgaagcagcacaaatccttgcgaatgactatggcgtaacttcagacgtattctctgcgccatcattcaatgaattagcgcgtgaaggtaatgatgcagtacgttggaacttattacacccaacagcggaacaacgtgttccttatgtagcacaagtattagcggacttaccgacagttgcttcaaccgactatgtgaaacaatacgcagatcaaattcgtgcgttcgtaccaagtaaacattatcatgtattaggtacagatggtttcggtcgttcagacagccgtgctaacttacgtgaacacttcgaagttgatgctcgttacgttgttgttgcagcgttatcacaattagcgaaagaaggcacagtagaaactaaagttgttgctgatgcaatcgctaaattcggcttaaacgtagatcgtattaacccattatatgcataacattaaaactctccccctttaatgggggagagacaggcaatacttcgtttagaagtattggcagagagagggtaaatgcaaaaaattaatgaaatttgaccgctttccctctccctgaaaaattgctcaacgcaatttttctgtccctctcccacaagtggcgagggtagtttattaaatgaaggattatcaaaatgtcaaaacaaattaatgtgccagacatcggttcagatgaagtttctgtaactgaagtcatggtaaaagtaggcgatactattactgtagatcaatcactcatcaacgtagaaggtgacaaagcttcaatggaagtaccagcgccggaagcaggtgttgttaaagaagttttagtaaaagtgggcgataaagtaacaactggttcaccaatgttagtattagaagcggcagaagctgcgccagcaccagccgcagaagcgcctgcacaagctgcggcacctgtagcagtggcatcagcagttgttgaagtgaatgtaccagatatcggctcagacgaagtaaacgtaaccgaaattatggttaaagttggtgattcagttgaagttgatcaatctatcatcaatgtagaaggtgataaagcttctatggaagttccagcacctatcgcgggcgttgtaaaagaaattttaatcaatgtaggcgataaagtttcaaccggcaaattaattatgaaatttgaaactgcatcagcagcaccagttgctgtagaagcgccagcacaagcagctgcaccggcagcaacagcttcagcaattaaagaagtgaacgtacctgatatcggcggtgatgaagtaaacgtaactgaaatcatggtaaatgttggtgatacagtatctgaagagcaatctttaattactgttgaaggtgacaaagcttcaatggaagttccggcaccatttgcaggtgttgtgaaagaaattttagtgaaatctggtgataaagtgtcaaccggttcattaatcatgaaatttgaagttcaaggtgcagcaccggcagcagctcctgctcctgcagcacaagcagctgcaccagcggcacaagcagcaacgcaatcagctcaaggcggtaacgtttctggtttaagccaagatgcagtagtagcggcaggtgcttatgcacacgcgacaccggtaattcgtcgtttagcacgtgaattcggtgtgaacttagataaagtgaaaggttcaggtcgtaaaggtcgtattgttaaagaagatatccaagcatacgttaaaactgcagttaaagcgtttgaaacaggtactgttgcagcggcagcaggtaacggtgttgcaaacggtgcaggtttaggcttattaccatggccgaaagtagacttcagcaaattcggtgaagttgaagaagtagaattaagccgtatcaataagatttctggtgcgaacttacaccgtaactgggtaatgattcctcacgttacacacttcgatcgtacagatatcacagaattagaagcattccgtaaagaacagaacaagattgttgaaaaacaaaaacttgatgtgaagatcacaccagttgtgttcattatgaaagcggttgcgaaagcattagaagcatacccacgtttcaatagctcaatttctgaagacggtcaaaaattaacaattaagaaatacatcaacattggtgttgcggttgatacaccaaacggcttagttgttccagtgttcaaaaatgtgaacaagaaaggtatcatcgaactttcacgtgagttaatggaagtgtctaagaaagcgcgtgacggtaaactttcaggttctgatatgcaaggtggttgtttcactatttcaagccttggcggtatcggtacaactcacttcacaccaatcgtgaacgctccagaagttgcaattttaggtgtatctaagtctgaaatggcaccggtatggaatggtaaagagttcgagccacgcttaatgcttccactttcattatcattcgaccaccgtgtaattgatggtgctgatggtgcgagattcttaagctacatcaatggtgtattagcagacattcgtcgcttagttatgtaataggtaagcggttgaatttgtaaaaaattttgcaaagttgaccgcttgtatcgtagggacacactgtgtgtgtccaaggacgcaacacttgcgtccctacaataaaggaataaatatgagcaaagaaatcaaaacgcaagtcgtagtgcttggtgcaggtcctgccggttactcagcagcattccgttgtgctgacttaggcttagaaactgtaattgttgagcgttactcaactttaggtggtgtgtgcttaaacgtaggttgtatcccgtctaaagcattattacacgttgcgaaagttattgaagaagcaaaacatgcagagaaaaatggtattacatttggtgagccgacaattgatttagataaagttcgtgcaggtaaagaagcagttgtgtctaaattaaccggtggtttagcaggtatggctaaagcacgtaaagtaactgtggtagaaggtttagcagcatttactgatccgaatactttagttgctcgtgaccgtgacggtaatccaacaacaattaaattcgataacgcaattattgctgcgggttctcgcccaattcagcttccgtttatcccacacgaagatcctcgtatttgggattcaacagatgcgcttaaactaaaagaagtaccgaaaaaattactcgtaatgggtggtggtatcatcggtttagaaatgggtacggtgtatcacgctttaggtgcagaagttgaagtggttgaaatgtttgaccaagtaattcctgcagcagataaagatgttgttgcgatctacaccaaacaaatcgagaaaaaattcaagctaatgcttgaaactaaagtaactgcagttgaagcgaaagatgacggtatctatgtttcaatggaaggtaaagcgtgtaacgacactaaacgttatgatgcggtattagttgctatcggtcgtgtaccaaacggtaaattaatcgatgcaggtaaagcgggtgttaacgttgatgatcgtggtttcatcgcagttgacaaacaaatgcgtacaaacgtaccacacatctttgctatcggtgatatcgttggtcagccaatgttagctcacaaaggtgttcatgaaggtcacgtagctgcagaagttattgcaggtcaaaaacactacttcgatccgaaagtgattccatcaatcgcttatactgaaccagaagttgcttgggtaggtaaaactgaaaaagaatgtcgtcaagaaggcttaaactttgaagtggcgaagttcccatgggctgcatcaggtcgtgcgattgcttctgagtgttcagaaggtatgactaaacttatcttcgataaagatacacaccgtttactcggtggtgcaatcgtaggtagcaacggtggtgaattattaggtgaaatcggccttgcaatcgaaatgggttgtgatgcggaagatatcgctttaactatccacgctcaccctacattacacgaatctgtaggtttagcagcagaagtgtttgaaggttctatcacagacttaccaaacgcaaaagcgaaaaaacgctaataggttaatttaacttatttatacaagcggttgaaatttgcaaaaaaatagcggatttcaaccgctttttttctatcttgaaagatcagtttaatagtttgatttatgcttataaaatcaacgaattagctatgcatttattaatttttcagcgttgtgatctttttttcagcacttgaaataaaataattaaattagcatttgacataggtctgaaaatccgtaaaatgcacctcgttccttacgaacaaaaacttaaagcgggaatagctcagttggtagagcacgaccttgccaaggtcggggtcgcgagttcgagcctcgtttcccgctccattaaatctcttcaacacggcgtgttagcaaagcggttatgcactggattgcaaatccatgtagatcggttcgactccggtacacgcctccactattcactcatttcaatattttataattttctctgtgatttgatttacacacttttttattaatcaatttacgttttaatggcttctacgatatatagattatacctaaataatttgggtgaggatcattattagtcttaaagctcttatatagattgtacttagctataataaaaatcccacctagtaaaggtgggattcggaaagataactattctaatgaatggaaatatttagatatttcttcgtaagagtgtgtaactggaacattaaccccattttctgtaaagtaaactaaagtcttttcacctgatttttcaatgtaagagagattccaatcatttatagacactcttatgttactatcactattgctacgtgatgttgggaagaatttggggaatttttccgtgatatcaggataagcacctacaacgacgtgagtaataccacctacacaatgcagaagggtaaaattatgttcacttaagctttcttcaataaataaaatggcagttctacttacagtaattttgttaccagaacgagctaatactaaatcaacaaatccggacataatgaatttctccttttaggtaaattaaaataatatgtatatgagcctatatacggcagtatgttgaattggcttgttattcaacatactatttgtctcttttatcttcattatattacttagcattattcagtgatgactatcttagaaagcgttttatttaactttttagcgagttcatattgttctgtaaccgcattccagatagcatcttgagaaagtacactgtaatttccatgagtttcaaggcggatattgtctgcattatcgtagagctctagccacaaggagctatgataaaactgattgagttgctgcatgatctgataggcttcttcccaccggctgaggcttttttctaattccggtaagagtttaactaacttaccgtagttatcttgcatttgttgaatattttgctgcatacctagattaatttcctactatagaatgaatgttatgaaagtaaaaaagctaagcatattgcttagcttttttgttaggtgtttacttaaagatgatatcttctttaggatcaaatttacttgcgtcaatcaccttattttcttcaaagtattttttcaacatttctgcatcaataaagccggtatttacgtagctaggatgttttttcattactgggtaaccatcaccaccggcagttagataatctggaatagatactttatatgttttattcgggtcaaacggttttcctgcaattttaacatttgagatcgctttcgctgcacgatctaccgtcatagaaatgccagcaaattgaggatatgcgcctgtatcaacttcttttaatgcaacagttgttaagaaatctaataactcttggcccttaagatcaatcgtagaaatcatattaccaaaaggttgaactgttaataaagttttataagttaccttaccttcttcaatagaagcacgtacacctccagagttcacgataccgatatctgcttttacacgctctttttgtgattgagaaattaagcgtcctaagtttgtttgaacgaagcgtacgtgttcacgtttaccgtctaataagcccttcacttcaccaacttcgacgtttaataatttatcaccttcatcttgatatttttttaagtgttcaaatagcgcttgatccggtttgatttcagcttggtaaagttggtattccttttttccatcttcttttttgatagtttttttcaggttaattggaataagttcatatttaaccaatgtggttttgccgtttttaaattcaaaatcagcacgccctacatatttgccccattctccggcttgcataatccaagttccattttggaaatcaggtttacagctatcgcctggggtatatttcactctaaattgacctttttcgtcaaaacatacggtatcatgagtatggcctccgataatgatatcaaatgcacctttatctagagttcttgccatagttacatcaccaggtgcattgctgccatgtttaccatctaagtaccatcccatatgggttaacgcaatgcgtacatccggtttttcgattttattaatttcagttaacgtctctttagctgtgctaattgggtctttaaagataacattttctgttacatcgggattacctaatttacctgtatcttctgtggttaacccgacaacagcaacttttaatccttgcttgtctagcattacataaggtttagtaagttctttttgagtgcgtttattgattacatttgcagatataagtgggaaattagcccatttctcttgcatacttagtacctgaagcgggaaatcaaattcatggttacctaataccatcgcttcataaccaattgcatttaaaccttcgtaatcaggacgagcattttgcatatcggattcaggtacgccggtattaatatcaccggcatttaagataatggttgagccaccttttgcctctacttcctttttaatgttatcaatcaaagctttttgagcagcaaggccatattcgcctttgtcattgtgccagaaatggccgtggatatcatttgtatgtaggagggtaaatgtgtaggttttgtctgcttggtatgccattgcagaagttgctgaaagtagtgcaacagagagaagagttttgttaaatttcataagaacctcaaatttagattgatatgcaaaaaaatgggcattagatagataggagaacctataaatctattgcccatatgattaaaaaataagaataagtagccacgttatcgcaaatagaaccattgccataaatacggctgcggaaccgatgtctttcgctcgtcctgataattcatggaagtcagaaccgatcctatctacgacagcttcaattgcgctatttaataattcggtaatcagcactaaaaacacagtacttagcagtaaaagtttttcaatgatatcgttgccaagtagtaatgcaagagggattaaaatcgttgcacaccaaatttcttggcgaaatgcgggttcattaatgtaggctgctttaagccctttcattgaataaccggcagcacgaataacacgttgaaagtctgctttattttcaggtttcattttatttctcaaaatagttttattaataaaaagtgcgtgcattctacctgaaagaaatcggttgcgaaaagcatttttcttggttcgagcctatctatatttgtttgatatagagaaataacaaattttaatcgctaatatataaaaatctaataaaaatgcataagtaactattcccaaaaagggtaatttccgctaatctcaaactttcatatttatccaggtgaataaacggctagccgtttattctgttttagtctttaatagcgaaatattatgagtaattcatctttatcttcaaaaattttcgggggcaacttagtcttacgtattgccatcggtttagtgcttggcttgtgtttagcatctgttaatcctgagtgggcaaaaagcgttggcgtattaggtcaattttttgtgaaatcacttcgagcaattgcaccgattcttgtatttgtattagtgctttctgcaattgcaaataaagaagtaggttcagacagtaaattaaaaccgattctagtaatgtatattttaggtacatttgttgcagcattgacagcagtgatatttagtttccttttcccaacaacattagaacttgtttcaaatccagataatttaaatcctccgcaaggtattggggaaattatcaaaacagttgtgttcaatttagttgataacccgttacaagcattagcaaatgctaactttatcggcattttagcttgggcgattggcttaggtattgcgttacgtcatgcggcaccaagtacaaaaacatttttaaacgattttgcggaagcagtatcttatgttgttaaagttgtaatcgcttttgcacctatcggtgtatttggtttagttgctgaaacaatagcaacgaatggtattgatgcatttgccggctatgcgcgtttattaggcgtattacttggttcaatggcatttgtggcatttgtgctaaatccattaattgtatattggaaaatccgccgtaatccgtatccattgacattaatctgtttacgcgaaagcggagtaacagctttctttactcgtagctcagcggcaaatattccagtgaatatgaaccttgctaaacgtttaggtgtacgagatgaaatcgcttctgttgcaattccacttggtgcgaatatcaacatggcgggtgctgcaattacagtaactgtattaacattagctgctgcttatacccaagggattcatcctgattttgcaacagcgttattattaagtattgttgctgcaatttgtgcgtgtggcgcatcaggtgttgcaggtggatcgttattacttatcccattagcatgtagtttatttaatattccaaatgatatcgccgcacaagtaatcggtgttggctttatcatcggcgtgattcaagattcagctgagaccgcattaaactcatcaacagacgtgctatttactacagcagtaagtatggcagaagacaataaataatttatatagatattctataaaatttattgtggttattggaatctccgagattaacttttgcgatctggatcgcaaactttagcttcacttttcacaagcggtcgaaaatttagcatactttgcaaaaaggtaatttgctatgaattttgaccgctttgttcttgtcctttcgttattttttcttccattacttttcttaccccaagaatggcttacttatggctgctatgtggcagttttgataattattataggaatattccgtaaacaagcattaactattttattaggcgctttaatactagtaagctattggcaaattatcaatatatcagaaagcgcagataagtatgcaataccttctcagtaattgtaccaatttcaagttcagaaaattattaagcaagatgagtttcaaacagcattagcgaggttagaaaatggcgatctgatttatttaaactggcagtcggatgagccgttagaattagaacaacattatcaagcgaatcttaagatacgacctattgctgctcgcttaaatattggaaattttgatcggcagcgttggttcttcgcacatcatttaaaggggagtgcaacagtcaaaaaagcgaataagctggtctcacaatacgtgagatctttgcgtgttcaatggctggaatatgtcagaaaacaattagaaccatttccatctaggggactattactggcattagcttttggtgaacgtgcttggctagccaattcagattggcaactatttcaacaaacttctaccgcacatttaattgctatttccggcttacatattgggctagcgatggggattggattctggttggcaaagtgtattcagtggctttttctacggataggagtcttatctgctggaagcatttctatctttttcccgagatgtgtagggctagtttttgctattttctatagttatttatccggttttgcgattcctactttacgggcattacttgcgatttctcttgtcttattatgtcaatggctacgccgctattacactgcttggcaattatggtggcgtattgttgcattattacttgtgcttgatcctctcacaattctatcggatagtttttggttatcggttttagccgtactaagtttaatcatttggtatcagtattttccgctcaccaagcttttccccttttgcaaaaaatggcagaaatttaaccgcttgtggctgtcactagtacatttgcaattagggatttttctcgtattttctccagtacaatttttcttttttgaggggatttcaccttgggcatttatcactaatttcataattgtaccgttatacagtttgttgttagttccgctagttatcttttcattactaactaacaatatattgaatagctgggcgtgggcggattggctagcacaggggagtttgaaaatactttctttgctttccgccgattggataacgttaagccaaagcgagcaacattatttgttcgctttgaatgcgttgtgtctattgttactgtacctcttacaagaaaaattatttataagatattggaaactgttgggattatttgtcttaagcagcagttttgcgattttcttcatcaagtttccggtttcaccggagtgggtgacatttgatgtcggacaaggacttgcacaggcacttgtttatcaagatagcggtaaaaaacgtgccattctttacgatacaggtgcaagctggaaagataaatcggggcgaataggttcgatggcccaattagaaattttgccttatttgaagcgtaatggaattcaagtagaagccgtttttttaagccatgacgataatgatcactccggtggagcggaagatattcttgctgaatatccccacgcacgtctaatttcggcaagtactcgccgttatgccaagcatgatcctgaagcctgtattgccggtcaaacgtggcaatttggacaatttgaattaaaagccatttatccgatatcaagagtaaaacgcgcgaagaatgaagattcttgcattattttggtaaaaatagaccgcttctccttgctgtttaccggtgacactacctcagcaaaagaaggttcattcgctcataaaatcgggcaagttgatttcttacagatttctcatcatggtagtaaaacgagttccagctatactctattagctcagacaaaaccgcaaattgctattatttctgcaggacgatggaatccttggaaaatgcctcatcaacaagtattaacacgcttatcacaacaaaatattaaaacctttagcactgcaagggtagggatggtaaaagtgagttttgagaaggggagttggaagatagagacggcgagaaataacagaagcccatggtatcgagagacttatgggcttccaaatcaataattgcctttcttaattaaggaacatcatgtaaggcattcggattttttgaaataaacattgcatcaccataactaaagaaacgatatttcgcttctactgcatgtttataagcattcattgtgttgcggtaaccggcaaacgcagaaactaacataattagcgttgattcaggtaaatggaagtttgtgactaacgcatcgacaatacggaatgttttgcccggatacaggaaaatactggtatctgagaaaaacggcgcaatcaatttaccttcttgttcggcagcttgagcggcactttcgatcgaacgaacagaagtagtgccaaccgcaataacacgtttgccggctgctttagttgctaaaatttgatcaacaacgtcttggcttacttcagcatattcagcgtgcattttatgatccaaaatattatctacgcgtaccggttggaatgtgcctgcgccaacatgtaatgttacaaaggcgatattaactccctttgctttgagcttttcaagcgttggtgtgtcaaaatgcaaaccggcagtcggtgcagccacagcacctagaactttactataaacggtttgatagcgttcttggtcagcatcttcgtcaggacgatcaatatacggcggtaatggcatatgaccggcttgttgaagtaaatcaaacagaggttgttcttcgttgaaatgtaattcaaacaatgcctcatggcgtgcagccataattgctttaaaaccattaccttcgccgagtttatcttcaccaagtacaagttccgcaccttctttcggtgcttttgaagcacgcacgtgagctaaacagcgatgttcatctaaaactcgctcaactaaaacttctaatttcccgccactggctttacgtccgtacaaacgtgcaggaataacacgcgtattattgaaaatcagcaaatctcctgcttcaatttgcgtcaataagtcggagaattgtttgtcggcaaattcaccggtttcaccggttaactgtaataagcggctagcggtacgttccgcagtaggataacgagcgataagctcgtcaggtaagtcaaaatggaaatcagaaactaacatggaaaacctctataaaaacagactgccccttaaaaggggcagatattatgtatttagtaattctactatatcattgatggctttgctgagcttatttcgatcatggcgataagccacttcgtcatcagataaaacttgctttaacactttaatattcgccgatagattactataggcggttggaacagtaataatgccatcaaggcgatttttaccaatccgagtttccaaccattctacacgatctgctaatgaaagagagccggctggccccgattcttgctgaatattatcaataaaaataacctttgctttactatgctgaatcgcattcgatatttcatcaatcaataatgacggcataatgctggttaaaaaactgccgggaccaagtacgattaattccgcctcttttattgattcaatcgcttccggtgtcgcatttaccctcggaattagcaataaatttctcggaatttcttcaagtgcatctactgaaacttcgccaacaatcgttacgcccgattttaattgtgccgctaagtgtaccggcgattccgacattggaattagtccagcacgaacatgcaataagtcccggactaaattaattccttcaagcggtcgaattttcatattttctaacgcttttaaaattaaattacctaagttatgtcctgcaagttctcccgcaccgccgaaacgatattcaaataatgcagaagcgacagtcggcttgatgataatttgcgttaaacagttacgcaagtcaccccaagcaataccaccgtgctgggaacgaatacgaccggtagaaccgccatcatctgtggtggtgacaattccggtaagtcgtttcccaaggaatgatagtgatgataatactcgacctaaaccgtgtccgccaccaatggcaaccacctgactcatactattcaaataaggatgacgagaagatagtttttgttcaggcatttattttcctttttattattgaacagagactatagttgtgtttacattatgccaccgaacggaatatgtttattaatttctcgtgatgataaatctatacgcaatcttcttcatttgaaggtaacgcattaacaacggctttaaccaatgttgcaagaggaattgcaaaaaacacgccccaaaatccccacaagccgccaaaaattaacaccgctacaataatagttaatggatgtaaatttacagcttcggaaaataaaaatggcacaactaaatttccgtctagtagttggctgatcacgaaagcgagcagcaagtaatagaattcaggtgacaatccaaattgaaataaagcaactaaagcaaccggtatcgtaactaatactgcaccgatataaggcactaacactgataatcctaccgctacggaaagtagtaacggataacgtaaatcaaagaataagaagagggcataagttgcaataccaacaatcaaaatttctaagaatttaccacggatataatttgcaatttgttgttgcatttcaaaccatacgtttgctgctaaacgacgatttttcggcaacatacgcacaaaagaacgcacaaaaaggtgtttatcttttaacaagaaaaacaccattaacggcactaaaaatgcgtaaatacctaatcctactagactgataatagagtggacagacaaagttaataaagattccccgaaacctaaaatttttgtctttaaattgcccattaaagtgtctagcatggcgtaatcaattaattcgggataatgttctggtaatgcttccagccaagcattcaataagttgaacatagagggaagatcccgaataaatgtgaccgcttggttccacaggcttggcaacatcaccataaatagaaagataagcagcgagataaatccacctaatacaaccaccaagctcagaaagcgagggaatttaaaatggcgcataagaaaacgaatcggccattcaagtaggtaagcaaaaacaatcgccactaacaacggcataatcagatcgctgaagaaataaatgatgccgaatccaatcaataaaataccgagtaacgcgactgtttgcggatcattaaatttctgtttataccaagcttggaacatttcaagcattctatttccctctaataaatttgaaaaatccttctacgtaatgtagaaggatttacattatttttggctacaaacagcaataaagcccagtttattttccggatcattaaaggtttggaacatttttttgaacgtatcgcgattttcaggttttagtgcattaccgacaattttcattgcgcctaaaacaccttcatcatgaattaaacctttcggagaaagcaaagtcatttcgcctgaataagcatctacattacggaagccacattcatggaataaggttttccaaccttctttggttaatggtgttaccgtaagattaatcgcttctcttagtgactgaatcacggcatccgcatcctcggtatttagcatgacgtcatgagttaacaagaaaccacccggttttaatacacgaatatattcacgaattgctttttcttttgcttcaataggcaacatggtcaacattgcttcattgatcacaatatcaaatgaattgtcttcgaacggcaattttgtcgcattggcacgctgaacttttacaagatcttcaacttcatgctctttaatattcgcacgtgctttatcaagcgcttcttcatctaaatcaataccagtgatatgacaaccatattgtttagcgatttgaatagcagtcgtacacatattgcatgcgacttctaatacttttttatctttgttaaaatcaccattcgcaatgagccaatcggtcgctaatttaccacccggacgtaagcgagttttgccaagacgggctaaaaaattatgtcctacttcttcttttttcatagaaacctctctgcatttatctgcaaaattttgagaaaatttaaccgcctgtatgacggatatctaaaggattataccgaagtttttatgattcttatatacacgaatcgtaaaatttggcatcatattgcgtgtaatttatgcattaattacgcaatcaaacaaaaaggaaacaaaatgaaaaaatcattaaaaacaataatctataaccatcatcggggagaaattcacgaaagtgcaataaaagcgttagttaccgacccattatttaaaagtcgtgttgagcgaaaccgaaaaggaaaggggagttatcaacgaaacgcaaaacatcgcaaagccggttatgagagaggtgaaagcccatttaaaaatgttctgatgagcaattttaaatgggcttttttattagcctttaaaaaatgcataaaaaaatccctcgtctttcgacaagggattggaattttatggtgcactagctgttcccgaatttgcttgcaactagttgattttattgagtaaattcaatgatatttttgtgcgtgttacaaaacgtgttacataaattcttttcctaggtattctttatcctatataactgctatatagtttatttataaaatggtattcacctcttcactttgtaataaaaactattatatatcaatatcttatatagtgaatacttattttttaagtcttcactaagtattcacctcttcaccattctaaaaaaataaatatttccctctcatttttttgctatttgattaaataataagcaatcagatttttattacatatcataactaaacgtagctaaacgattaaattttagactattgaatatctcttttaagtctttagtatgtgttttatttttgaagattttgtttgttataagaggaatagagatgattattcataatcaaatccgccaagagattttagatgtcttggctaatggcggacttaaaaaaattaagtttttccataatgggaaaacagtatttaaagacttagggcaggaattgcccgctatttcagtctttattgatgaaacagaaagtaatgcttttactgtatgtgaagatgaatggattggtgatttacaaattgctatttatcttccgcttcactcaaacgaaagtgagctagatgaaattgccgaacaaatttcattcattatgaaagattgtgatttagaaacggttagcgattgtcgattaagccgttatagctatgactatgatgcgaatgaatccgcatggattacggcaacgttacattattcaattaattattttagttaaggtaagtgtatgtttaaaaaattattagaagcccgtaataaaaaagcggcgatggtggcagaaatgcgttcacttatggaaaaggcagaacaagagaaccgttctttaaatgaagaagaagccggtcaatttgatgctttaaaagcaaaggttgaagaagtcaaaaaagagattgaccgcttagaaagtgtgaccgaagaagagcgtaataatccaaattatcagcaagcggaaaaagctacaaatccgccaagcaatgatgaattgcgtcattggattaaaacaggtgaaactcgagccttagctacaaatacaaatgccggtgcggatggcggttattctgtgattcctcaattagataaagaggtcatgaaacgtttaaccgatgatggcgtaatgcgtcagattgctaacgtcgtgaaattaccggtaggtgtgaaagaatggaaaaaattagtatcagccggcggtgcagtggctcaacacggtacagaaggcgaagcacgcacggaaaccgcaacgcctaaattaaatgaagtcactatcgccctcaacccgatttacgcttatccaaaaacgacacaagaaattttagatttcagcggcgtggatattttaggctggctaacggatgaaattagcgaaacatttacagatacggaagaaatcgatctaacgaatggcgatggttcgaaaaaatcaaaaggctttttggcttacccacgtactaccgcaaatgataaggctagaccttttggcacgcttcaaaaaatggaagtacaaccggcaaaacttacggcggatacattgattgaccttttattctcactacgtagcaaatatcgtaaaaatgctgtatgggtaatgaactcacaaacagccggtacattacaaaaactgaaaaatggtaatggtgattatatttggcgtgatggtcttcaagtcggtagcccttctacgcttttaggcttaccggtttactatatggaaacgatgccaaacgcagaaggcacaaatccattcttagcggttggtgactttaaacgaggttatacgattgtagatcatgaaacgggcgtacgcactaaaccggataatattaccgagccgggattctataaaatccacacggacaaatatttaggcggcggtgtggttgattcaaatgcgattaaagtgttagaagcgaaagcctaaagcaacaccttgaaagcggtctaatttgtaagattttttacaaacacgaccgctttttatcttttgggggataaatggaaaatacaaaatttgaaatcagaaccgccagtttagccgctgaacaagaaagccgtactttatccggctatgtggtgcaatggaataaacctagcgaagtgctatggggagagtttatcgaaacattcgcccctaatgcttttactaaatcgctaaatggtggcggagatgttcgagcattattcgaacatgattacactaaattattaggtagaaccagtagcaatacgcttaccttggcggaagataatcaaggcttacgttttcgcatagatttgccaaatacacaattaggcaatgatattttagaaagcgtacgccgtggcgatattagtggaatgtcctttggctttttaccggaggtggaagaatgggacgaaacgaaagaaccggcattaagaactattaagcaagcacagttatttgaaattactgtaaccagtattccggcatatccggatagtagcctagaaattgcgaagcgttcacgtattgccgccaaaagagaacagaaaaacatcaatcaagatgagatgcgtaaaaactggctaacgttggcggaggcttaaaatgtttaaatggtttaaacgaaataaacaggaatcagcgaatgaagttagatctacgccccttactttggatgagtattttagctatatgggtgcaagcaatacaaattcaggcgagtttgtaacgcctattactgcagaagcattgccggcggtattaaatgcagtaacggtaatatctcaagcggttgccagtatgccatgttatttatttgaattaacaagcgatgggcgaagccgagtacataagcactcggttgaatatctgctcaatgaaatgccaaatcgtaaccaaacgccataccaattcaaagaaacgatgatgcgacacttgcttttgaatggtaatgcgtatgcggtaataggttggaattataagggcgaagcggaatcactaacgccatatccgccgcatagtgtaaatattcaacgcaccaataaaggcacgtggatctaccaaataacagatattgacggcaacgtgaaaaactatcttcaagatgaaatcctacatttacgaaattctagctatgacggctttataggacgtagcccgattactattgcccgtgaagcggtgggtttggggatgtcacaacaaagacacggctcaagcataatgaataatggcttattagcaagcggcattatctcaacggctgaatggtttgatgaagccaaagggcaaaaggcgataaaagccttagagcgttacaaaggggcaaagaacgcaggtaaaacgccgattttagaaggcggtatggaatacaaacagttaggaatgagtaatcaagatgcggaatggttagcaagccgaaaattcactattgaagatattgcccgtattttcaatattagcccaatcttcttacaagattattcgcatagtagctactcaaatttcacggaagcgagccgatcattcttagggcagacacttaaaccgcatttagtcaattttgagcaacagctaaaagacgccttgatgattgatttagcaagtaatagccgtaagcgttacgtgattgaatttgatactagcgaactgttgcgaaccaatcaaaatgaccgtttcacaggttacgagattgctatcaaaagtggcattctatccccgaacgaatgtagaaagcgtgaaggcttaccgccttatgttggcggcgatgaatttagccaagcatggaaacaaaccgtagaagttaaaaaaggtaaaacaaatggcgagaatggttagagccggaaaattcgataaggttatagaaatacaaaagccaatcagtaagaaaagtgattatggttcccctattcgagaatggcaaacagtaaaacaaatacgggcaagtattgaaccactacaagggcgagaatattttagcggccctttccaaatgggggagaacatcacccgagtaagaatacgctatcagcctgatttacctatcaatagaaaaatgcgtgtgaagtatggagaacaaatactagatatttattcagtaattgatagtaaggaacggcatgaagaaattcaattaatgtgtaaagaaggggaagcgtatgagcgttagtataagcctagatgaaatcaaagcccatttgcgtattgagcatgatcttgatgattcattactggagatgttggcggaatcagcgttagaagtagctcagaactatattggtaaaacgtggggcgaaagcaatacggaaaaagaagtgaagtttactagtggcataaaagtaggttgcctaatgtttatcgggcatttgtatgcgaatcgtgaaacggtggcggatgtccagctttatgaagtgccttttgctattagtgctttatggaatccatatcgagaacctagcatttattagggggataaatgccgatgcaaccattaaggcgttgtactttccccggttgtcgtaatcgagtgaaatccggacgatgtgatgagcataagccaaaggatacccgacagagtgcagctaaacgaggttacgatcatagatgggcgaaataccgtaaaggatacttagcacaaaatcccctttgtgttatgtgtttagcaaaaggaatctacacaccggcaaccgtgatagaccatattaagcccgtagagaatggacaagcagatccgttattttgggtaaagtcaaaccatcaagccttatgccgagattgccatagctacaaaacaagagagatagacaaacgtggatatggtgcgaagaagtaaaggaatggggaaaatcaccatacctagccctatccaaatttggatgagcttaaataataaacaatttgaacaggtggggggagtttttaaaagaaaagtcacaccgccaagaaccgcccgccccctcaaatttttacgcacggcaatttttcagaaaatatagacaggacaacatgacaaagcgaaaaacacctaaagccccaagttatttagatgcaatcgcaaccgatcaatggaagcgaaaaataaaacagttagcggaacgtggggatataaccgaagaagattacactaacttagaactgtattgcgtgaactattcgctttaccggcaagcggttcaaaatattgccgagcgaggctttagcattactaatacgcaaggcacggaagcccgtaatccggcacttaccgctaaaagtgaagcagaaaaaatcattattaaaatgtcgtccttactgggctttgacccagtcagcagacgtaaaaaccccgtagatacagaagaaaaagacgtattagacgaactatgacgatatggaatgactacgcaaaagcggtaaaaaatggcgaaattgttgcttgtaaacgcataaaacaagccgtaaatcgctattttgcggacttagataaccctaattattactttgatagtgaaattgtagaacgttttttaaagttttctaaggtatgtccgcacgtaaaaggacacttaagaggaaaagcgatcgagctttcagattggcaggtatttctattcgctaatattttaggctttaaatatcgtgctaccggtttgaggaaatatcgttccgcttatattcaagttgcccggaaaaatgctaaatcaacggtggccgccgtgcttgctaattggtttcttgtaatggaaaaaggtcagcaagatatttacaccgcagctgtaagccgtgatcaagcccgaatcgtctttgatgatgcccgacaaatggcggtattaagtaaaccgcttaaaaagcgagtacagattcaacaacacaaaatgatttatccgcaaaataacagcctaatgcgaccgcttgcggcgaagtcgtccacgattgaaggcacaaacccaagccttgcgattgtggacgaataccacttacaccccgacaacagcgtttatagtgcgttggaattagggcaaggggcaagacccgaagggcttttatttgcgataacaaccgccagaagtaatacgatttccgcctgtaaacagcattatgattactgttgccaaatattagacggtaatgaacaaaacgaaagtattttcatcatgatctttgaactggacgatgaaaacgaagtggacgaccctagccaatggataaaagcaaatcccaatatcggtaaatctattcctttccaagactttgaaaacaccatagcgaaagcacgtgggattccgtccgaatgggtagaaatgctcactaaacgctttaatgtatggtgtaacggttctacaccgtggttaggcgaaggaaactggaaagcgtgcgaaagaagctatcaagaaacggatttacacggtaaagaatgttatatgggcttagacctttccagtacaaatgaccttactagtatttgttacgtgttcccaatgccaaccggcaaagtacgaactattacacgccattacataccggaatatcaattacagaatgtggccaataaaaaccgggccatttaccgacaatgggagcgtatggggtggttacgagtaaccggcggcgattgtatcgactatgaccggattagagatgatattttaaaagatagtggcattttcaatataaaaatgattggttttgacgtatggaacgctacacacttacgcacccaattacagggagcaggattagaagtagagccgtttcctcaaacctatcaacgatttagcccggtggcaaaatctgctgaggtactcatcaatcgccaaatgatagaacacaacggcgatcctattctatcgtgggcattatctaacgtggtaatggaaatggatgcgaatgccaatatcaaaccgaacaaaaagaaatcggcgaataaaattgacccggcaattgcttttttaatggcggtgggtacgtatcaattagagtacggagatttagcttttgaaatgtcagatgaacaacgaaaattattagattcattcacaggagtagatatttaatgaaatgcgaagcggcaaagaacaatcccctaattatggatcaagcgattcaattctatttagcaaaccccaaaggaatatttacttttatgagcctttggaatgataacgagccatattcaaagcaagagttaaaaatctgcttgaatagtaggataaacaaactaaaagcattattttctgttcttcctaccataggtacagaattatccttaaaacgtctattaagtcaaaaggaacaattacaatgagtgtgaaaataaccggcttaaaagaaattcaagccaatatgaagaaaatagaaaaacagttgcaaaaagaaacagggaaagcgattcgtaaaagcctgaatgcaggagcaaaagaactaaaaagcgcagttaagccttatattcctgttcttggttcaagcactaattttcgacaaaaaggcacagtaaaaaataacttgcggcacaatactaagatagccaaagacgggatgagcgggaagacgatagttagaattagacgagctggaaaaaaacggatggccagaataggagaaaatacccgtgatcgtacagacccattctactggtacttgctagatcaaggtacaagcaaaatgaaagggcagcattttttacaaaaaggtgaaagtgcaggaagagcccgagcattaaatacagtcagaaataaattttatgaagaaatgaaaaacgtaataaagtagccttgaaatatcggcgatgagttgctataaattagtcaatgattcgccattagccattattaggggcttttatgaaagactataatccactatttccaagcagaaaaaaggaagaagtaactttatccgatgtggtcggtagcttttttgatgtgattcgggcagcagttccaacggaaaataatctggtgaacgcaaaaatcacctacacaaccccaaaaggagatgatttcaatatcaatctagaaattaaggcaaaatcacagaaataaaccaaattaacgcacctaggctgatccccgaaagcaagaaaccttatcttgttggtgcgttcctaccataagggctaaatgcgaaaggggcattaatgactaatcaaaaatttctacctaaaaaagcatattcaattaatgacgcagtaaaatatatatctttaaaccataatataaacataactgaattagacttaattgaatatattcaaaatggggatttaatcgcctccgttcaccttgatggaagtataagaaagattgattacataaatagaaaagaatttcatagaaatgagactttgagcattcgaaatgaagaaatatttatacaatttagtaaatcagagtgcaatgcaaaaattaaaataaatgaagattttgaagtgattagggtaacattaaataacgtttattttgacttagacattattctgaataaagaattttatcttgaaagttacttttcagataatgatttaataaaactttattctggcgagataggtagattccaaaacatactgtttaatggttatttccctttatcaaaagaattatttgatagggataatgttagaaccataatagaacgaggctatctacaagaatttgaggatatattcataaataaaggggaaggcttttatttccatttaccgatttatgaaaacagaactaagatatatctcgaagacatctatattttacatcaggatattatagaatttttagaattattttctgttattaaaccagataatcagcaagaagaaatatataaaatcaaagagcagctaagaaatagaaatgatgaactttcaagactttatcaagaaattgaggtgataaaaaacaaacctagcgataaagaaattaaaggtaaatccgaaacaagctatctaaacattattcaagccttaaaagatgagttattagcagatgaaaaatttaaaaatcaatcagaattgattacatttttagctgataaatatcaaggctacacaggcttaaccgaaagcaatttaagagataaattcgccaaagctaaccaaattaaatagaccactcttttacaaaaaatctatatagatctaaatagaatctatatagattttctcatttcctaaattcctttctaatacacctcgtaacgttacaaacctaaccgtttgatgatttatgaggagtattttaaatgacccaatcacattcccaatcaaagaaattaatcccaggtacagaagttacttctatagttggctttggtcgtaccaaacttaatttactagttaaagcaggtaaattcccacagccaatccgcttttctcaaaactttatccgatgggatttagaagaggtcgaggcgtggattgaagaacaaaaagcaacacgagtataagggggtaatagatgatgacacgttcaccaagagaagtagccgtgattaaggcactagtaaccaatccgcatttaggcataagtgaaaaagaaagttattttgatgttcatttcttaaacgcacgtaatgaggtaaaccgagtagaaaaacagctaggattagaatttaatcgtgtatcagaaacgagtaaatgggggaatccatacacacgttacaccgtaaaagatgcggagcaaattaaaaagttagtggaatatcacaatcacaaagtgagaaccggtaaagcacgaggaagcacccgtaagatttatgaaaacgttgaggaaattagcgatcagcaattatccaatattttgaaattatggggcaaataatcaaatgagcggtaaaaagaaaaagccccgagtggctaaccattcagagctttcaattccgcataatgcgaacatatccgagcagaattatagcattgtacggtttattagtaaattattaacagtggtaaatatagggggaagtatgagtgagcaaggtgcagataaagcaggtttagagatttctacaggtttgaaattcttttttaaatcttgcggcgtaggaattgccgtagcgttttttctatggctttcgcctgattttataaaagcattatcagaatttatcttaatgttaaagggcaattaatcctaggtaaccaataaaaaagccgtcggcaagcgactgctaacggctttttttctgaactgaaaaatccattaagaggaatatcaaaatgaatttaaatcaagaatattataaacaatgtgaaattttttcacaagaaaagggctttacaagcggtcagatttttaataaatttcacaacgtagtcgcaaaatcgactgccgagcgtggaaactcgaataatttacatacggcgaacattactagcacgccaaagaatcgtgctatttttgtttgtggactaaacacacctaaagaaaatagccaatcccaaaatggattcgctgaatttctctcaatggtagcgtttagtgggcaacgtttaatcgttggctgtactccgtatgttgcagttttccaccccgctaaacgctatcgccaaaccgtggaaagtaaagcgatagtcttcaatgtttttcatacggagctatcagccatgatctacctattcaaagccgtaagccgtttagacttacgcaacacgtcaaaaccgatttcatcattcccttgctataccgtgcgtattaaagccaatagcttagagcaagccaaagagattgtttgccctttctttgccgttaaggaggtggtttatgcgtaatcaagcagtcaaacagccagttcaagccactaccctaactgctgaagatattcaaacaattaaaaaatctcgtagccagttatggcaagtgctttctatcattcggattatgagccaatctaattatgaagagcctatagattatggtgtagcacttgaaggcgtggcggagttaatggacaaagccttatccgaattagaagaaatgagtgtttagggggtaaagatgaataaaaaattagattattcacccttaaacgccgtggaactcaaggcgatttctattgcctatgaaaatcttcttaaacaggcagatgattccgtggttccctattttagtacagcactaagggtattaggcgagcagtttataaattatccggatgaacagattccttcattgaaagcgttctataatgaattatcgacgatttcccgtcatttgttagaacttgcgccgacgccgccgagtttagaccctatggaattagctaaattagtcaccaatgatgaattagtcgatagtatgttaaagctaggtctaatcaattcgttggcaaaagacttatacgctattcaaagtgtaattgatatgcggctggctatgtttgatcatggcgtaaataggggggctctgtatgaaactcactaacgcaccctttttaaaagaaccgtggaataaacaatatttttctgatctgattgtattagccggttccaaagcgtgggaaacgtggaataaaggcgagggcgtagcgtggcgaatgatggtggacggcttgaaaatagatacgttcaccactagcactggcaaaattatcaatccctatgatcaatcgcctgtaattcttggcggtgatacgcttgaaaacattgtaaaaacacgtatctcagataaagagcaaaccgccattaaatttattcaatgtggcgaactcactagtaatcagaagacggcaatttgtttaaatattgcgaagatgactaatgccaaagtggtcactttattctcaagtgaactagatttaatcgagaattggagcggtcatattcaacgcttacgtaatgaagatgatgcccgactattatcagaaatggcggtagaaccgcctaaaattaaggaaaatgatcgtactaatgaaaaatcacgagctttccaaaaatggttaggcttagatatggctttacgtcgtggtagccgtgaaatttatgcttatgacgggaaaacgtggaaacagcaagaaaatgatgatttagaagaaagagcggttcaattttttgatgagtgtgaactagggtacagcgatagcacaatagatcggcttattaatacattaaaggcccaattaccgagaatgggcgaaatgccttgcgatttaatcgcctttgataatggagtattaaatcgcaataccttggaatttaaaccgcataaccggttaaattggctaaccgcttgtattccgcataattatgatgaacaggcaacaaatacgccatactttgataagtggctgaattttgtatcagatggcaatcaagataaagcgagaaatattttagctgctttatatgcgattttaaccaatcgctataactggcaaatatttttcgaagttaccgggaaaggcggtagcggtaaatctgtttttgcgaatattgcaacactactagccggcgaaagaaatactatatccgccaagttagaagattttgataatgcgaaggatttagaaggctttgaggataaaacgcttattctttgccctgaacaatcaaaatacggtggaaatggtggcggattaaaaacaattagcggcggtgatttattgcgagtcaatccgaaacataagaagccattttttaccaagattaccgctttaattatgcttatcaataatgaaccttgtaggtttacggaacgagccggaggggtagatcgtaggcgagtaatttttgattttaaaaaggtggttccagaaagtgagcgtgatcctacctttacggagaaaataacgcttgaggttggcggcattattcgaaaagtgctggatacatttcctgattcgttagaggcaaaaaaagccttaaatacacaaatgaatagccaagaagccttagaggtgaaaaagctatccgatccgcttacagatttctttagttatttctacactaccgagcaaatagacgggctttttgttggtgtggctaatatgggagtagataaaatcagaacgcatatttacccggcatatttggcttatacaagagcgatgaatattagtgaattaggtttaggtaactttgtgattggcattgagcaagccttaaagcaacatgggaatcaacatgattttatgaagaaacatactaaaacaggacggcgaacgaatatccattttaaggattttgacagctttaaaaatgaggtattggactgagaaaagcgggtgataagcccgctttttttataagagttcaccaaaaggtgaagccatagtgaaggcttaaatctaagtgttaaccgcttaaatcattgatttataaagaaaaatcacgaaagtgaacaggtgaacaccaaaacatataaaaaagtttttcataggcattattagaaacttaaatccattccgcaagattcgcaataatctccccaaagctgcattaatggccgtcttagttcgatatattccgcacggttgtatgcttggctcgtttcatttcctattctatgagcgaggcaactttctgccgccctaaaatctacggcttgatcttctaaatatgttctagcgatagatcgtaaaccgtgggaatcttggatgcctcgataaccaatttttcttagtgcgttggttatcgtttctttactcattgatttattcggttggctataatgtggaaatacaaatttatttacgccggtgatagggcgtaggctttccaaaattttaagcatttgcgatgatagcggtactgtatgcggaaattgccccttacgtgttttcttcattttttcagccggtataaaccaaagatttttatcaaaatcaatttcagcccattctatacttacggcttctgccggtcgaaccatagaaagtaattgccatttgaaaagcactttcgtcagaaaatccctatttgagttttggaagtccgctattaattttggtaattcacttggcttgattgccgggtggtgcgtttgtgcttctttatggtatgcgtcgcttacgttttggcaagcgttaaaaggcaatacgcccacggtaacgccataatttagaatctgattcgccaagtttagaatacggtgtaacgtatcattgattcccttatcatttagaggtttaaccgcttttataagtattggcggcgtgattttatctatggcgtaatgccctaatacggggaataaatgattttccaatctagcccaattcttttccatagtaagcggttcaacctctttacttcttttctctttccaaagctgggccagttttaaaaacgtattatcgttttgttctgcctgttgcctttcttgttcttctttattggctttaggatcgattccttttgctaataacgcacggtattcttcacgaatagtacgggcttccgcaatggaaatcgccggataatctccgatagtgaggttagttcttcttttggtaatcggttcttgatagttaaatatccacgtttttaccttagagggcttaactcttaaatacagcccgtaaccatcagatagggaatattctgccggtttgattttggctttttctacttcggtattattgagaggtttaacgattttaggcatagattccaccttgctttttaggttttttgtaacacgctatttttcattttatcagtgtgttacaaaacgtgttacataaaaaggcgttttaatacgatttaatgtgagggggtacgataagcaaaaggtactaaaaaagcccatataacaaggctctaacgttatttttgagcggttatgatgggctttaatggggtaaagtggtgcgactagctggactcgaaccagtgacccccaccatgtcaaggtggtgctctaaccaactgagctatagtcgcataattgagataaattctaatggaaaatatgaaggatagcaaggcttcacatttcgtttgattttattttaaacgttcctgggtgaaacattgtttattttcccagcgaatcatcgtgaggtggttaccccaagcgcaaccggtgtctaaggcgtagatattcggtttgtccgctttgcccattaagcttgcccagtgaccgaaaataatttcttgttgattaaataacggattatctaattcaaaccaaggttttaattcgcttggtgcgtcttcaaccggtaatttacaagcaaaatccaaccgcttatcggcatagcaaaaacgcatacgagtaaagacattcacaatatagcgccaacgttcgatgccttgccattcggcagaccaatgatccggcgtgttttcgtacatttgggcgatatagtcggcataatcatcactttgtaaaacggcttctgcttctctggcacaagcgatggtttctgctaaattccattcaggaccgataccggcgtgagccagtaggaaaccgtgagtcgggtgctgaataagaagcggttgatttctcagccaattttgtaaatcagcacgatcttccgcttcgaatattgcgtcaacctgatcactcggcttaactttttttataccaagtaatgtagcgagcaagtgcaggtcgtgattgcctaaaatggtttttgcattattctttggatctttcacaaagtgcaaacattccaacgattttgcacctcgggcaactaaatcgccggtcagccacaattcatcgtgtgtcggattgtaattaacttgtttgagtagcagttgtaactcatcaaaacagccgtgtaaatcgccaacaatataagttgccatcatatcctctcaagttataaatgaaaaactacattaaccattttactgctaaatggaaaatcggtggtgcgataaatgaagaaagtaagccgcagatcactaaagctaatgaactataactcgctgattttgtattgagttccatacaacgagccgtaccaagtgcgtgagacgcaatacctaaactcataccgattgcttgcggattagtaatacgaacaagttttagtacaggcacacctaataccgcacccaataagcccgccaccattacccctactgcgcttaaagcaaattcgccgccgatttcaccggtaatcactaatgcaagcggcatggttaccgatttcggcattagtgcggcaacgatatcttgtgtaccgccaaataatagtgctaataacataccgctacacattgaaacgagcgtaccaagtaacaaaataaagctgattgccttccagcgttggcgaatttgtggaaattgttcataaagcggaatcgcaagagcaacaattgccaaacctagaaaatggctgagcggagaagtaccttgctgatagtctttatacgggatttgaaaaatcactaagattgcgaccagcaataatagcgttaataaaaaaggattcagtaacgaaatcgctaattttttactgagcttcacactgaggaaaaagacaatgatagtcagtaaggtataaagataaatcattggtcatcctccgaatgcttgaataagcgttgtgctacccaaccgactacaacaatggtaattattgtactaaggatattggaaataattagcgaggaaaaataacgaactaaaatctcgccgtattcaatcatacccacacaaatcggtagaaaaacgagcggcatataacggtttaggaaacgtcctgtcggtagtacccattccaatttgattaagcctgtaataagcgtaacaaataagacaagtaaaccccaaatactatccggaatagcgataggaatgagcgtatttaaccctttgccgagataaagcattgcccataaaatcgctaaagaaagagcaaagccgataatgttcttttgcataaagcctcatgtgataagcggtcaaatttgtagaaaattttgcaaaaaattctcgaaatttgaccgcttgctgattagatgatattccccacaattgaacgtgtttctaaacgtacttcggtgagtttgactttaaccgcctgtccgatttggtaagctttttcgcctttaatgtaaagtgcgatttcttccggacggaattccatttcttcttttttatcgtgaatggttgagaacggtacgaaaatttgtgcgccgtttgcgatcactttcgctcgtacaccgccacgagaaacatctgcaatttcacaatcaaattcgaccgcttgttccaccattgggaaaaggtaacgtgcatagagccaatcagcgatatcacgttccaccaaacggttttgacggcgagcttcttgtaaacgaactaagatgctttcttctaccgttttcgcctgcttgccaagtaatacttgcttgattaagcgatggttgaccatatcgccgtacttacggattggagatgtccaagtcgcataatggctgatccctaacccgagatgcggtgcaacttccgatttaaactctgcaaaagtgagataacggcgtaaacgaagctctaagaatttctccggaaactcgtcaatcgaacgacgcatttcgcaatagccttcaagtgttgctagtttttccggcgcatataatgccgtaagcgcatcgcggttttcgtcattagctaacgtatccaataagaatttttgtgctaattctaaatttttcggctcaaagccggcgtgggtattaaatacgccagttttggcattgtcggctaagaatttcgcacagcaaatattggcaatgatcatcgactcttcgatcatttgatttgcaatgcggcggtattccacatggatatcacgtaccgaaccgtcttcatttaattcaaatgagtaatcgccggactctttaaataacaacgcattgctacggcgccattcgatgcgtgcaagagtaaattggtgtaaccaatcaatttgttgtttggtttccgcactttctggctgccacgcattttcaacttgttcgagataatccgatacgttgtcgtaagctaatttcgctttgctttccacccatgccgaaacaaaacgtgtatcgccaataatattaccggctaaatcggtttcgatataaccaactaacgccggacgtttctcatttggtacgagagaacagagatcatctgacagctcacgaggtaacatcggaatattgaagcccggtaaatagttagtaaaacaacgttgacgagcagctttttcgatatttgaattttccggaatataggcggtcggatcagcaatcgccaccactaaacgccaaccggtttgttcttcaccttgttcgattggctcgatatatagcgcatcgtccatatcttgcgtgctaggactgtcgatcgtagtgaaatagagtgatgtgagatcttcacgatctaattcatcgtgtaactcatagcttttttcattcgctaccggttcacggggctgttcgtgacgagctaatgttacccaccacggggcgaaattatcgtccgctttacagataaattgagtgacttgagcaaataagaaacgatcatcacgtaacggatgggttttgagttgtgctagcacccagtcaccgctttccaatgtttctgtgacttttttatgcgtatttgccggaatgatatttttaatgcttgggtgatcgacaataagttgtaatttattatctttgttaaaacgcacttgtgcaataaagcgatcaagcatcggttcaagtaaactgtcgatttctacctgttctttgtcgccttcacgttttactacggctttcactttatcgccgtgcattacttttttcatttccattggcggaatgaaataacttttcttgtcacattctaaaaaaccgaatgccttatccgaggctttaaccatgccttccacatattctttatttgcctcaatttgttgttttaattgggcaagtaacggattgtcttgaaacataaattctctctacaaaaataaaaaaaggtgcagcgtagttgcaccatgaaatctagtaaggattataacggaaagcggttagatttgctgaattttttgtaaaaaatccattaaatctaaccgcttggataattttataatgctttcgaaacataatcttctagcacttgattcattcggctttgccagccttttccagtggacttaaaagcatcaatcacggattgcgagtaacgaatggtcacacttactttcttggtttgtgcaacagggcgaccacgtttccgctcacgactttcaatgaccaatgcttgtaatgcagggggcatttgttcgaaagtgagggcatttttgaaatcttcatctgtccattccggattttcgtcatcaatataatcttcggtatatttcatatttttttacctctcttggattggctttacgcaagctgataatacgataattttcgttcctcaaacaaaaaacgatcacgaaaagtcgttcgtgaatgaatcctattactttaaaacgaggtttcgagtattcaaagcgaatatcttgttcaataaaagcggtatctaattcaaaattttgtgcaaccgaaaacggtaaacctctttcttgctcgttgcgtaggcttttttgttcatcatattccagcttcatgctttgcctctacattatcacgttaaaatcagacgctcaaatgattttttgtaactacattaatttattggatagcatagcaaaatacggcagagaaggactggctaaaattctgattcttcgatcaagatcgcagaaataaaaaacggacgctaaattgcgcccgtttttgttttatggatagctgaattattcttcgcctagctcacccattgcggtaatgctgaaacctgcatcaacgtgtaatacttcaccggttacacctgaagctaagtctgaacataagaatgctgctgagttacccacatcatcaattgttacggtacggcgtaatgctgcagtttgttcaaatgccgctaacattttcttgaagtttttgatacctgatgccgcaagtgtacggattggacctgcagagattgcattgacacggataccgtctttacctaaatctgccgccattacacgagttgccgcttctaatgaagcttttgctaaacacattacgttgtagttaggaatcgcacgttccgcacctaagtagcttaaggttaaaagtgctgcattttcatttaagtatggacgcgccgcttgtgccattgcgacgaagctgtatgcactgatatcgtgtgcgatacggtagccttcacgtgttgctgcgtttacataatcaccgtctaattgatcgcccggtgcgaatgcgattgcgtgtacgaaaccgtcaaatttttcccattttttgcttaattcggtaaagcagttttggattgattcgtctgttgctacatctaatggtaatacgatatctgaaccgaattctttcgcaaactcttcaacacgtggttgtaatttatcatttaaataagtgaacgcaagttctgcgccttgtgctttcattgctttagcaatgccgtatgcgatagaacggttacttgcaagacccgttactaaaatgcgtttacctgttaaaaagctcatgctggattccttttgaacattatcgaagcgtggtttacgcttacttcatataaaacaaagggcgtatgcgatacgcccctacgaaattttgcggattataccgaaaaaacgaccgcttgcgcaaatttcctgagatttcatgcgtagtaagcggtctgattcgagcagttttttgcaaaatttttgatgaatttgaccgcttaatttatttaatcgcaatcattgagccgaaattgaaacattggaaccaaagttcgatttgggaaaaaccggcttgttttaaacgttctttatgggtttcaatgctatcggttaacattacgttttcgagcgcggtacgtttttggctaacttcaagctcactataaccgttggcacgtttaaaggtgtggtgtaggtcaatgagtaattcattcattgtgtcattagcaaaagtaaatttttcagataacaccaaaataccattcgggtttaagccctgataaattttagtcagtaattcaagacgatccgctcgaggtaagaattgcagggtaaagtttagcaccaccatcgaagcatttttgatctcaatatggcgaatatcgtcacaaaggatctctgccggcacctcagaatgataagcgttgatatgcgagcggcagcgttccaccattggctgtgagttatctacgccaataatcttcacttggctggtttgtagattgcggcgaatggataaaattcccgccccacgtgaacaacctaaatcataaacttgtgatccttcggtcacgaaacgttgcgccaacataccgattgccgtaatgatattcgaatagccaggcacagagcgttggatcatatcgggaaacacttcggcaaccgattcatcaaaggtaaaatcaccgagtttctcaatcggtgcagaaaaaatcgtatctttactactcatgtcttgttattccttgtctaaaaatttttgaatggcacgcgcgaccgtttccggtttttctgcgtgtacccaatgttttgcattggcgacaacaaacgattttgcctgtggaaattgcttcagaatcgtgtcggtgtctttcgcttgaatataatcggatgcgctgcctttgataaataaagtcggtttatcaaaaaagacttcgttccaacccatcaaattttcatagttggttttaattgccgttagattgaagcggaaatagtccggtttttgcggatcgaacgcttttaacataaattgttgctcgccttcgtctttcacatattgcgccaatatggtttttgcttgttggcgtgtttcgggttgagcagctttaacggcaaataagccggcaaaattattgtcatggcggtgagttgaattagcagttggtgcaatatcaattacgactaatttatcgaccaaagcaggcgcaatatcggctaaagtcatcgccgttttgccgcccatcgaatgaccgatcacaatattgtccgctaacgctaaatgctctaacaatgcttgtagatcttgtgccatcaagtggtaattcatttcatcggcatgaaacgattgaccgtgattgcgtagatccacgcgtaagatattaaattgctcgctaaattggcgggcgataatgcccaaattattcatatcgccgaataatccgtgcagaaaaatcatcgtctgcgcatcggctttttccgttgccggttggaattgataattaagataagtattttctgtcataagttgttattttttattcaaatgtttggttaagatcctgtaaaaagatcttgaatctgtattataatgcctagaatttttttctaatcaagtaaatcaaaacaaaaatatcaagaggttaagatgaaaacgatcgaagtcgatgatgaattatatcattacattgccagcagaacccaagcaattggcgaaagtgcgtcagatattttacgtcgtctgttgcgtttaccttcatcaccacaaccttttgtactggttcaacaaaatacgattgatgaactgaaagaattagcgaaaccaaaagcaaaggctaaaaaggaagagctaattgaaaaagcagtacaaaaagttgagaaagttttgaaatcagattcgtttattaacgaaaacaaaaatgttacacgctttttaatgttactttcggcgttacatcatgcaaatgcacaaggttttgctcaagcaactgaagtggtgacggggacggaacgcacttatttcggcacaagtgaagcggcattattaagccatggtagcagcgtaaaagcgaaacagattccggattcgccattttgggtggtgacgaataataataccgcacgtaaaggcttgattcttaccggtgtaatggaatctatggagttgccaaaacacttaattgaacgtattcgtatcttattttcttaatcgtcatttatggtaaatttttcctttttcccgaccgcttattgggcagtgaatgctgcgcagaggcaagctattgtgtgggaaaagggaaataccgattattttccctttctttcttcttcacttaattgggcggaatttcatcgtttagtttcgcaaacgactgatttacttgcttctcaaggcgtgagaactaagcaaataattgcttattccggcacgcatcggttaatcggattgctttgttattgtgcagcgattgcaatgggcgcacgtattttgatgttaaatccggcattaagtgaaagtcagcgccaaacgatccttgcagaatattcgattgatattttgattaccgatcaacactttgcaaattttcagcaaaatcagaccgcttatccgttttcgaattgggatgcaactgagccggcgacgcttacgctaacttcaggttcttctggaataccgaaggcggtagttcattctgtacaaaaccatttagaaaatgctgaaggtgtgtgtgaattaatgcaattttgccaaaccaattcttggttactaagtttgccgttgtttcatgtgtccggtcagggtattgtctggcgatggttggcgcaaggggcaaccttggtcgtgaatgagcagaaagatcatttttttgcttgtttggatcgtgtttcgcacgcctcattagtgccgacccagttacagcgttatttacaaactagaacagacaaaatcaccgaggcaaagaaattcttattaggtggtactgcgattcccaaagcattggtagcgcaagcgcagcagcgaggcattacgtgttattccggctatggaatgacggaaatggcatctactatttgtgcggttgaaaatgaattggataatgtcggttatccacttaaagggcgggaagttaaattagttaacgatgaaatttgggttcgaggtagtggtttagcactcggttatttgcaaaaaaatggtgaaattagaccgcttgtcaatgaggaagggtggctactcaccaaagatcggggcgaatgggactctgccgctaaattagtggtgaaagggcgattggataatatgtttatttccggtggtgaaaatattcagccggaggatgtcgaaaaagtcatctatcaatccggtttggtgaatcaagtctttattttacctgtcgaagatgcggaatttggtcaacgacctgtcgcagtggtgcaatttatttcacctgattttgcaaaaaattgtgaaaatttaaccgcttggcttggcgataagctcgaaaaatttaaacaacctatcgcttattatccgcttgagcgtgtgcagcctcctacacaaggcggcataaaaatttcacgtgtacaactacaaaacgcattaactcaattattaggaaaatatcatgatcaaacgtctgtttaaccctttcttatttagcctgactttggtgcttagtagtcatgcgctttgggctgcagaattaccgacggaaaaagatatccaaatccaaatcgatgagacgaaaaaacttgaacagaatgaagtcaataagtctttaatcaaaagcttggaagatacacaagcgcttttagcacaaatcacacaacaaaaaagtgataattccgcattagaaaaagagattaaaggtgctcaggcggcgttacaagtcagtaaaacggatattgctaaattacagcatacacctcaagttacattagagtcactggctaaatattcacttgatgagctgcaaaaacgtcttgctgccgctcagtcaagtagccaaacagtacaacaagatctaactaccattaacggcaaattagtggcgcaaaactctgcgccaaccaaagcacaaacggtgttaacgactaacgcaactcgtaagcaagaaattagtactttgctcggtaatgtaaatacctcacaaacggagagatccaaattagaaaccgaattagcgttacttgatctgcaaaatgcctacaaccagctgttgctgcgtggcagtgatgaattggcggcactctataatagccagttagaagagaagaagttagtacaacaaaatatacaaaatgagttgagtcagctgcaaaatgcaattaatgctaaattagtagaagaatctaaaaacaaggtggagcaggcggcacaatcacagcaagaaggtacaacttcaaatacaaatccgcttattattaagcaattagatcttaatacgcgtattagtgaagaattactgaagcaaacaacagatctcacccagctatcacaggataatctgcggattaaaggcgtgcttgataatttgcaacaaacgcagcgtaatatcgaagaacaaattagttctttgcaagggacgctggtgctttctcgtattatcaataaacaaaaacagtcattacctcaagatcagatggtgaagggcttatctaagcaaattgccgatttaagggtgcgtgtttttgatcttaccgaatttaaagacagtatctctgatccgaacgtctatattgcgaaattagagaaagatgaaaaaaccgaactgacggctaaagagaaagaccaactcaaaaatatcttggcggagcgttcaaaaatcttagctgaaatgataaagtctctgaataatcagcttaatttatcgatcaatatcgaattaaatcagcaacaggttcaaacgattagtgatacgctacaaaagaaattagagcaacaaagtttttgggtaaaaagtaatagcccgattgatttggattggtttaagagctttttagcggtagcaagttttcagttaaacgatctagctaaaaaattcgatttttccaattggaaagacaatattattcctgcaagtatctttgagattttacttgcactaggcgtatttattatttctcgccgcaaagagcaaatcaaacagcgcctaacccaaattaataacagcatgaaaacggtggcaacagatagtcagtggaatacgccgcttgcgattttttggaccttgattctctgtttaccaagtacctttatctttttgatggtatttattttaatcacctacatttgtttccaagatccgacagaagtatggccttggggattaagaatgtccgggtattggctctattttgcatttatggtagcgatgctgcgcccaaatgggattggctatcgacatttcaatatgccgcaaaaaagtaatgctgtgttccgtgatattttaaaacgttcggtttgggtaatcggtttaatgttaaatacagcggtatttagcaatattaacgaaatgggaattgcctatgatgtgcttgggcaagtatttaccattatagtgttaatcagcattatttttattgttgcaccggggtttagacaggcgatatcaacttatcaaaatgttgcgaccgatgaagaaagccctcgtaatctattattaaatattgctcgtacggtgttatttttagcaccaattgcattagtggtgttaatcggtttaggttactactatacctccttaattattatagaacatttagtatccacttattttgcagtcattacttggattattctgcgtaatgtgttctaccgtacgtttaatgtggcatcgcgtcgtttagctttccgtcgtttacaagaaaaacgagaacaagcattagcgaaggtaacgaatactgagcagcaaattgtacaatctgaaggtgatatttcatttgaattacacgatgacacgttagctgtaagtgaaattaaagaccaaatgttgaagctgaccgatcttttactctgggcatcgttgttcggattactgtattgggtttggtcggatttagtcaccgtagcttattatttaaacggtgtgacactttggcagcaagcaaccgatacggctacaggtgtagtaatggaatcgattacattactaaatctgttagtggcattcggtattctgtttgtgacttacgtgttaattcgtaacttgagcggtttattagaggctttagtgttttctaatttaaagctttcgcaagggacaccttatacggtcacaacattattaacttatttattgattgtacttggtgcgacacttgcgtttgcaacgttgggaatgtcatggtctaaattgcaatggttatttaccgcattatcggttggtttaggctttggtatgcaagaaatctttgcaaactttgtatcggggatcattattttgtttgaacgtccggtacgtattggcgatatgattactattggcacgtttaacggtacggtttctaagatccgtattcgtgcaacgacattaattgataatgatagtaaagaggttatcgtaccgaacaaggcatttattaccgagcgtatagttaactgggcgttgaccacctctatgacacgtttagtgattagtgtgggggttgcgtatggttcggatctggatttagttaagcgcttgttattacaagcggcggaagagaatccaagtgtactgaaagatcctgctccggtggcttatttcttagcgtttggtgcgagtacattagatcatgaattacgagtacacgttggacagatttcagataggatgcgcacggttgacgaattaaatcgacgcatcaatcaattgtttgctgagcataatattgaaattgcctttaatcaattggatatctttattaaaaatcaagcgactaatgaagaagtgaaatgggcaacggaaaaatttaacgataagaattagaggtataaagcttacttatgatgtttaagaaagcctggcaattagtattacttggaggtctgtttccgcctttcctttgggcggaaacccagcaacaagcggttgaagcaagcgtccgtaatcaaattagtgcgttgcaaaccggtacgcttgatacggaacctagttctgccgactcgcaaacgttaagtgcaacattgcagtttattgagcagactaaaaagcaaaaaagtgatttagttgcgttggaaaaacaaatccaaaaacttccccaagagttattggaaattgaagctcgtatcaaagattataaagatgccacggactcattaaaaaatagtgagttcaacgggttgtctttggataaattaagccaaaagcaggtggagattcaggcacaactacaagcggtacaagtgacattgagtgaattggatagtcgtatatctaatgggcgtaatcttttgttgaataatcaaaagaccactgaagaaaatgtagtgagagcgcaggaaatcactcgcttaaaaaataataatcaagcgagcaagcctatgatggatagatggaacgctgagcttgattatattgatgcaaataataaatttaatgcactactcacaactaatgcggaaaaactgattgaattagatgaggagaaaagaagtgaagcgactgctcagcagcaacttctacagaagcaattggccattttgcaagatgccttaaatgctaagcggttacaagagtcagagcaaaaagcattacaagttgaaagccaacaggttacgagtggtattcaaaatttcttaattcaagatgaattggagcataaccgagaattaagtcaattctgggttagacagacacaagcgttaaatgcgttatcgcaagatgatttgcgcacaaaaaatgtattggaaggcttggcacaagcgcagcgtaatattgaagagcagattagtgcattgcaaggtacattagtgctttctaaggtgattaatcagcaaatgcaggcattgccgacagcgaaattgaataatgacttagctacctcaattgcgaatgtgcgtgtgcatatttttgaatattcgcagcaacgagatcaactatataatcttgatgagtatgtgcgaaatattacattagcgcttgaagagccgctgacttatgaagaaaacttggcgttgactaagctattgaaagaacgccaaaaattgcttgatgatattattaagtcattaaacagccagctaaacgtttccattaatatcgaaaataaccaaaaacaaattgatgcgattagcagtacactacaacgtaaattgcagcaacaaagtttctgggtaaacagtaataatccgatgggtttggattggattaaggctttccctaaattagcgttttctgagattgcggaattaacgaagtatatgagcttcagtaatgtcagtaagaatttgttacctacggcattatttaccggtttctttttattaatttcgtttttactgaattggaaaaaaaaggcgataaaagaccgcttgtctaggattgcaagtcaagtcaacacattaaaaaacgatagtcattggtatacaccggaagcaatgttttggacattgttgcttgcgctaccaagcaccttaatgttttttactacttataaccttatcgcttttttattctttgatgatccgatttccgcatggcgttggggcgtgcgtttaactttatattggtggttctttgcaacggctttatcgctattacgcccgaatggactggcttatcgccatttcggtatgccgcaagaaagtaaccgcattttccaacgtattatcaaacagtctatttggattatcggcttattattgatctcttcgattccgtctcaaattgagatgatcggctatccaaacgatgtgattgggcaggtaatgtctattgttgcgcttgcactatgtctgtttgtggtgcgtccattattggatagagggattaccgaataccagaatgcaaaaaccgaagacggtaccattcgcaatgtgagcttatttaagctattgcgcttggtattaattgttgtaccgatctcattaattgtgttgattgtattcggttattactatacggcgatttatctgattacgcatttactgaatagctactttgtgattctgatttgggtattcggacgttattttgcttatcgtgcggtaactatttcggcacgtcgtttagcttatcgtcgtttgcaagaaaaacgacaaaagatccgagaacaagcggcggaaccgccgaataaggatgaaataaaagaagaagagtcgataaaactttcggtggttaaccaacaaattttccgtattaccgatcttattggctgggtggttttatttggtttactctatgtagtttggtcggacttaatcagtatcgcatattatttagatggtgtaattttattcgaaagtaatgatggtgataaagttgaggcaattactttattaaacctcatgcgagctttcttgtatgtgatagtgacttatgctttggttaaaaatattgccggtattttagaggtgattctattctcacggatcaaattatctaaaggtacaccacaaacgattactaccgtctttatttatacgattgtggttatcggtggggtatcggcgttctctgcgttaggtatttcgtggacgaaaattcaatggatttttacggcgctatccgtggggcttggttttggggttcgtgaaattttcggtagtgtggtatcaggttcgattttattatttgaacgtccgattcgtgtcggtgataaagtcactgttggacagcacacaggcattattaccaaaattcgtttgcgttcaaccacattactcaattcggataatatggaagtagtattgccgaatcaggcatttgtcacagatcgttttattaactggacattaaataatacgattactcgtgtacaattctttctaaatgtacacttagacgacaatctgcaaaaagcaagggaattaatcttgcaagcaattgcagaagcccctaaagtagtggctgaacccaaaccggcaatcaatattctacgttttcacgataatgcgctagagcatgaaatcgaagtgtttgtaggagaattaggtgaccgctcggaaactttaactttcttacattatcggattaccgaattattaaaacaaaatcaaattcgattcgctttcaaacagttggatgtcaatatgcatacggcaatagaagaacaacaagcggtcaaatttagtgaaaatttagcaaaataagaaggaagcattatggcaggcaacagcattggacaattatttaaagtaaccacattcggcgaatcgcatggtattgcattaggttgtatcgtggatggcgttccgcccaatatggaactgtcggaggcggatattcagcccgacttagatcgccgtaaaccggggacttcacgttataccacacctcgtagagaggatgatgaagtccaaattctgtccggtgtgtttgaaggcaaaacaaccggtactagcattggtttaatcattaagaacggtgatcaacgctcgaaagattacggtgatattgctgataaattccgtccgggacatgcggattatacctatcagcaaaaatacggcattcgtgattatcgtggtggtggccgttcttcagcgcgtgaaacggcaatgcgtgttgcagccggtgcgattgcaaaaaaatatttacgtgagcaattcggcattgaagtgcgtggttatttatcacaaattggaaatataaaaatcaatccggaaactgtggcggatatcagtaaaatcgactggcaacaagtgacaagtaatccgtttttctgtccggatccggttgctgtggaaggctttgacgagttgattcgtgacttgaaaaaagacggcgattctatcggtgcaaaattgactgtggtggcagaaaatgtaccggtcggattgggggagccagtgtttgaccgcttagatgcggatcttgcgcatgcgttgatgtcaattaatgcggtaaaagcggttgaaattggtgacggttttgccgttgttgagcaacgcggtagtgagcatcgagatgaaatgacaccggaaggttttgtctcaaatcatgccggcggcattttgggcgggatcagctccggccaaccgattattgcacatatcgcattaaaaccgacatccagtattatggtaccgggacgctcggtgaatttaaataatgaacaagtcgaactggttaccaaaggacgccatgatccttgcgttggtattcgtgcagtgccgattgccgaggcgatgacagcgattattttattggatcatttacttagatttaaggcacaatgccgttaagtcggttataattaaaacaagcggtctgatttgcaagattttttgcaaaaatgaccgcttgtatttttatttgtttaaaaaatttgtagaaagcatttatgaaaaaatttaaaactgttttgttatcagggctccttagtttagctgcttcaactcaggcgactctttgggagcaaattcgtacaccggttgccggacagcctcaagcgattggtggttatagcaatgggtgtattatcggtgcgcagccgttagcattaaaaggcgaaggctatcaagtcattcgctcggcacgtaaccgtttttacggacatcctgacctactatcatttttacaacgtttagctaaaaatacgaagaacgcaggtttacctccgatcttaatcggcgatatgggaatgccagcgggcggacgtttttcttccggtcatgccagtcaccaaaccggcttagatgcggatatttggtttagatttggtccaatggatgcagaaacggcgaagaatccggcaggtttagcaacattaatggtaaatcgtgatgcgcaggtagttgatgagcgagtatggacatcacaacacgcaatgatggtgaaattagcggcgcaagatactcgtgtggatagaatctttgttaacccggcgattaaagtgaaattatgcaataccgccggttcagacagaaattggttacgcaaagtgcgcccttggtacggacacgattcgcatatgcacgtgcgtttaagttgtccgcaaaatgcgccgaattgtgaaaaccaagctccaattccggcaggcgatggttgtggttcagagctttattcttggtttgagccggcaccggcaggttcaaccgcatccaaaccaaaagtgttaccgacacctccggttcaatgccagatgattctttcatcgcaaggacttaattaataaaaaaacgcaccttaaaatgctaaggtgcgttttttctagctatcgcttttaacgattattccgctttaatcgcaaaagctttgagcatggtacggaaaatatccgtgttatcgacaaagaattggctttccggcgcagctttatagtacgtacctaaaccggcttccggttttgcgatatcaaggaagtgtttcgcaccaaaacctttagcaaataccgggaccaattctctggtgtgattatctgaataccagcgtaccagcggtagtgcgcctgcaccttgattaatgatttcagagtagaatttgtcatttgagtcgggaccttgtaagaagccgttaccatggtcggtggttacaattaataacgtctcatcccaagagctattgttctcaacccacttaacagctgcttcgacagcaaggttaaaactgatttgctcttcgactaaacgaggcagattattagcgtgtgccgcccagtccaccgcaccgccttccaccattaagaagaagcctttatcattcttactgaccacatttaatgcaccaagagtcatagtggctaagtccggttgattttcaagtaaatttcccgcagtgaccccgtctcgattaaattgtaatgtagcattattcggtactgtaccgagaattttttgtttaccgttaaaatctaatttaccttcagcaagtgctgcaaaatctgctttactgtcaatcaatttgtaatcggttttacctgctactaaattttcccaagtctccttaccgccgacaaaacggaagtctttttcagatttaggctgaatcgctttaccattttgatcgaaataagggtggccggcacccataatgacggatgctcgtccggatttaaccgcttcttgagcgatctctgcgtaattattgcggtttacattatgcgataagaatcctgccggtgtcgcgtgactccattgtaccgagctgattaccccaagagaacgacctgattccaccacgtattcgccaatattttttatatgagtatcattgttcgaccagttaatcgcattattataagttttttgtccgctagcgagcgcagttgctgcggcagcactatcggtaaaatcggtttgggcatattcatacccactgaaatagctggtgtagttagtgagattacctttgtgctgataagcggatttatctttattccaaaggcttttcggatcgaatttaaccgagtttttaagtgaatgggtaggcttggttgatgtgttaagcggataggttgaagcaaataattttacgtcaaatttatcgtaaacttctttacctaatgctccatggcggaaatagcttgccgctttccaagtattaataccggcaccgtcactgatcaataaaatcacattctttgcagatttaggttgtgcttgttccgcttgtgcgattgcactttgctggaaagtacttgctgcaataaaaataaaagcgatttttgatagcttcataaaaaaactccttaaggttgctatataactcggcgtgaagtttactgaggaaatatgacagtttgatgacaatttgagaacaaggaggcagatacagatcttggccaacctattgctttttaaaaagaaaaatcagacaattttgcccaataaaagcagaatgatgttagagaaaagaactttgagagtatttttagcggaaaaaccaagtttagcaagggcaatcgcagacgtcttgcctaagccgcatacccgtggtgatggttatattcaatgtggtgaacatgatgtggtaacttggtgtatcggccatttgttagaacaagctgagccggacgcttatgatgagcgttttaaaatgtggcgtatggaacatttgccgattattccgcaacaatggaaattagtgcccaaaaaagaaacattgaagcagctacaagcggtcgaaaaattggtaaaaaaagcagatgtattggtaaacgccggcgacccggacagagaagggcagctgctcgttgatgaagtgttcagctatctaaatgtaccggcggaaaaacgtgaccagattcaacgttgtttagtcagtgatctcaacccgagtgcagtaaaaaaagcaattgataaattgcaaaataatcgtgattttataccgcttgcaacttcagcattagcacgtgcaagggcggattggctatacggcattaatatgacgcgtgcttatactttacaagggcgttgggcaggctatcagggcgtattatcggtcgggcgggtacaaactccagtattgggtttgattgtgcgccgagatttggaaattgaacattttgtaccgaaagactattttgaagtattagcccatatcgttgtaccggaaacccaaggacgttttaccgcacaatggcaaccgagtaaggcttgcgaagattatcaagatgaagacggtcgtgtgttatccaaaagtttggcggaaaatgtggttaaacgcattaccgaccaagctgcattggtaacggactatcaggataaaattgaaaccgaaacggcgccactgccttactcattatcggtgttacaaattgatgcagcacgtcgttacggtttatcggcacaggtagtgctggatatttgtcagaagctatacgaaacacataagttgattacttatccccgttcggataaccgttatttaccgaatgagcattatgccgaccgttttaaggtaatggcggcaatcgctcatcacttagatgaatataaagaaaagcctgaagtggttaatccggaaatccgtaaccgttgttggaatgataaaaaggttgacgcgcaccatgccattattccgaccgctcgccaaggctcggtacaactaactgaaaacgaaaaacgtatttatcaattgattgcccgtcaatacttaatgcaattttgtccggatgcagaatatcgaaaaggtaaaattgtattggatatcgctggtggaacatttaatgcgcaagcccgaaacttaattgttgccggttggaaatcattactaggcaaagaagacagtgatgaagtactagagccgttgttaccagttgtgaaaaaagggcagcagttacattgtgaaaagggcgagattgtcagtaagaaaactcagccgcctcgtcattttaccgatgcaagtttattatcggcgatgaccggtattgcgcgttttgtgcaagataaacagcttaaaaaggtattacgtgaaacggacggtttagggacggaagctacccgtgctgggatcatcgaattactgttcaaacgaggatttttagtcaaaaaaggacgtaatatccatagcacggaagcaggtcgaattttaattagtgcgttgccggatgaagcaactcagccggatatgacagcacattgggaaatgcaattgaccgacatcagtaaaaagcaagcgagttatcagcaatttatggcaacgttaaccggcaagcttcctgaattgttacatacggaaagacagaaattgcaaaatttgagtcgaatccaaccgcctgcctcttatcgtaagcggtcaaattttaagaaaaatttacaaactgctgaaaaataaggcaaatgtatagttggaataaaaaaatcacttgcaagcggcaggctaaatctatattatgctcgccatcgcaagttgattttaattttaaaatctgaaatttatcgcggaaaaaatagagagtttaaatgttaaacgtactaacaattatttatctcgttgttgcaattgcattaattggttttattttaatgcagcaaggtaaaggcgctgatgccggtgcttcttttggagcaggcgctgccggaactgttttcggttcagcaggttcagcaaacttcttatcaagaacgacagcgattttagcagttatcttttttggtattagcttacttattggtaatttgaattcacaccaagtagcaccaaaaagtcaattcgaagatttaagcggtgtgcaacaaaaggttgaacagcctgcaaaagtagaaacccaaaataacgatattcctcaatagttttgggaacagaattaaagctctggtggtggaattggtagacacgctatcttgagggggtagtgtccataggatgtgcgagttcgagtctcgcccagagcaccaaaattagaaacctaatcgaaagattaggtttttttatgccctaaaaaatagcctgcttatcacaggctatttttgtatataggtatatcacaattttctaaatcggttgattatcttctacttcctcaactaatttctcacctttgcgagtaagtgcaaataaaatgctcaataaacctaaagtaaatgcagcccagccgaaaataatggaattccatccttccgccacatagctaattgccgcacagcccatcgttaataaagtcgttataaatgttcgcattacagctccgatacatttgttatttttataaatagttaaataagacctgaggagtatgagttactccacaaaagactcagtattaaattatgatcgtttaataactgatcagaccccttaaaagggcgcgccattataacgattttttgagaatacacaattaaaagtatacaaaagtagcaaatataatcagatttatcttctctctttgcgagagaatgtacgataaaggtaaggaatgacctgttctaaacaagaaaattcttatataatatcaagttcactatgttaggaaaattaaaggattgagaatgaagaaaaaagcaatacaggcagtgggtttcggacttttttgtgcgtttttaattctctatatcgctcctttagtcaataataagattcatgctgtagggcaatcgaatattgctatcgccagttatcatgatgcggtgaaattggcttctccagcggtagtaaatgtttacaaccgttctccaagccaaaatggggatacttttgaagttaaaaatcttgggtctggtgtaattatgactgccgatggttatattttgacgaacaagcatgttattcaaaatgcggcgcagatcattgttgcactacaaaccggtaagatttcagatgcgattttggtcggagacgatacgctcaccgatttggcagtgctgaagattaaagcggaaaatttaccgacaattcctcagaatgacgaacgtccaattcgtatcggagatgtcgtatttgcgatcggtaacccatttaacttaggacaaagtattacacaagggattattagtgcgacaggccgtaatgctttaacggacggaggtcgtcagaattttattcaaaccgatgcttcgattaaccgaggtaattcgggaggggcattgataaactcagcaggggaattagtcggaattaatacgttaagcctaggtaaaaccagtgatgaattggcagaagggttgaactttgctattccaattaatttagctaagcaaattatggataaaattatcaaagacggtcgagtgattcgaggttactttggggtaaatagctcactctattccacggctagtcaggaaaaaactaaaggggtattaattaccggtgttgcggaaaacggtccggcggcacaagctgggatcgaagaaaatgaccgtatcttgaaagtggggaatgttgacgctgaatcaccaactcagatgatggatttactggcaaatatgaagccgggtacgcaagttaaagtacaaattttacgtaacggacaggttatggaagtgaatgtaattatcggtgaattcccagaattataatgcttttgtcactttaggtaggaacgaagaatgagcaattttattattactgttgatggccctagtggtgctggcaaaggcacattatgtcatgcattagcggaaaaattagggtttgattttttagattcaggcgcaatttatcgaattaccgcattagcggcattaaaagcgggtgtcgcattagatgacgaagagcgtattgctgaagtaggtcgtcaccttaatgtgaaatttattcctgaaaatggcgagataaaagttatattagacggtgagaatgtcggtgatcaaattcgtactgctgaagctggacaaaatgcttcaaaagtagcggttttccctaaagtacgagatgcattattacaacgtcagcgtgatttcagttctccgaacggtttaattgcagatggacgagatatggggacagtcgtattccctgaagcccaagtaaagttatttctcgatgccagcgccgaagaacgcacaaaaagacgtgtaaaacagttgcaagaaaagggatttaatgctaactttgacgagattttagccgagattaaagagcgagactttcgcgatagaaatcgcgctgttgcgcctttggttccagctaaagatgcgttattgttagactcgacaaatctgtcgattgaagaggtaattgctcaagcattagagcatattgccaaattcagaacaatttaatgtttattttgctgaacataggatgtgtttggtgattattactaaccccgtttaacaggatgttggatggatgttcatttttatttaagaagaaaattatgtcagaaaattttgctcaactacttgaagaattcctagcaacagaagctcgtttaggttctgtagttaaaggtactgtagtagctattcaaaaaggctatgtaatcgttgatacaggtttcaaatctgaatcatcaatcccagctgaagaattcacaaacgcacaaggcgaacttgaagttcaagttggcgaccaagtagatgtggttcttaaagcagttgaagatggcttcggtgaaacagtagtttctcgtggtgatgcaaaacgtaacgaagcttggattgctttagagaaagcattcgaagaacaagctacagttatcggttttgttaacggtaaagtgaaaggcggtttcactgttgaattaaacggtgttcgtgcattcttaccaggttcattagttgatactcgtccagttcgtgattctttaaacttagaaggtaaagaattagaattcaaagtaatcaaacttgaccaaaaacgtaacaacgtagttgtttctcgtcgtgctgtaatcgaatcagaaagcaaccaagatcgtgatgaagtattagcgaacttagttgaaggttctgtagttaaaggtacagttaaaaacttaactgactacggtgcattcgttgatttaggtggcgttgacggtttattacacatcactgatatggcttggaaacgtgttaaacacccaagcgaagttgttaacgtaggtgatgaagtaactgttaaagtattaaaatttgacaaagatcgtactcgtgtatcattaggcttaaaacaattaggtcaagatccatgggctgcaatcgctcaaaaccacccagtaaacagcaaattaactggtaaagtaactaacttaacagactacggctgcttcgttgaaattttagacggtgttgaaggtttagttcacgtttcagaaatggattggacaaacaaaaacatccacccatctaaagttgttagcgtaggtgatgtagttgaagtaatggtacttgaagttgatgaagaacgtcgtcgtatctcattaggtttaaaacaatgtaaagcaaacccttgggaacacttcgcagcaactcacaacaaaaacgataaagtgacaggtaaaatcaaatctatcactgatttcggtatcttcatcggtcttgaaggtggtatcgacggtttagttcacttatctgacatttcttggaatgtttcaggtgaagaggctgttcgtaactacaaaaaaggtgacgaagtagaagcagttgtattacaagttgatgcagtgaaagagcgtatttctttaggtatcaaacaattagaatcagatccgttcacaaacttcgtagacagcactaaaaaaggtgctatcgtgactggtaaagttgtagaagttgatgctaaaggtgttaaagttgagttagaaggtggcgtggaagcgttcatccgtgctaacgaagcaactcgtgatcgcgttgaagatatcactacagtaatttctgctggtgattcaatcgaagcgaaatacactggcgttgatcgtaaatctcgcgttgttaacttatctgttcgtgcgaaagatgaagctgaagaatcagcagcaatcgctcaagtgaacaaacaacaagaagttgagatgccaaacgcaatggcagcagctttccaagcagctaaaggcgaataattagcgtctttctaattgaaagcggatatgtgaaagcatatccgctttgatttaaataatcaggagaaactatgactaaatcagaacttattgacaatttagtatcacttaatccgacattacaagtaaaatctgtagaagatggcgtaaaagagcttttagagcaaattatgttgtctttagaacagggtgaacgagttgaagtaagaggatttggtagtttttctttacattatcgccagcctcgtctaggtcgtaatcctaaaacaggtgagagtgttaaattagatgcgaaatacgtccctcattttaaagcgggaaaagatttaaaagagcgtgttgatttagcataaatagttgtatcataactatttgttttacctatctaaatagaggaaagagacgatgaaatatattttaggtattttaattaccttagcggtaattatggttgcggtgaccattggtgcaaataacgatcaattgatcactttcaattatgtccttgctcagagcgaattacgtttatctagcctcgttgccattttatttggttttggcttaattttaggttggttaattacgggtgtattttatttacgtcttaaattacaaaatattgcactcaatcgccgagtgaaaagacaggcgcagcaaattacagaattaacgaccactacgccaaaggctgagtaatgcttgaactactgttccttttattgccaattgccgctctttatgggtggtatatgggacaacgaagtgcaaaaagggatcaagaatctgtcaataataaattttcccgtgattatgttacggggttaaattttcttttatctaatcagcaggaaaaggcagttgatctttttctgtctatgctccaaaaacaagaatctgaaaatcagatcactaccgaatctcaatttgaagctgaacttacactcgggaatttatttcgttcccgtggtgaggttgatcgtgctttacgtattcaccaagcgcttgatgcgagtccacattattccatagaacaaaaattacttgctaaacagcaattggcaaaagactttatggctgccggtttttatgatcgtgctgaaaattactatattttattacttgatgagcctgagtttgctgttaattcgttaacacaattaatggtaatttatcagaaaactaaagaatggaagaaggcgatcaatgtttccgaaaagctgttaaaaattgagccggatacagataaagtaccattagcacattattattgtgaatatgctcaaacaataaaaacggaaaatgttgaagaacatttaaatgctttgaagaaagccttggaatattctccactttgtgcgagagcgtcgattttattaggcgattattatttagaacaataccaatttaaacaagctttagtgcattttgaacatttggtggtacaagacccgagttatatcagtgaagtgttaaataaaattaaggcttgttatattgcgcttaatgatttagttaattatgagttattccttattcgagctaatcagataaagcataacagtagtgtagatattgcgttaactgaatttattgaacaaaaagatggcatcacagcggcacattcaaagctttatcagcaattgagtcagtatcctaatatgttgacctttcatcgttttatccattatcagattaatgaagcggaggacggaagagcaaaagacagtttggtacttttacataacatggttggcgatcgtattaaaaaaggcttccaatatcgctgcttaaactgtggttaccaaagttatcgtctaagttggtattgtccttcttgtcgccaatgggaacaaattaaaccgattcacagtattgatacataaacacgcaagtatatttataaactgaaaattgaggagtccgatatggataataaaattattgttgccttagattatgaaacggaacatgaagccttaagctttgtggatcaagtcgatccgtctctttgccgtttaaaagtgggcaaagaaatgtttaccaccttaggaacaaattttgttaaacaattacatgaacgtaaatttgatgttttcctcgatttaaaatatcacgacattccgaatactgttgcacgtgcggttcgttctgctgccgatttaggtgtttggatggtcgatttgcacgcttcaggtggtttaaccatgatggaagaagcgaaaaaaatcttagagccgtatggtaaagatgcgccgttattaattgcagtaacagtattaaccagtatggaagatttagacttgttacaaattggaatcaacgcttcaccgatggaacaagttattcgtttagcgcatcttgcacaacgtgccggtttagacggtgtggtttgttctccacaagaagtagaagtgcttcgtacgcattgtggtaaagactttaaattagtcacaccgggtattcgcccggaaggttcggatttcggtgatcagcgtcgtgtaatgacaccaaaacaagcaattgatactggttcagactatttagtgattggtcgaccgattacccaagctcaagacccattagcggtattaaaatcaattaatgcttctattcgttaattgatgattgattgtctaaggtgggctgtacgtccaccttttttattttaagcggtcaaatttttaggattttttactgatgacattagtatattcaacagagagtgggcgtattgtgcctgagaaagtaaaagcggagcgtcccaaaggtgacggaattgtgcgcattcagcgtcaaaccagcggcagaaaaggtaagggcgtgtgtgtgatcagcggattggatttggatgatgttgaactcaaattattagcggcagaactgaaaaaacgcagtggtgttggcggctcagtaaaagatggattgattgagattcaaggtgataaccgagacttactgaaacaaatcttggaacaaaaaggctttaaagtaaaacttgccggtggttaagcatcattatacaagcggttaaatttggctaaatttttgcaaaaaattagtgaaatttaaccgcttgtttcttagaaaagctagattttttctctttcccaaatggttttctttgcgaaaaccaatttattcccagtatgtttaatcatatcaaagcgaatttcccatacatcactcggttttaagcgggcgattggatggcgagtataatagcaatctaaagcctcctggcgagctgctgaatcaattaaactgttgcaatgcgctgagaattgaacgccttcaatgtcggtaagcgtttcaacttgagcggcaattgtgcctacaacatgtgagtttttttgcatcaacagaccgtggcgagtgtttttatcagtaagaatgattaagcgaacttgttcgctatcgaaagcataaaaacagtttgccgcccaaaagtcattttcgccatagacagcaaaactcacgacatgattttgctggataaaacggctgatatgggagggaagattctgcatcatatattcttttttagaatatcccgccagaatagtgggatattgcgtctattaagctacaaacatttgccaaaaataagagaaaggcatcactaaaatcagtgccggcagcatattggcaacggcaaaatgtttgataccgcagatacgtaagccggttgcgagcataatgaaaccgccagcagttgagaagtcggcgagcatattgggtgtagtgagtggcataatcaagctggctaataatgctaagctgacttgcacgagaatcaatggcacggcaatgcttgaaaccgcataacccaaagtggcggcaaaaatgccggcagtgaagaaatctaaaattgctttaataaacaatacggatgggtctccggtcatgccttctttcattgagccgaatacacccataccgctggcacaaaatagaatgagaattgccacaaattgatttaagaattcttggtgtgaaacaccagatggtgggaaaattttatccaccgcacctcgcatttttccggctaagctaccgatacctttttctaaataaattaactcaccgataattgtgccgacaatgagtgccaataccaccgcagacatatttttagcgccgataatcaacataatgcccaagcccattgagcaaagaccaaacagtggaggtaaattactttttactcgctcgggtaattttgagcctaaaaatgcaccgataagcccaccgactaatacggcggcaccattgacataagggcctacaagcatgtttactccttattgtttgcttcgccccagcgaggcatagggaaatcgaaatcaaatagatccaacgccttagaaacactgtgtgtcaccagctcatctatggtagttgggttttgatagaaagcgggtaccggcgggaaaatgatgccgcccatttctgtgacacgacgcatattatcaatatgagctaagttgaatggcgtttctcgtaccattagcactaattttctacgttctttaagcactacatccgctgctcgagttaaaagattatcgctaaagccaagagcaatcgctgaaagtgtacgaatagagcatggagcgaccagcatcccgagggttttaaaagatccgctggcaatgctcgcaccgacattatgaattgaatgtacttgtgaagctaaatccaacagctgttctcgctcaatatttgtttctaatgagcgagtcatttctgctcctttagtgaggactaaatgggtttccacatcaagcgatttaagtaattcaagtgctttatagccgtattgaaagccgcttgcaccactaataccaataataattcgttgtttcataagtaactaaaaaagcggtcgaattttgcaaaaaaattgcaaattttgaccgcttataagattagcgtaaggttgctaccaacatggttaacataaagcttaccacagctaagataaagtttttaagcgagaatggttgtgattttttaaatgctttcgcactgaatacgatataaagcactaaaaacgcaatcttagggataagccattgcatttcatttagagcatagataccgtttgaaagtaaaatcacgagtagaatgatacctgaaacaagtaatagcgtatcaatcaggtgtggagcaatacgtaaaattttatattgacgccagtccaccatttttgacgcgagtacgccacgtgttagtaacaagatcaagctgatataggcaaagcctacatggactaacactaattgaggaaaaaattccataatcactcctaattaaataaaaaacaagcggtcaaaattgccaattattctgcaatttcagtttttaaatattggaaaatctctcgatagtttttagccggtttattcgcctcacgttctttttgtgcaccacgaatcaagttgcgtaaatgctggcgatctaattgcgggtactcgttcagtaaatgatttaaagacgcatcgcccatattgactagttgatcacgcactaattccagcttgtgtagtaacgcttgctgttggttatggcgatttttcactttatccaatgcgtcttggatcggctccggatcacgattacgcaataatttaccgataaactgaatttgacggcggcgagcttcaagtttaaaaccttgtgcttgacgaatggcttcttttaaatcttcatcaagagggatcttttcgaggttttgcggggttaattcaattaattccgctccgagtttttttagatgttccgagtctcgtttgatttcgcttttacttacccagatgatttcttcttcctcatccgtccaatcaatttcatttttgctacgttttttagccattgttattccttcaatcgtaaaaaataccatattctaacagaaatttaaggtagaatatatgcatcgtactcagccatttttaattatcaattttaagctaacaaatcatgtcattaacaacaaaacaagatctccaaaaacaagagcaagaacttcgtcaagcggttgaatttgcccttaattttgcaaaaaattcaggggcagaagcggaagtcggagtaacaaaagttgccggactttcggcttcaacccgtttagaacaaacagagaatatcgaatttaacaatgacggttcgctcggcatttcggtatatgtcgggaaacgtaagggcaatgcgtcaacctcggatttacaaccacagtctattcaacgtgcggtcgaatctgcattagcaattgccaagtatacttcagaagatgagtgtgcaggtttagctgataaagagatgatggcatttgatgcaccggatttagagctttatcaccaagcggatatttcagttgaacaagcggttgaactagctttagaagcggagcatcatgcactaaatgcagacgagaaaattgtgaatagcgaaggagcaacttttaattcgcatagtggtgtacgtgtgtatggtaacacgcacggtatgttacaaagttatctttcaagtcgctattcgctttcttgtagtgtaatttctgcctatgaagatcagttggaacgtgattatgaatacacgatttcacgtgagttcgacaaattacaatcgccggaatgggttggtcgtcaagcagcgtttaaagcggttgatcgcttaaatccgcaaaagatcaaaacctgtgaagtgccggtaattttttacaacgatgtagcaaccggtttaatcgggcatttagccggtgcaattagtggcggtgccttatatcgtaaatcaagtttcttattagataagttaggtacacaaattttaccaagttggtttgcaatttctgaacgcccacatttattacgccaattagcttcatccgctttcgacagtgaaggggttattacccaagatagagaaattattactgatggtgtattgcaaacttatctgatgaccagctattcggcacgtaagatgggcttaaaaacgactggacacgcaggcggtatccataactggttagtcaaaccaaatcgaacaggcggtttagactcgcttctaaaagagatgggaaccggtttattggtgactgaatttttaggatcagcgattaatgcggtaaccggcgagtattcacgcggagcagcaggtttttgggttgaaaacggcgagattcagtatccggtagcggaaattaccattgccggtcagttacaagaaatgtataaaaatttagtcgcagttgctgatgatattgagcatcgctctaatattcaaaccggttcgattttattagataagatgaaaatttccggcgaataaaaaatttacactatttgagaataattcttattgacattaacgagtctattacctacaatagaccctgttacattttagggtaatgtaacactgctaaataactttatcgtcatctgaagttataaagcaattagggtaaaagtaaattcgttaggtcaaaatagctagtccgtaagggctagctatttttttatgttaaattttgcaaaaattttgacaaatttgaccgcttgtattacaagcaaaagaaaaggcgaacttttgttcgccttgtaaaaaattataaacagttcttatcgccacgagaaagactaataacgcctgagcgtacaatttcaactacggtcgtttcttgttttaccgcttcaataaaggcattcagcttttcactggtaccggataactgaatggtgtagagcttcggcgtaatatctacgatttgccctcggaagatatccgccatacgttttaattcatcacgagctgaacctgttgctctcactttcaacaataacacttcacgttcaatgtgttcggtaggacttaaatttgataccttgaatacatcaatcagtttatgtaattgtttttcgatctgctcaagcacgttttcgtctccttgagcaacaatcgtcatacgagaaagtgtttcatcgtcagtcggtgcaacggttaaactttcgatattaaacccacgttgagaaaaaagacctaccacacgggataatgcacccgattcgttttcgagtaatactgataatgttctacgcatctgttctctccgttttgcttaaaatcatctcattcattgcaccgccacgaatttgcattgggtaaacgtgttcggtttcatctacttttacatcgacaaacactaatttgtctttgatggcaaaagcttgggtgagtttttcttccaattcgctagggtgatcaatcgtaataccgatatgaccgtaagcttcagctaattttgcgaaatcaggtaatgaattcatataaacttgcgaatgtcgacctgaataaatcaagtcttgccactgttttaccatacctaagaagcggttatttaaactcacaatcacaaccggtgtgccatattgttttgcggttgaaagttcttggatattcatttggattgaaccgtcaccggtgacacataccacggtggcttccggatgggcaaattttacaccgattgcagccggtaagccgaatcccattgtgccggcaccacctgaattaatccaacggcgaggttgttcaaacgggtagtgaagagcggcaaacatttggtgttgaccaacatctgaagcaacataggcatcacctttggtgatttgatgaattaatcggatcacttgttgcggcttgattacatcattactttcttcaaagtttaaacattggcgtgctttccattcattaatttgttgccaccaagcggtcaaatctgcctgattttttgcaagattttcttcttccaacaagctgaggaattcttctaatacatttttcgcactacctacgatcggaatataagctggtacggtttttgaaatagaagccggatcgatatcaacgtgaatgacttttgcattcgggcaatattttgccagattattcgtagtacggtcatcaaaacgcacaccgataccaagaattaaatcactctcgtgcatcgcattattcgcttcataagtaccgtgcataccgagcattcctaagaattgtttattcgaagctgggaaagcgcctaatcccattaatgaactggtaaccggcaagtttaatttagtggcaaaatcggtcagttgtggcgcacattccgccgaaattatcccgccaccgatatataacactggttttttcgccactaataacgcttttaatgcttttttaatttggcctttatgaccttgtacggtcgggttatatgagcgtaatgaaacctctttcggatattcataggtaaatttatttgccggattaaccatatcttttggaatatcaattaataccgggcccgggcgaccggttgacgcaatataaaaggcttttttgatagtcgacgggatatcttccggatttttgatcataaagctatgcttcaccacagggcgtgaaatgcctagcatatcgcattcttggaacgcatcactaccgattaaaccggaaggtacctgaccggttaagatcacaagcggtacagagtctgcataagcggtggcaataccggtaatcgcattggttgctccggggccggaagtgactaacacacagccgactttaccggttgaacgggcatagccgtcagccatgtgtaccgcagcttgctcatggcggacgagaacgtgattaatattatcaagtgtatgaatggcatcataaatatctaataccgagccgcccggatagccgaaaacgtattctacgccttcgtctttcaaggattgaacaaccatttctgctccggaaagttttttcattgaatcctccaacgattttttaagtgaaatattgtgtttgctttatatgtgaatggattttgctaaaaaataaaatatttgtctagaggtgagaaagtgttctaaaaggtgattgaccagtttaatatgctttatatttaaaatatttgggattttataaaatgaaaaggcgattttttctaaaaaaagatatttttaaccaaattttataaaatgaagagaattaaatctttttttgcgaagataagtaaaaatactcggaataggtaggaaagaaaaatagtgtgaatatgtcacactatttcaagcattttaatcaaagtaagcgttttcgagttgatccgcttgttcgggttgcttatttgcgatcatttcttccacttcggtagtaagttttgcaatcgcattgcggtaggttatttcaagcgtttcggtgctagtagcaattacaccttgatcgtttaagaaaccgtcatttacatcatatacccaaccgtgaatagacagttttttacctcggctccatgccgccgtaacaatagaactccgtcctaaattataaacttgctcggcaacatttaaacgggtcagcatattggcgcgttgttctgaagggagattaccaagcaaatagctgtgtttgaaccagagatcacggatgtgcaagagccaattgctgattaagccataatcttcaaccgttcccatcgccgctttaataccgccacaattggtatggccacaaataatgatatgttcgatatctaatacatcaaccgcatactgcacgacagaaagacaatttagatcggtatgaataactaagtttgctacatttcggtgaacaaagagttcaccggggcctaagccagttaatttttctgcgggaacacggctatcagaacatccaatccaaaggtaagtcggcttttggtgttcggcaagctgtttaaagtaatctgattgctcatctttcatcttggttgcccaggcatggttgttggcaaacagttgttcgatttgtttcatcatgttccttaatcttgttatcaaattgttagacattctagcataaagccatgcaaaataaaaaagcggttgaatttacaagattttttgcaaattcaaccgcttattattgattttgtcgctattctactaacgtaattttggccgctgatgcaccacgttcaccgttaatgagttcaaactttactttttgtccgactttgagtgaacgatagccttcactctgaatttctgaaaaatgggcaaaaatatcaccttcaaaagattcgcaagtaataaacccaaaaccttttgtattgttgaaccatttcacgatgccaatttccataataataatctcctgtcctatggcgttaataatacatcgtaaattttagtcaaaaatgtcataggagcaacgagcaatcttcaaaaattagcactagatcacaaaatttcttaaaagacagaggtttctagctttaatacgcctttttctactacgatcgctttaccaaattttttcactagcgcttctttagctttactttcatctaaggtgtaaaccggcgtgttatttagaatattagctaaaccatccattaacatcggcaggaaaatttgtaagtcgtcttggtacttttccggagtagcggaatagttcagcaatcgaacgtcttttaaatataatgcgccttgttgcggatcgtaaaagggggtcgtatccatattcaaataaattttcgcatcgtattttttacctttcgcttgcaagatgccgtcaatgatgccggaaactgcgacttttttctcatcggtttgcccgatttgggtagcaaggttgtaaaggtgatagtctaattgaaagaggccgggaataccgactttatcctttaatggaattttttcggctaaacgagtttcgagatattggttaatttcttgttggctaatgctaaatgcctgtacattactgataagcgatagcagcaataatgtaccagtgagtaaatatttaaacgcttttttcatcatacttccttctgttcaagatagcttattctagttttgttaattgaaaaagagtagaataacactcttttagtttggatcggactataacaattccgttcaatgaaggaaacaaaatgattaaaaaaattatcatttgcctctgcgcttttgctttagctagttgtgcggttggcggtagcgcaagtgttggtggcggttcaaatggtgttggtgcgggtttcagtttaggaacggggatccgcttttaatttgcaaataataagtggaatatgaccgcttattgatgtgtttatagactgtttatctataaggaattttgatgaaatatgaattaaaaaacacgagtggcaatgctcgtcgtggtcgtttgaccttttctcgcccgaaaggcgaatatgtggtggaaacaccggcatttatgccggttggtacatacggcacggtaaaagggatgacgccggaagaggtagcggcgaccggcgcacaaattttattaggcaatactttccatctatggttacgtccggggcaagaagtgatgaaatcacacggtgatttacatgactttatgcaatggcacggtccgattttaaccgactcaggcggtttccaagtgttcagcctaggtaaattacgaaaaatcaaagaagaaggtgtaactttccaaaatccgatcagtggtgagaaaattttcctttcgccggaaaaatcgatggaaatccaatacgatctcggttcggatatcgtgatgatctttgatgaatgtaccccatatccggccacttttgattacgcaaaaaactcaatggaaatgtcattacgttgggcgaaacgtagccgtgatcgttttgatgagttacaaaatccacgtgcgttatttggtatcgtacaaggcggtacttacgaagaattgcgtaagatttcagttgaaggcttggtgaatatcggctttgatggttatgcggtcggcggtttagcggtgggcgagccgaaagaggaaatgcaccgtattcttgaatttacgacaccattattaccgcaagataaacctcgttatttaatgggtgtaggtaaaccggaagacttagttgaaggtgtacgtcgtggtattgatatgttcgactgcgtaatgccgacacgtaatgcacgtaacggtcatttatttgttagcaatggtattgtgaaaatccgtaatgcgaaatacaaaaccgatacgacaccgttagatccgggatgtgattgctacacctgtaaaaactatacgaaggcttatttgtatcatttagataaatgcggtgaaattttaggtgcgcgtttaaatacgattcataacttacgctattatcaacgcttaatggcacagattcgccaagcgattgaggaagatcgctttgatgattttgtggttgaattttatgccaaaattggtaaagaagttccaccattacaatcggaagtgaataagtaatttaaatttattgcggcacaagtttaggcttgtgcctttttctcgactatttattgcatatagaggtgattatgcaacagctggaaccacaacaattcgcaagttgggcagaaccgatagatatgttgtatgcttgtcatagcaaggtgaagcgtttttgcaaacagctacaaattttacctgaatatttggcaaaaaacggggtaaatcaagcggttaaaaatgatgtacagcaaattcttaattattttaatctttccgctccgttgcatcatgaagatgaagagtgtgattttttccccgcattacttcaagtgcaaccgcaagcgcaagcagaagtggatgaactggaaagccaacatgaagtgttgcatcaaaattgggcattactttctgcgcagttagaagcgttagtcgcaggtgagcgtaatgaagtagatcctgaactcattgcacgttttatcgcaggatatgatgttcatattgcgattgaagaaccattattcgaattagggcgctcgcacttagcacaatcagaattggagaagatgggaaaagtcatggcggatcgccgaaaaacatcgccatagaagctaaatgaatctatatcaattagacttaatggtatatagctgcccattgccgctattaatggcgaaaaaagcattagcgcaattacctcagcatgccactctagtcatttctctcaatatggcgagcagtgcggatgattttgagttgctgtgtgaacaatatggatatcagtggttggattgtcagcatgacgggacaagacaagttattacgataaaaaaataagcggtctatttttgcaaaaattttaccaaaatagaccgcttgtttattttattgcttgccgctttttaagaccaaccgttattacgtctgcgacggggtagaataaatggaatcagtaggccaagtactaagccagcagccaatacagaaccgccataaataaaccactgaattacgatctcacgtttttcagaatcatgcattgtttctaagtcacgattcttatttttcaatacttccaactcacgtttaagttgtgcattttgatcaagtaattcactgctttgttgttcagattgctgactgcgacgttgcatttcaacggtacgttgttgccagtcgctgtcaattttgcctaatttggcacttaaatcttgaacttgttgctgtagctgtgggattaagtcttttggacttgctgtttgggaaatttctgaagcaagtacccagccttcacgatttttgctatcacgaataagcacaaagcgatctttacggtctaataccgttactttctcacccgcttgaatagctcctgagattttatattgatcgcctgcccctttacgcatataagtactgaggttttcagtaatataatctgctgaaaaagcaggaagagaggctccgagtaataaacaagcgagtagggtcgactttcgttttagcataatcgatgttccttttagtcagtaaaaaggaaaagcacaacgatgtacttttcccagagttaaaaaattaatagaaaatcgctaatagaatttcataaatcacaatagcgataattgcgccagcaggtaatgttattacccacgaagcaacgatattacgaataatacctaagtttaatgctgcaataccgcgagcaaagcccacacctaaaattgcaccaacaattgtctgtgtggttgaaatcggtaatccggtaccagatgcgataaccacagtagttgcacaagcaaattcagctgagaatccacggcttggtgttaagtcggtaataccggtacccattgtacccattactttgtagcccatgataagcataccagcagcaatacctgcagcacctaaaggtaagatccacggcgccaatgccgctttaccactcaccataccgccactttctacgattgataccaccgctgaaagaggacctacagcatttgcaacgtcattcgaaccatgtgcgaatgccattgaacaagcggttaataacattaagatactaaatactttttctacaccaccgaatgccgctccttgagcgcgttttgcaaatgcttcgctacggaagtagaagtaacaagcaacaacggcaaccgcagcgatagctgaagagattaacacggtttccgtagtggttaagtgtaaaccaacgtgcttcagacctttagtcatggtaacgatacttaaaataaaagcggttaacgccatatagaaaggaccgtatttttgcgcatttttcattggctcagccgtatcgaagatcaacttctgtgtactggtgaaaatccagtaagcaacgataccggcaataactggtgtaataaaccagctacctacgattccacctaattgtccccattgtacagcctcactacctacggttaagcaaccgaaaccgataattgcaccgatgattgcatgggtagtagataccggccaacccatttttgatgcgattaataaccaaaaaccggcagcaaaaagcgcagacatcatacctaatactaaaacatccggcttatcggcaaaaagtgaaacgtcaataataccgcttttaattgtttcggttacctcaccgccggcaaggtaagcaccggcaaattcaaagaccattgcaataataattgcttggcgtgcagtgatcgtacctgaacctacagacgtacccattgcattagatacgtcattggcaccgataccaaaagccataaaaaaaccaaaaagggcagtaataatgactaacgtagagccatattcttgaagtaattccattagaatctccttaatattatgctttggccagcattagctcgatacgcgatcctacacgttgagcttggtcagctaaaatgctaactcgttcaatacatttatataaaaacattacatcaatcgggttgaggtcattttcaacggttcttaatgtacggcgcaatacgatttgaagctgatcggtatcgtcttcaatttgatctagttctaaaatcatattgtttacaaattttaattcacgaccgcgaaagcctgtctctaatagctcgtctaattcagcaagtactttgcgcacttgacgagtggaatcaaggctacgagaaagaaactgcttgaaaggttcttgcatcggctcaggaatcactaattgacggccgatgatacggccagaaatatctcttgagtaatttgctactttatctaattgagtaactaactctaacaagtcggttcgttctaccggtaagaataaaccgcgaggaagtttcaaacggatttcacgttttaaagcatctgcacgacgctctaaatcaataatttgctcacgtacttcagctgccttttcccaatctttttggaaagttgctgcaaagaacggttcgagaagttcactacattcagtcacttttacagacagtttttgtagtggtttaagtggcgattgtgcgaataaacctaaaatgttattcattgccatagggatatctccattgtgattaaatttactcaattttgtacaagacaaaatcttttttattttactttatacaagctaaaagatcactggaaaatagaaaaataagcggtctaatttgtaagattttttaccaattaaaccgcttgaaatatatttattaaaatttaatcaattaaatatggtgaacaactaagcgtttgccattatgctcaaggacttccgcatctagattaaatacagtttttaaattctctggcgtaataatttcctctggtgaaccggtcataataatttcaccgtccttcattgccacaatagtatcagcataagctgccgccatattgatatcatgtacaaccattattgtagtcagttgtaattcatcagtgagtttgcgtagtaagcgcattaattctctggcatggaacatatccaaattatttaatggttcatcaagtaaaacatgctgtgtttgttggcagaatgtcatagcaattaaagctctttgacgctgacctccggagagttcgtttaaaaagcgatctttaagttgctcaagttcgaaacgttgtaacgcttctttaaccacctgtttatcctgctcacagatttttccttggtgatgcgggtaacgaccgaacattaataaatcttgtacggtgatacggctatgaataacgttatcttgtgtcaaaattgctaattgttgagcaattttgcgtgaatccgtttcagtaatattgtaatcatttagccaaatttgcccattttgaatattttgtaaacgggcaattagagaaagaagtgttgatttaccagcaccatttgcgccgataagggcagtaattccaccattaggaatatgtaaattgatattatttaaaatggtagaatttccaattttatgagaaatatttttaatatcgatcatcgttatttcttttgttttaacattaaataaatgaatactacgccgccgaaaaattcgatgactacactaagcaccccttgcatccctagcagttgttcgaaaaccgcttgtcctagcactaatgttgttgcagagatcaagaatgttagcggaatacgtacgctgtgagcgataactgggctaagcgcattaacaattgcacagaccaataagcctaaaaataggattggaccgactaatgcggttgaaacggaaaccagcaatgcgcagcatacaagcagttggcgagaaaacttatggtaattgatccctaagttgatcgctcgatctcgcccgagcagtaatacatcaagtttatgacgttgctgccaaatccataatgcggagaatatcgcaatagctacaccaatccataataatgtcggattgacattattaaaactggcaaaagatgagccttgtgcaacggcgaattcttcggggtcgatcatccgttgtaacaagttattcaagcttctaaacagcacaccaaaaatcacaccgactagaatcattcgggttagatcattatgttctttagtgagcgttttaaataataaaagtgagccgcataacatcagcatgctttcgaaagcaaatttatttgcaatatctaattgtgtaaagccaataccaccaaagataaagatcaatatggtttgagtaagcaaataaagcgaatcgaatcctagaatgctgggcgtgagaaccgggttatttgtcaatgtttggaataataatgttgatataccgatcgtataagcaatcgttaaaagcaacaaaagttttttccctctaaatggcaagataaaatcccaattgccattagcattgaacgtcataaaaaataacgtacttgcagctaagataagccctaataaaataagtaaagatgtagatttacgcatgacgcttccctctaaataataaatagaggaatacaacagtaccgcaaataccgaaaatagtggaaatcggtacttcataaggggcattaataactctgccaatgatgtcacaaactaatacaagattcgcaccaagtaatacgaccgcggggagatttttacgcaatctatcacctgctagacgagagacaatatttggtacgactaaaccgataaagggaatttgcccgatggtcacaacaacaactgccgtaataagtgcaacagtaattaaggcaagccatgtcattcggcgataattaataccaaggctagtgctaatattgtgtcctagtccggtaatactcagttgatccgccatgatatagatcacgatagagagtgcggcagtaagccataatagttcatagcgaccggctaaaactccggaaaaatcaccggaaaaccaaatagataaaagttgtaatgagtcggtttcgtaagcgataaaggtcgtaattgcttcaataatattgccgaatacaataccgattagtggcaccatgagtttttgatgagggggaagattacgtagcaacagcataaaaatgcccataccgattaatgcgcaacaagtggcaaacgacattttcgcgacaagtggagcggcaggaaaaatcagactgatagctaatacaccaagagcggcactttggcttgctccaatcatactcggttcaataaaacgattttttaaaacgatttgtaataccatgccagcaacacttaaagttgcaccgactaatataatggcaagggtacgaggaagacgactgataaaaaacagttgtgtttgttctggatcagataataaagccgaccaatgaaagtcggctacacccacagacatactcagtaaactgagaattaaaagcgaaaaaaaactaaattgagtaagtgaaaacatagattagttaaaattatcgccctcactaatgtgagggcgtggtgaacttatttagaaaatgcttttttaatattgattaaatcggtacgcatttgttcaataccaccagctgctaagtaagccgcactgcttaaataaacaatttggccatttttccaagctttagtttgatgcacaagttcgttatctaaaatttcttgcgctgttttaccttcttctccgatggctgctgtgcggtcaagaacgaatagccagtcaggattgattttctgtaaaaattcatgcgaaataggttcaccgtggcttgtgccttttttatgtacatctgctttagcaagtggaatgccaagcgctgaatgtacccaacctaagcgacctttctcaccaaaagctgacatttttccgccatttacaataataatcaagccatttcctttaccttttactgctgcttgagtttcttttaataacgcttcaatttcagttttatattcattagctttatattgtttagcaaataatttacctaagctgtccagatttgctaaaccggctgcaatggtattcaattcaggatttggagttaagtcaatagcgttcgcaatagctttcacatcgtctaattttttggcagagcgagtagcaacaatgattaaatctggttttaagctgtttaatgtttctaggttaggttcaaaaaccgtaccgatattggtagcttgtgctactgcaggttttaagtacggtaatgttttagcaacatcaggcgcgccagctacgtcgactcctaaatgttgtaaaatatcaatggttgctgcatcaaaaactgcgactttatgaggtgtttgtgtaaaggtaacttctccgcgagcggttggaattgttacatcttttgcaaatgctgaagtagttaatgcggctgcaagagttaaagtaaagaatgctttttttaacatagatccttcctgtttaaaagtatagctgtaagtgaaaattattctcaatgattttaaccgtattttcaatgatgtaaagagactttcatcaataatctgcttgaatttgattaaaaattgcaaatttcaatttaggtgaatttccgttaaactaatcatttatatcatttgtcacgtagagttttaataaaatggctgagtacactccatcaaacaaagaaagcgcaagagataaacaagtcgagcaaattgccatttcacctcattctattgaggcggaacaggcagtattaggtggtattatgctaagcaatgaccattgggataatgttgccgagcgtgtacaaccgacagatttttataactatgcgcatcggactatttttgagcaaatggtggagttggtgcgtaataatcagccgattgatatcatcaccttagaccaagccttaaaagataaaggggtattacaggacgttggtggcttcgcttatttagccgagctttctaaaaatacaccaagtgcagccaatattcttgcttatgcggatattgtgcgtgaccgttccgatttgcgtggtgtgattacggcaggtaatcaaattgctgagatggcgtatcatacgaaaggcagaaatgcaaaagaagtcttagatgaagcggaacgtatcgtatttgaaattgccgaaaaacgtaataccagcaatgaaggcccgcaaaaaattgatgacatcttaattaatacgcttactcgtattgaaatgctttcaaaaaaccgcaacaatggcggggtaacaggtgtttcaaccggtttcattgatttaaataaaaagaccgcaggtttacagccctcggatttaattatcgttgcggcacgtccgtcaatgggtaaaaccacgtttgcaatgaacttatgcgaaaatgcttcgttagtagatgtggaagatccgaatgatttggatgaatacggtaaccctcgtaagaagccggctaaaccggtattgattttcagccttgagatgccggcagaccaaattatgatgcgtatgttagcttcgctttctcgcgtagatcaaaccaagatccgaaccggacagattcatgacgatgaagattgggcgaaaatatccagcacgatggcaattttacaagagcgcaaaaatatctatatcgatgacagttccggtttaacaccaaccgagttacgttcgcgtgcaagacgagtgtaccgtgagaatggtgggttaagtatgatcatggtggattatttgcagttaatgcgtgcgccggcattttccgataaccgaacgcttgaaatcgctgagatttcccgttctctgaaggcattggcaaaggaattacaagtgccggttgtggcgctttcgcagttaaaccgaagcttggaacaacgtgccgataaacgcccggtaaactcggacttacgtgaatccggatctattgaacaagatgcggacttaattatgtttatttatcgtgatgaggtgtataacgataattccgatttaaaagggattgctgaaattattatcggtaagcaacgtaacggcccgattggacgagttcgtttaactttccaaggtcaatattcaagatttgataactatacaggcggagcctatgacgatgagtactaatctttgtgcaatttataaaagcccgaaaagagaaggaatgtttctttatgtagcaaagcgcgatcagtttgatagcatacctgaaacattacgccaaatgtttggtaagccgcaatttgtgatgctatttaatttaaatggtgaaaagcaactcaagcggtcaaaaaacgaagaagttttgcaagcgatccaaacacagggctttttcttacaaatgccaccgccaccggagaatttgttaaaaacatttattgaacaaaatagaggagaagcgtaatgcgttgtccgttttgtgctgcagaggatacaaaagttgttgattcacgtttagcagcggacggttaccaaattcgccgccgtcgtgaatgtattagctgtaaagagcgttttacgacttttgaatcggctgaattggttgtgccttatattgtgaaaaataacggcaaccgagtgccgtttgatgcgaataagttacgagtcagtctaagccgagcgttagaaaagcgtccggtaagtgcagatgatcttgaaaaagcaatcagtaaaattattattcagctgcaatcgaccggcgaacgagaagtcccgagtaaattagtggggaatctcgcaatggatgccttaaaacagttggataaggtcgcttatattcgctttgcttcggtttaccttagctttgatgatattgaagagtttacccaagaaattgaaaaactcagagagtagtaaaaatgccacaatatttgttgtggcattttttataacataaatacaagcggtcgaatttgtaaaaaattttgcaaatttaaccgcttgtttagttgggattattcgaataaaccagcgtgcagtgaacgaactacttcatccgcttcttcatttttcactagagtacatacgttatttgtgcttgcaccgtagctaattaaacggatattgaagttttcaatcgtatggaataactgtttcgccacaccggcttgggtatgcaagttgttaccgataatagcaacaagcgccagattgttttctacttgtacgtggcaataagcgtttaattcatccagtaactctttggataacatatctgcaccggatgatgcagaaccagtcttatctaaagttagtgcaacgctgacttccgatgtagtaattacatctaccgaaattttgtgttttgctaaaatagcgaatacgttagctaaaaagccttgagcgtggagcattgaaaggctagaaagcgttaataaagtttggttacgacgtaacgcaattgcacggaaagtcgggcgaggttgtggatcacgcgttacccaagtaccgccttgttccggcgctttacttgaaccgacatataccggaatgttgctacgtacagccggtaataaggtcgcaggatgtagaacttttgcaccgaatgttgccatttccgccgcttcattaaatgccatggtatcaatgcgttgtgcatttggtacgacacgaggatcggttgtgtaaatgcccggtacgtccgtccaaattaaaacatcatttgcatttagtacttctgctaatagtgctgcagagtagtctgaaccgccacgacctaatgtggttgttttaccttcatcatctcgaccgataaagccttgggtgatcattacgttacctgcagcaattaacggcttaattatttcgtcagattgttgttgggtcttctcatcatttggagcagcttttccataattactatttgtcgctacaacgtcacgcacatccacccatactgccgggaaattacgttcttttaaaagttgagtgaaaattttggtcgacatcatttcaccgtgacagattaattcatcggttaaagcgttagatgtcgcaaggctcgcggattcggctaatgcgctgatatgctgtaataattcgtcaatctcagcagaaatttcgctttgactttgtagtttttcaataatgttatattgaattgtacgcactgcatttaaaatttcgtcacggcgttctttttcgcaaccgtttgccaattctactaaataattagttacgccagctgatgcagaaagtaccacaacacgtgtattagcgtccgctgttacgatgtttgcacaagaagtcattgcttcaaaattagctacgctagtgccaccaaatttagcaaccgaaagatgagacataataagaatttcctataaatcaaaaaataatagatgacgttgtgtagtggatattcgaaaggaaatttgagtagattaggcggtttgatttaggaaccaattaatcagagcactccatttaaacttgtgttaaatgacagctgataggattcaacctgactcagccgatgttcattccagtctagtgaattcacacctcggcaagcactcccatcatttaatcctcaaacggccctagttgccttgaattaaactgcctgagtgttgcgcctctcccgcaatgaataaattcattacttcttttcaagagctgaaaagcttgtatagaaatacccttttattagaggggtgtcaaacgatatttattcttaatggaaagaatgcttaaggaatgggctaatttgaggataaatttagataaaaataaaagaggtcagatctttaaacttaatttgtaaaaaattaagtggatctgaccgctttcagggagattaattatttctcgtcttttaccggagcggcacttttatgtgcagccattttttgacgaatttcacggcgttgttttgatagttccgcattgcggatcatgtaatcatcaacacggttttcatagtcgtcacgcatattagcgataattgctcggatctcttcaacggtcattgaatcattgatgtattgatttaaattatctaataacaatacacgtttttggttatcacggattttacgatcattatccgcagtttcacgatgtaatttattttttaaacgataaagatgaacataatccaacatatcttggaacgcttgtttttttacatcagccatttgagaaccctcttggttagtgaaaataaatctgtataaatcctagaccttttaaacaaattcgtcaaaatgtttctcaagggtttgtttatttgcataaataaacatcaaaatttttaaaataatgaagaatttgtcgatagatttgtattaaaagtgataatatcttgatatttattcgctcggtttataaggatattttatgtcatcttcaatgcaatcgccagtaaaacagtctgcgcctagagaatttgccgctattgatttgggctcgaacagctttcatatgattgttgcgcgcattgtaaatggctcgatccaaatactttctcgtttgaaacgtcgagtacgcttggcggacggtttagatgaacaccgaatcttgagccaagaggctattacgagaggcgtggaatgtttagcgttatttgccgaccgtttacaaggtttttcggcggaaaatgtgaaagtggtcggaacttatactttgcgtcgagcgatcaataacgatgagtttttaaaacaagcagcgcaagtgtttccttacccgattcaaattatttccggacaagaagaagctcgtttgatctattccggtgtgagccatactcagccggaaaaaggtcgaaaactagtggttgatattggcggcggctcaacggaaatgacgatcggtgatgatttcacgccattaagagcagagagccgtcatatgggctgtgtgagctttgcaaatcgtttcttccctcgtggtgaactgacgattgagcgatttgataatgcttaccaaacggcaatggaaaaaattgaggatcttgcttgggaataccgtcagttaggttggcaaaatgtattgggatcttcgggaacgattaaaaccgtgcaaaaagtgttgattgccaacgggtatcgagacgggttgattacggaagaacgtttacagaatttaattgatatttgcttgcaatttaattccttaaacgagattcagttaaaaggtttaattgaagagcgagcggatgtgctgatccctggcttggcgattttattagcgctatttcatacctttagaattgaatcgatgcgttattcaaacggggcgattcgtgaaggtgttatgtatggcttagaaaagagcttccaagtcggggatattcgccaaagaacggcagaagcactagcagagcaatttaatattgatcagcaacaagccaatagagtggaaaacacagcactgatgctatttgaacaggtgaaaatttggcgcaatcgccgccaaatccctgagctacgtagtatgttaaagtgggcgagcttactacatgagatcggtattgtgattaatcacaatagtgtgcatcgccattccgcttacattattgcgcatagcgatttgccgggttttgattccgagcaacagaatttattggcgatgctgatgcgttttcatttgaagagcttcaaacggagtgaaattcgcagtactaaccgttatcagcatcgcgatattatgacattattgcgtttatttcgtttagcggtattgctaaatcgtcctcgacaagcgacggttgagccgaaatcggtaaaattaaccgtaacaaataatgaatggttattgcagtttgaatccggctttttaagacaaaatccattgattttggcggaactggaagaagagcaaaaatgtttggttcagcttgatttaacattaaaaatggaataagtagcattgtgaaggcacagcctaattggtctgtgccttcagctttataaaatttgatctagttctcattttcttattttcccgcttgttatttagcggataaatctttacgctatacatactggagtatatcttcatttatggagtggctgttgaaccaaaacagcattgataaatttattattgtaagggagcgatatgttattaggtgatttatctcgagcggactacgctaaatcattaccgcccgtatttgtgcgtttatgcgaaaaattgaagacattggatttggttaatcttccgttaggttggcaagatcttgaagagggcgttcgcatgaacgtgatggaatttgaaaccagtccggctgaagaaaagaaagcggaaatgcatcgcaaatttatcgatattcaattattaatttcaggcgaagaaatgattgagtatggcttaggcgagcctaatttagcgaaattcgatgagtatcgtgaagaagacgattatcagttaacggatgcgattgagcataaaaatgagctggtattacagccaaatatgtttgctatctttttaccttatgaaccgcataaaccgggcaatgcagtaaacggtcaaaataaattattgaaaaaattagttgttaaagtccctgtcagttatttgtaggaggcagttatgtctgctcgaggaaaaatattagatactatcggcgcattacaaaccagtttaaccaaaacagagaagaaaattgcctcggcgattttggctcaaccggagatcctcagtcagaactcattatctgaagtagcgaaacaacttgatgtcggtgaagcgacatttatccgattttgtcgtactttaggttttaaaggctataccgattttaaattggatttagcgattgaattggcgacccaagaaaagcaaagtaactcaatttttgatacggatgtgtcggaaaccgatacaccgaaagaaattgcaattaaattacaaagcagtttgaataacgtgattgctgaaacaatcaatttgctcgattttcaagaattagaaaatgtggtgaaagaattgcaaaaagcgcagcgtattttcttattcggtgtaggttcttcggggttaaccgcagaagacgcaaaacataaattgatgcgtatcggcttacagaccgatgcggtaaccaataaccactttatgtatatgcaagcgtcattattgcgtgaaggcgatgtggtgatcgggatcagccattcaggttattcagatgaggtaattagctcgttgcgtattgcacgtaaaaataatgcgaagaccgtggcgattactcaccatattcgttcacccgtcaccaatgttgctgattatgtattgattaacggcaatcgccaaggacatatgcagggcgattctatcggcactaaaatgtcacaattgttcgtgttagatcttatttacgctttattagttaaagcggagccggaaaaatcaattcaacaaaaacaaaaaacgttggatgtgattttagaacaacgtgttcacggccgataatttttgttttacaagcggttaaatttgcagaattttttacaaatttaaccgctttatttttttatctaaaaaagtgctttcaaaatgacgaatgttttcgctagaatgatcgaatccgttttaaagaaacataagaggcaaacacaatgacacaagtttataatttcagtgcaggtccggcaatgatgccaaaaaccgttttagaacaagcgcaacaagaactattaaattggcaaaaccaaggtacttcggtgatggaagttagccatcgcggtaagttctttatggaattagcggcccagtctgaacaagattttcgtgaggtttaccatattccggaaaactacaaaatcttgtttttgcaaggcggtgctcgtggacaatttgctgcagtaccaatgaacttaattggtgcaaagggtaaagctctttatttaaatagcggtcattggtcggggatggcggcaaaagaagcgcgtaatttctgtgaaatcgatgaaattaatatcgttgaaaaagatcaaaatggcgtgattgcggtaacccgtaccgattttagtgatattgccgaacagtatgattatgttcattattgcacaaatgaaacgataaccggtgtgcaaattaaacagatcccaaatgtgggcaatgcggtattggtcgcagatatgtcgtctgatattctttcgactcaaattgatatcagcaaattcggcttaatttacgcaggtgcgcaaaaaaatctagggccggcaggtattacgattgtgattgtgcgtgaagatttgattggtaaagctcgcacggcaaccccttcgatttggaactatgaaacacaagtgaatgctgattcgatgatcaacacaccacctacattcgcttggtatttatgttcattggtatttaagcatttaatcaaagagggcggtttggcggcggttgaaaaacgtaatacagcgaaagcggaattactttataattacttgaataacagcacgttctatcgcaattatattgcggaagcaaatcgttcggtaatgaatgtgacatttaccactgatgatgatgagttaaatgcaaaatttgtagcagaagcgaccgcttgtgggctacacgccttaaaaggacacaaagtattaggcggtatgcgtgcgtcaatttataatgcaatgccgattgaaggtgtagaagcattaatccaatttatggataaatttgcacaagaaaatgcataatctttaaaaattactgaggctatccggtgggatagccttttttatatggatatgattttacgccagctagttgaataattaatcgtgtattaatatcttgccagttgtaacgtattttttactggtaaagattaaaattctttaatacaatccatcaataacgaataaaaagaattttacagaggtaaaaatgcaatttatcaacatcgccaatcagggcgtgaaatccctttctccttaccaagcgggtaaaccgattgaagaattagaacgtgagcttggtatcagcaatattattaaactggcttctaatgaaaatccgttcggtttccctgaaagtgcaaaacaagcgattattaatcaattaaatgatctcactcgttatccggatgcaaacggctttgaattaaaagcagctatttcaaaaaaatttggcgtacaagcgaatcaaattaccttaggtaacggttcaaatgatttattggaattatttgcccatacctttgccggcgaacaagatgaaattatttattctcaatacgcattcatcgtttatccgttagtgactaaagcggttaatgcggtggcacgtgaaattccggcgaaaaactgggggcatgatctagatgcgtttcttgctgcaatcaatgaaaaaacaaaactaatttttattgccaatccgaataatccgaccggcaatttcttaaccgaagcggaaattgatgctttcttagcgaaagtaccggcaaatgtgttggtagttctcgatgaagcctatactgaatttacagacgcttgcgagcgtgtcgattcattcggcttattggcaaaatatccgaatttaattgtgtctcgctcactttcaaaagcttatggacttgccggactacgtatcggttatgccgtatctaacgctgaaattgccgatttactaaatcgtgtgcgccaaccgtttaactgtaacagccttgcattggcttctgcaattgcggtgatgaatgacgatacttttgtggaaaaagtcgcagaaaataatcgccaagaaatgcaacgttatgaagcattctgccaagcacaaggtttggattatattccgtccaaaggtaactttattacgattgatttcaaacgtcctgctgcaccgatttatgaagccttattacgtgaaggtgtgattgttcgtccgattgcaggttacggtatgccgaatcatttacgtatcagtatcggtttaccgcaagaaaatgaccgattgtttgccgcattagtaaaagtattaggctaatttaagagaatacagatggaaaaaattacattagcaccgatcagccgtgttgaaggcgagattaatttacctggttcaaaaagcctttcgaatcgagcgttattattagctgctttagcgaaaggcacgactaaagttaccaatttattagacagtgatgatattcgtcatatgctgaatgcattaaaagcattaggcgtgaattattcattatcggaagataagaccgtttgtactgttgaaggaattggcggcgcatttaattggcaaaatgggttatcgttatttttaggtaacgcaggtacggcaatgcgcccgttaaccgctgcattatgtttaaaaggcgcaaccgaagcagaagttattctaaccggcgaacctcgtatgaaagaacgcccgatcaaacacttggttgatgcccttcgccaagcgggtgcaagcgttcaatatttggaaaatgaaggttatccgccggtagcgatccgaaacagtggcttaaaaggcggaaaagtacaaattgacggttcaatttccagccaatttttaaccgctttactgatggcagcaccacttgctgaaggcgatatggaaattgaaattatcggtgaactggtatcaaaaccttatattgatattaccttagcgatgatgaaagattttggggtaaatgttgagaaccaaaattatcagacctttgtggtaaaaggtaaccaaagctacatttctccggagaaatatttggtggaaggtgacgcatcatctgcttcttatttcttagcggccggtgcgattaaggggaaagtgaaggtaaccggtattggtaaaaattcgatccaaggtgaccgcttgtttgccaatgtgctagaagcaatgggggctaaaatcacttggggtgacgattttatccaagcagagcaaggcgagcttaaaggtgtggatatggatatgaaccatattccggatgcagcgatgacgattgcgaccaccgcattatttgccgaaggggaaacggtgattcgcaatatttataactggcgtgtcaaagaaaccgatcgtttagctgcgatggcaaccgaattgcgtaaagtcggtgcaaccgttgaagaaggcgaagattttattcgtattcagcctttaccactcacgcaattccaacatgctgaaattgcaacctataatgatcaccgtatggcgatgtgtttctcattgattgcattgtctgatacaccagtgacaattttagatccgaaatgcacggcaaaaacgtttccgacctatttcaatgaatttgagaagttgtcggaaagaacataaaaagcgataataagcggttaaatttgtaaaaaaatttgcaaatctaaccgcttttttatgcgcggttacaaattttaattcaattaaattgcataaatattcattttgatatacatttgtcagaaacaaaaaataatgaggaagttatgcgtaacacagaattagtccagtggtttagacaatccgcgccttacgtaaatatgcacagagagaaaacctttgtgattatgttagacggtaatgcgattgctcatccgaattttattaatattaccaacgatattggattgctccatagtttaggcattaaactggtcatcgtgtttggtgctcgttgccaaattgatgaattactggcaaaaaatcagatgagttccgcttatcataataatattcgtataaccgatagcaaaacattagaagtggtgaagcaagcggttggcggattgcattatgatattttttctcgtttgtcgctgcgtttaccgaattcaccggtattgaatgtagtgagtagtaatgcagtattggcgcagccgcttggtgtgattgatggtgtagattacggtttaagcggtaaaattcgccgtattaatattgaaggaattcagcagcaactggcacaggattcgattgtggttattggcccaattgcaccttctgttaccggtgaaatgtttaatttgcctttcgaagagattgcaacgcaaattgcgattaaattaaaagcagataaattaatcggtttctgtgatcagcaagggatcttggatcaaaacggaaaagtactatcggatttacaccctcgtgaagctaaacgttacttaacgcaatttattgaatccggacaatatcacaattctgccgctcgctttttacaagcagccattgaagcttgccatgccggcattaaacgttcgcatttgctgagttataaagaagacggctcattacttcaagagttgttctctcgtgacggtatcgggacacagttgtcggaagagagttcagaaaatattcgtttggctacttcgtttgatattcccggtttgttaaatctgattcgtccgcttgaagaacaagggattttggttaagcgttctcgcgaacagctggaaatggagatcagtaactatacgattattgagcgtgacggtattgtgattgcttgtgcggcactgaatcattatccggaagaaaaaatggcggaaatggcttgcgtggcagtacaccccgattatcgagattcatcacgaggtgatgtgttattagaagcgattaaacgtagagcctataaattacaggtcgagaaattatttgtcttaaccactcgcacaacacagtggttccaagagcgaggctttgtggtatccggtacggaagatttgccgaaagagaaacgagaacattacaattaccaaagaatgtcaaagattttgattttagagcttaaccaatagcggttgaatctatcaccaatataatgaaggtgcgagagttcttctcgtgccattttatctcctcaaaaatggcaaaggtacgagtaaaggcacttgtgccggctggtgtagatagcatcaattttgcaaaatattgtataaatttgaccgcttgttacttcgttaaatattgctgtctttcttgcataagtttactcaaaaactcaatcaatacttttaccttaggtgataaatagcgtcgatgtggatataagatactgatatcaatggaatgctgtttatattgtggtaaaacttccaccaagttaccggcagtcagatcatctttggctaaaaagagcggtaaattgataataccttgtccggcttttgccatctgtaagagtgcatagccgttatttgagaggatatgtggtgtcggtttaaattttattttttgatcattatcgacaaataaccactgttggtggttttcataaagtaagcaagagtgctgagctaattgctcaagtgtttctggtgtaccgtgtttatctaaatattccggcgatgcaagtagcataagttctgattgtgcaatacgttttgctacaattgaactatcttcaagcgaaccaattcttaatactaggtcatagccttccgcaaccacatcaacacggcgatcactaaattcaatattaagctgaatattgggataagtagctataaattgacctaaataaggcgcaacaaagcgcgaaccgaagtccatcggtagggaaattgtgattttcccttgtaatgtagaggtaatattgcttacactattctccgcatcttttaattcgttaaggataggtagacaacgctggtaataaagtaatccggcttctgttggagtgatcttacgagttgtacgatgaagtaatctgacattaagatgctcctcaagctgagcaataagcttgcttgccattgccaacgaaatttgttcaagctgagcggcttgagtgaaactttgtgtttctatcactcggcagaaaagattaattgcgttgagtttgtccataatttctttctctagatattgttttttactatcaggcttgctattgtcagcatattttgggtcaattagtatcaaatatcaactagaaagaaataaactataatatatttctttaattatttacattttaggtagttattaatgggaaaatcattggttattgtggagtcaccggcgaaagctaagacaatcaataaatatttaggtagcgattatgtggttaaatcgagtgtcggtcatattcgtgatttacctaaaagcggtagtgaaagtgaaaaaaatgagaaagccaaaccgatttccaccaaaggcatgactgctgaacaaaaagcaaaattaaaagcagaaaaagatcgtgccgcattagtcaaacgtatgggcatcgatccttaccatgattggaaagcgaattaccaagtgcttccagataaagaaaaagttgtttccgaattaaaatccttagctaaaaaagcagatcatatttatctcgcaaccgacttggatagagaaggggaagcaattgcttggcatttacgagaagttatcggtggtgatgacgatcgttttagccgagtggtgttcaatgaaattaccaaaaatgctattcaaaaagcatttgaaaagccggatcatttaaatttagaccgtgtaaatgcccaacaaacacgccgctttttagaccgtgtggtcggctttatggtatcgcctttgctttggaaaaaagtcgcacgaggcttatctgcagggcgtgtacagtcagttgcggttaaacttttagttgagcgtgagcgagaaattaaagcgttccaaccggaagaatattgggaaattttagccaatacattaacggctaaaggaaaattaccacttgatttaactggctataaaggtaaaaaattctcggcgaaaaatcaaaaacaagcggatgaagcggtaaaagcgttacgaggtagcgaatttgttgtttcagagattgataaaaaaccaacttcatcaaaagcgagcccaccatttattacttcaacattgcaacaaacggcaagcacccgtttgggctttggcgtgaagaaaaccatgatgttagcgcaacgtttatatgaagcgggttatattacctatatgcgtaccgactcaaccaatttaagtcaagacgcattagcgatggcgcgtggttatattgaagaacaattcggcagtgagtatttaccggctaaaccgaatttctattcaagtaaagaaggtgcacaagaagcgcacgaagcgattcgtccgtcagacgtgaatgtaaaaatgtctgatttaaaaggtatggaaaaagatgccgagcgtctttatgagcttatttggcgtcgtttcttagcttgccagatgacaccggctcgttatgattcaaccagccttactgttacggcaggtgactatgaattaaaagcgaaaggacgtgtattgcgttttgacggttggacgaaagcattaccagtacaaggcaaaaccgctgaagatcaagtgttaccggaggtcgcactcaatgaaaaattaatgttagaagatgtgctacctagccagcactttactaaaccgccggcacgtttctctgaagccgctttggttaaagaattggaaaaacgtggtatcggtcgcccgtctacttacgcagcaattatttcaaccattcaagagcgtggctatgtgcgtattgaaaatcgccgtttctatgcggaaaaaatgggtgaaattgttaccgaccgtttagacgaatcctttagcgatctaatgaattacgactttaccgccaatatggaagaaacactcgaccaaattgcggaaggtaataaaaactggaaagaagcgcttaataatttcttcaaagatttctctgagcagctgactaaagccgaattagatgagctggaaggtgggatgaagccgaatagtcttgtgccaacggaaattgattgtccgacttgtgcaagaaaaatggcaattcgtaccgcttctaccggtgtattcttaggctgtaccggttatgcgttaccgccgaaagagcgttgcaaaaccacaatgaatctgattccggaagcggaattactcaatgtgttagatgaagaatcggaagcaaaagctttattagcacgtaagcgttgtccgaaatgtgattcggcaatggatagctatgtaatcgatccgcaacgtaaattacatatttgtggtaataatccgaattgtgacggctatgtgttagaacaaggtacattcaaaattaaaggctatgatggcccgattgttgagtgtgataaatgcggtgcggatatgcatctcaaacttggtcgtttcggtaaatatatgggttgtaccgcttgcgataacactcgtaagattctgaaaaatggtgaagtggctccgcctcgtgaagagccgacccatttcccggaactcaaatgtgagaaatcggatgcgtatttcgtattacgtgacggcgcaagcggtgtgtttatgtcggcacacaatttcccgaaatcacgagaaacacgggcgccgaaagttgccgaattagcacaataccgtgatcgtttaccggaaaaattacaatatcttgtcgatgcacctcagcaagatccggaagggaatgaagcgattatccgctttagccgtaaagaaaaacgtcaatatgtgacctctgaaaaagacggtaaagcgactaaatggatcgtagattacgtggacggcaaatggctagaacgtaaaaaataatatctcttaaacaaaaaaaccaccgcttattgaggtggttttttttatatcaatttacaacgaattagcgtacgtatcgcaagtagctggcaagcaggctacgcaagttttccaaccattcttttttaccttgaatactctcgaattgttgccagagattggctaacacgccatgattgcgaggatcttgccagtaaaggcgtgttaggctgacataacttgctgccagcgaacgttgcgctaatgcaaacccttctatattacgccaatcttgttcgtccatttgcagctgcacaagcggtcgaattggcaacatattttgcaattcggtataaaacggctgtaatgctaaatctctctcaaattgggcggtagcttgttttacaaatcgctggcctttggctgaaatcgggtagagcatcatcgcactgtggtagccgctactggcttcttttgtcggggtaatttgtactaactgaaaaccgcattgttgccaaaaatgcaacagaggttccgagagcccaaagctgaccgaaacataatctacaagcggtcgagtttgctgaattttttgcaaaataaagtcagaaattaaccgcttgccaatcccttgctgttgcaattcaggttgtaccgcaatacgtgagatgcgtaccgaacgtagctgacaggcttcgagtaagttgccttggaagcagagatattgtgcgactaaattaccttgtgggcggcgttctccccgccaaatggcttcagctaattcaggttccaaatcaccttcaggtacagcccaaataccgccgactaaacgctgatgttcggagaaagaatgtagtaactgatcttgagcatcaaataatcggcgtaaatcgctaggtgtggttttgtaatgtgcttccgccagtaaatgataaaattcagcatattgattggtttcgcttggtagcgacataatcaataattcatcaataaattgttccaacggatcattttcatcccaacgtagcggtttagtcagttgccattctcggtacggctttgtgagctgttgagggagtttcaggctgaagcctcgcccagtgccttcataattatgtgtggtagtggttaacaccactttatcgaagtaagcacagagttgatgtaacatcggcagcggcaaacttgccgcttcatcaataaataaccagctatttgccgcaatttggttagatgcaattttttgtaacaggtgatcaggggcaaaaaaaggaatattctgcgcagcagacttccaaaaactaggtaagaccgagtggcttcttgcggtaatcagtaccgattctgttttagctaactgctgagctaatttaccggcgagggtagatttgcctcgcccacgaggtgcggtaattaaatgaatagctgatgaatcaagcggtaatttttcaaagatttcttgctgttgttgcgtaagattttcagccgcttggcattggggaggctgctttggcaagctaaaatccgtttcttccaatgtttggaattgaaagccgaatttttgtaccaatgccttaacgtagcgatagaaattcggtgtagcaatcaccttaccactattccaacgttgcgagtcaaaatcaggctgttgttccaacgtatcccaactcgggcaaatgagatagagcgtgccttgtgcctgaatcgtaccggcaataatcgctaatgcgtctaagttaagacatacaccgccttcagcgcgcatatcataaattgcataggggtattcttgccccaaaaactgtttggcttgggagatattgccactatgaataacaatgcccccgtcaagcggaggcatttcagctaaaatcaccagtttacgcattattcttcaatcactttttctgatatatacggatcttcaaaacctaaactttgcataatctcggtttctaagccttccatttcttccgcttccgcatcttcaatatgatcataaccgagtaagtgtagcgtgccgtgaattgctaaatgtgcccagtgcgattctaaggaaatttgttgctcttgcgcttctttttccactacttggcggcaaataatcagatcacctaataacggtaattcaatgccttccggcacttcaaacggaaatgaaagcacattggttggtttgtctttaccacgataagttaaatttaactcgtggctttccgcttcgtccacgatacgaatcgtgatttccgtttcagggaaatcttcggtttgtgcttcgtgcgctaacgcacgttgcacccattgggtaaattgttctaaagacggaagatcttcactgttctctgcggcaatttgtaaatcaataattggtgttgtcataaattctcaatatataaaaaacggaatgttgtcagatattataaaccttccgacacattccgtgaatctaagggcgtgatttattgccatttatccgcttcaagttggtcgctttctctgccttctatccagcgatcgccgtcttgtgtggtttcacgtttccaaaacggcgcacgggttttaaggtaatccatgataaattcgttagcatgataagcatcgcttcggtgagcggaacttaccccaaccaacacaatttcatcaccagtatgaagttgcccaatacgatgaatcactgccacacgttgtaaatcccaacggctacgtgcctcatctacaatttcttggagtgcttttttggtcattgcagggtaatgttccaaatataaaccggatacattatcgcctaaattcatttctcgtactttgccgacaaaaagcgtggttgctcccacgctatgatgttcgcttagccagtggtaaatcgcattttgatcaaacgtttcttgttgtacttcgattaacgtagcgtgcatttagcctcctgttaccggtgggaagaatgctacttcatcgccgtctttgattgcactttccaacggtgaaatgttttggttaattgccactaataatttgcctttttctaatgctaattgccattttttaccttgctggcttaaatgttcacgtagctgttcggcggtttcaaactcagcaggaacggttaaagcatcaacgccaaccaattcgcgtacctgtgcaaaaaataaaacgttaatcatatttatccctaaatgtaattcttattccgcattaaattcgcccgatttaccgccacttttgtgtagcaaacgaacattttcaatcaccatatctttttgtaccgctttacacatatcgtaaatcgtgagtgcagcaacactggcagcggttagcgcttccatttctacaccggttttaccggtgagtttgcatagtgattcgatgcgaacttgattggtttccggcagagcttcaagttgcacttcaacttttgataggagaagaggatggcaaagcggaataagttcccaggttcttttggccgcttgaatacctgctatacgagcagtagcaaatacatcacctttgtgatggttgccggagatgatcatttgtaatgtttcggcattcatcgaaatgaatgcttcggcacgtgcaacacggacagtttcttgtttcattgaaacatcaaccatattggcttcgccgttggtgtttatgtgagtaaattgagtcataagagtatctttttaattttaaagtattttgcaataaataaagtaaaaatgaccgcttgggttcccttctgaaccgcctgagcgtgttgcaatttgtaggaacatttttcttgagccgtaggcgaatctaaaatgttccgttaagcaaatttcaactaagtgaagaacagcagtgaagtagggttgcctttcttttggttacttttctttggcaacgcaaagaaaagtaacagagaaactagccgccgattgaggcgagattattccgaacgccgctatcgccgatatgcaaataatgatgttcccgtttgccttgtaatgcggcttttaaacgtgcttccaattgcgcttgttgggtatcttccgagagtaaatctcgcaaatcgatgccttcctcaccgaataagcaaaggtgtaatttaccaagtgccgaaacacgtaggcggttgcagctggcacagaagtttttctcatacggcataatcaaaccgatttcgccctggtaatcagggtgcgaaagcacctttgccgggccgtccgataatgcttttggctgtaattgccagccttcttgtaataaacgttgcattactgactgaccggataaatgttgcgctttgaaaaaactgtccatttcaccggtttccatcagctcgataaaacgcatttgaatcggtttatctttaatccaagcgaggaatttatctaattcaggggcagtgtattgcttcattaacaccgcattcaccttgattttgcgatagccgatttcaaatgctctatcaatgccttttaggaccgattgtagcttgttttcaccggtaatgagttggaattggcgtgtatcaaggctatctacactcacgttaatatctgtaatgccggcttgctgccataaatcgatatcacgttccatacgataaccgttagtggttaacgccactttttttatgccgttcgtttgcgaaatggtatgagcaatttctaaaaagtctttacgtaaagtcggttcaccaccggtaatacgcactttttccgtgccgagatcggcaaaagcacgcacaatgcgctgaatttcagatacgcttaaaaattgctgcttgtgtaaaggcggtttatagccgtccggcagacaataattacagcgaaaattgcagacatcagtcacggataaacgtaaataaacatattgtcgttcaaaacgatcaataagctgagaaacattatccgccccaatgtttttaattggaatggattgcattggacacctttctaaacacgagaggaacaacaatttcttgaaattcccttgaattagctacgtataagctaattacaggcattgctaccatattcttacagacaagcggttaaatttagcaaaaaatttgcaaagcagatcagataagaagttaggctcacaagctcggagtctgttgataaatataagttattgtagaggtcggagaggtttttcgcaatagttagaaagtggtatcgcattcagatggctaaatttacatacaaagctgacaaaaattgatttggcgcaaattaatcatttggaggtatggtaatcttcactctactcctaaaggagtattttttttatttataagttgtgtggggtaaaaatgtccaaatttaaattatcactagtaagcggagtggtgtgtgttgtgttaggtgctgcagcattgtttggcgtacagtcggcaatgaaagcgacaagttctactgaattttgtgtaagttgtcattctatgagccatccgcaagcggaatgggaaggtagtgttcatttttctaaccgcaaagggattcgtgcggaatgtgcggattgccacgtccctcaagatggtttgcattatgtaaaagctaaagttgttgcattaaaagatgtgtggcatacctttgtaaccaataaattaccggatcaagaagcctatgaagcgaatcgtttagatatggcgcaacgtgtttgggcagaaatgaaagaaaccgactcggcaacttgccgtagctgccatagctttgatgcgatgatcatcagtgaacaaaaagaagcagcgcaaaaaatgcataaattggcacaagaaaccaatcaaacttgtattgactgccataaaggtattgcacactttatgccggaaatgcaagtagataacagtgcggcattaggtgaattaactaaacacgccggacaatttagtgcgagcgacaaaacattgtataacttagcgatggctccgtcacaagtcgcacaaggcggtgaaattcgtttattaccgtttgcagaagtctcacaatggaaagagtccggtgataaggttgctggcacaattaaaggttggcagcaagtgggggcggaaagcatcatttatatggggctaggtcagcgtattatggtgggcttagtggcagatgaagcaaaagacaaactcactgttcatcaaacagttcatgacaatgtaaccaattcagattggaaagaagtgagcgctgaagtgacattaccaaaaacggcgttaactgccgatattcaggcacttaatcgtttcggtgacaatttaaatcaaacccattgtagcggttgccatgcgccgattggtgcagatcactatacggcaaatcaatggatcggcgtagtaaattcaatgaaagaccgtacttcaatgtcagcagatgatgtacgtgcggtaactatctatctacaacgtaacgcaaaagatgttgcgggtagttcacactaattttatttaacttacatgataccgagcttgtatgcctaagtcttagataaggtgtgcaagcctgtggcaagcggtcaaaattcacaaaatttttgcaaaatcagaccgcttatcacaccggatagtaaagaaatgcgctatcccctcgtgtttagaaaggtgtcaaatttaacttaactttcagagggttatgcatatgaaaactcaagaaaaaattaatgcaagtcgtcgtggttttattaaaaacacttctctcggccttgcagggacatctttggcaggcggtggtgtaaatgccttgatttcaacggaagcggcagcggcagaaatgcaaactgtgatgacagcagcacactggggggcattaggtgttgttgttgaaaacggtaaagtggttaaatctggtcctgcgatgccttcgtcaatcgagaatgaactacaaacggttgtacctgatcaagtgcacggtgaaactcgtgttaaatacccaatggtacgtaaaggttacttagagggtaataaagatacgactttacgtggtcgtgatgaatgggtgcgtgtttcttgggataaagcgtttgaattagttgcaaacgaaatgaaacgtgtgcgtgacgcacatggcccaagtgcaattttcggtggttcttacggttggtatagctcaggttcactacatgcagcccgtacgttattacagcgttatctaaacattaccggcggttttgttggcgtgaaaggcgactattcaaccggtgcggcacaagtgattatgccacacgtattaggtacgatcgaagtgtatgaacagcaaaccagctgggaagttgtcttagaaagcacggatgttattgtgttatggtcggcaaacccattaaatacgttacgtcttgcttggacttcaaccgatcaacaaggtttggaatacttcaaaaaattcaaagaaagcggtaaacgtattatctgtattgacccagtaagaagtgaaagttgcgaatatttaggtgcagagtggattccggttcatacaggtactgatgtggcgttaatgttaggtatggcacatactttagtaaccgaggataaacacgataaagaattcctcaaaaaatacactaaaggctacgaacaatttgagaaatatttgttaggtacggaagataaacaaccgaaagatgcacaatgggcaagtaaaatctgtggcgtaccgtcagaaaccatcaaaaaactggcattagagctacaaagtaaacgtacgatgttaatggctggttggggtattcaacgtcaacgccacggtgagcaaggtcactggatgttagttacattggcatcaatgctgggtcaaatcggtttaccaggtggcggttttggttttagctaccactattcaaacggtggtgcgccgactgcaaccggaggtattttaggagcgatttctgcaaacccgtctactgaagcgggcgcaaaaacttggttggatgaaacctctaaattctctttcccgcttgctcgcatttccgatgcattattaaatccgggtaaaaccattgactataacggcacaaaagtgacttatccggatattaaagtaatttggtggtcaggcggtaacccatttacccatcaccaagacaccaatactttagtaaaagcatggcaaaaaccggacagtgtgtttgtcaccgaatgtcactggacaccaaccgcacgtatggcggatattgttttaccggcaaccacaagttatgagcgtaatgacttaacgatgtcaggcgattattcaatgatgaatattttcccaatgaaacaagttgttccgccacaatttgaagcgaaaaacgactatgatatttttgcagagctttcaaaacgtgcaggtaaagaacaagaatttaccgaaggtaagtcagaaatggattggttaaaaggtttctatcaaactgcatttgatgcggcacgtaaaaaccgtgtgttaatgcctaaatttgaacagttctgggcggataacaaaccagttacctttaaagcgactgaaaaagcgaaaaaatgggtacgttatgaagagttccgtaacgatccattgctcaacccattaggtacaccatcaggcaaaattgaaattttctctgatgtagtggcgaaaatgaattacgatgactgtaaaggtcacccaacttggatggaacacgaagagttcgctggtaatgcaaccgcagaagcgccgcttgcattagttaccccacactcaaaatatcgtttacatagtcaattagcttacagctcattgcgtaaactttatgcagtcaatgatcgtgagccggtattaattaataccgaagatgcagcagctcgtggtattgcaaacggtgacatcgtgcgtattttcaataaacgtggtcaggtgttagcgggtgcagtggtaacagacggtatcattaaaggtgcgatcgcgttgcatgaaggtgcttggtatgatccgatggatctcggtaaatcagaacagccgctttgtaaaaacggtaatccgaatgtgttaactcgtgatgaaggtacttctaaattagcacaaggtaactcaccgaatactgcaacggtacaagtagagaaatttactggtgttgcaccggaagtcaccgtatttaaagaaccgaaatatacacaagcatagtgttataaacaggtaaaacaaaacgcactagagtttaaatgctttagtgcgtttttctattcatgctatagctatttgaaaacaagcggtcattttctcaaaattttttgcaaaaaactgcttaaaatcgaccgcttatctagattattctcccgaggttatagaatagctgttatagttagcaaaatttttaaggagaaatgatgaaaaataaatttatcgtatttgcggcaatcagtggttttttctgtattgcttttggtgctttcgcttctcatggactagctaaaatattagaggcaaaagcgttaggttggattgatactggtcttcaataccaaatgtttcataccttagctttattggctttaggtttgttccaattggtaaattcctcacaaaatccgcccgcttgcagagcgaaagccttaaacattatcggtggaagttggatattaggtattttgttatttagtggaagtttgtatgcgttagcattatttggacagcgattatttgtgtggagtacaccacttggcggcgtattttttatgattggctgggctgcgttaatttttgtaagtttacgtgctaaaaaaaccgcctaatcggttagaataggcggaaaacgtgttttttgttttatggtgtcaggtattgacttgccaacgcaatcaaggctagaatgattccgacatcaattttgattgacaattgcaatttaccttcgttacaggttagtttaaattgcatcttatagttcctgtctaatgagttaatcaaaagcaggtcaaacgcaaaatccctgttgccgcagggatttttgcattctccctgccacctattgttttcacatcattgcaaaaacaacacctgttattatatccatattgtatttttaatcaattacttgtttttcctattaaaatagtgcgcaaaacgctatactaaccacatttttcactaattagaaaacctatgaataaactagcattatattgccgagcgggctttgaaaaagaaactgccggcgagattaccgataaagcggcacaattaggcgtgttcggctttgtaaatttaaaagaaaatagtggttatatcatttttgaatgttatcaagcaggcgatgcggatcgcttagccaaagaattaaaatttgaacaattgatttttgcccgtcaaatgattgttgtaggggatatgctacaagatctgcctgtcgaagatcgcatttcaccgattttagagcaataccaagcgttaaatcctcgtcacagttcggatatttttgttgaaacgccagatactaacgaagcaaaagaattactgaccttttgtcgtaagtttaccgtaccgctacgtaatagcttaaaaaagcaaggctggttaggtaaatcagaaaaagcgaaaggtagtattagtttacatattttatttgtgcgtccaggctgttgttatgtcggttatgcttataacgacaataaatcgccattttttatggggattccccgtttaaaattcccggcagaagcaccgagccgttcgaccttaaaattagaagaagcgatcctcacctttattccggaagcggaagagaaaaaacgttttaccgatgaaatgaccggtgtggatttaggggcttgcccgggcggttggacctatcaactggttaaacgtggcgtattcgtgtatgcggtggatcacggcaaaatggcggcaagcctgcacgaaaccgggcgcattgagcattgccctgaagacggttttaaattccaaccgcctaaacgtaaaatgattgactggttggtgtgtgatatggtggaacagccaatgcggatcagcaaattaatcggtaaatggttaattaacggttggtgtcgagaaacgattttcaacttaaaattaccgatgaaaaaacgttatcaagaagtgcaattatgtttagcgtatcttgaagaagaactcgaaaaacaaggtttttggtttaaaattcaagcgaaacatctttatcacgatagagaagaaattaccgtacatattgcggtcatgggacgtaaaccccaataagcaaaatccacataaataagcggtaaaattttcacaaaattttgcaaatttatggcaaaatcagaccgcttattttaacaagaacaagacgttatagaggaagacacaatgacattaaaaatcggaatcgtcggtgccggcggtcgtatgggacgcaacttgattactgcggtacaaaatgcggaaggcgtagagttaggtgcggcatttgaacgtaaaggttcaagtttagtcggtgcggatgccggtgaagtggcgggcattggtgcaacaggggtaaaaatcagcgatgatttaagccaaaataccaattttgacgtattaattgattttacccgcccggaaggtacgctcgaacatattaaattttgtgtagcaaacggcaaaaaaatggtcattggtacaaccggttttgatgatgcgggtaaacaagcgattcaagcggcagcagagcaaatttcgattgtgtttgcttctaactatagtgtcggtgtgaacctcgtattcaaattattagaaaaagcggcgaaagtgatgggcgattattgcgatatcgaagtgattgaagctcaccaccgtcataaagtggatgcaccgtccggcacagcactatcaatgggcaaacatatcgctaaaacacttggacgtgatttaaaaacgtacggtgtatttgctcgagaaggcattaccggcgaacgtaaacgtgatgaaatcggttttgcaactattcgtgccggcgatgtggtcggcgaacactcagtatggtttgtcgatgagggcgaacgtgtggaaattgcccacaaagcctcaagccgtatgactttcgccaacggtgcagtgcgtgctgctaaatggcttcaaaccaagcaaaatggtctgtttgatatgacggacgttttggatctgaataatttatagtttagattgaatgtaggggcgcacagagtgtgtttaaaatgaataataaaaggaatgaaaaatgaccaaatacaacaacattgaaactaagttagtacaattaggtaaccgtactgatcctcgtacaggtgcggtagcaacacctattattttatcgaccgcttatggccgtgatggtttaggtgaatcaacaggttgggattatactcgtaccaaaaacccaacccgtgccgtgttagagcagggtattgcagatttagagggcggtgatgccggttttgcaatggcatcaggtatggcggcaattcagttagtgatgtcgcttttcaaagcaccggatgagtggattatttcaagtgatgtatatggcggctcttaccgtttattcgatttcagtcataaacatcacaatacagtaaaaccggtgtatgtcaatactgcagatttagcggcaattgaagcggcaatcacgccaaatacgaaagcgatttttgttgaaacaccgtcaaacccattaatggaagagtgtgatgttgatgcaatttctaaaattgcgaaaaaacataacttaatgttaattgtggataatactttcttaacgccgattttattccgtccgattgaacacggtgcggatattgtgattcatagtgcaacgaaatacctttctggtcataacgatgtgttagccggtttgattgtagcgaaagattcagaggcgactaaagtaaacggtcaaaatctttctgaacgtttattctacttccaaaactgtgcaggtgcggtgctttcaccgtttgattcttaccttgctgtgcgtggtttaaaaacccttgcgttgcgtatggagcgccaccaatcgaatgcaactgaattagcgaagttcttaagtgaacagcctgagattgatagcgtactttattcaggtaagagcggcatgctttcattccgtttacaaaaagaagaatgggtgccgaaattcttaaaagcgatcaatttgattacctttgcggaaagtttaggcggtacggaaagttttatcacttacccgtcaacccaaacacatatggatattccagaagcggagcgtattgcacgtggtatcaccaataacttactgcgtttctcagttggcttggaacatgttgaagatttaaaagcggatttacgccaagcgttcggacaactaaaataagtaaattggcataacattttggtgttatgccaaatttattttgattttagtattaattgtcattatcattaccctctatttttattaagagagcttaaacattatgaaaaaacatcacgttgaaacccttatttctcgcgaagaagttcaatctcgtattatggaacttgctaaagaaattaatcatcactatgcacacgcacattgcgagaatttggttgttgtagggctattacgtggttcatttatgtttatggcggatttagtgcgtttaattgatgtaccggttgaagttgattttatgacagcttctagctatggttcaggtacggaatcaagtcgtgatgttaagatcttaaaagatcttgatggtgagattcacgggaaagatgttttaatcgttgaagacattattgataccggttttactttaagtaaagtacgtgatattttgaatttacgtgagcctcgttcggtagcaatttgtacattattggataaaccttcacgtcgtgaagtagaagtaccggttgaatgggctggctttgcaattccggatgagttcgtagtgggatatggcattgattatgcacagaaatatcgcaatcttgattttatcggcaaagttgtgatggatgaataaaccattaaaagaatataactaaccgcttgcaggaaacttcaagcggttttttgtgcctaacttgcttaagtaaagaaaagggaggaagaaataatgtggaaaaaaacagttctagctttattggttgcagcttcagtaaatataagtgttgaagcaaagcagaaaacgaaagtatacagtgagacagaggttgctcagctccaagccgaattagaaaaaaaattaactgacaaatggcaaaaagatcagcaggatgcagcggaacttgttaagcaaagagcttattttgagcaattagatgcaattttaaaagcggcacaaacaaagaaaacattaacgccgaatgcattacagctaagtaatgcgttactcaaggcattagccggctatccgctggaaatggaagcggaatgggaattgctgaagaccaagcttgcagttaagcaagtttcagaacaagaaatttcagcgttttccgaaaaatatccgaattcgatttatcagaagcgcttaaatcagctcacatttgaacaattatatcaagcggcaaaatgggcagagttacttgagtatgccaaaaaagtgacgccggagggcaatgaaaatcagtgtcgagtgttttctgcacaatatcagttattcgctagtcaagctcagatcaatcctgaagctgaacaagcaacacaaagcaagacctcggtagatacagcggtaaatagcgtaataactgatttactcggacagtttgaaaagttttggttaaaaacggctgaattaccgcaaagttgtgccgatattgaagcttattggcgtgatcaaggcggtaaaacagcggataaaatccgtttaaaagcagttgaattatttaaacaaaatgcagctaaaggcttagaaactttgagtttaaatactcaagattcagaacttactttgtggcttagcgaagtaagcaaactacagaataacgtaaattatttgcaaaattttgttcaaaatcaaccgcttactgaacacaataaagcattgattatgtacacctttcctaaattgttgaaatcattagctgaagatatgccatcacctaattttgcgccttaccaaacttgggcggaaaaatggcaattaacatcggctgagttaaaagaatggaaaacagcgtttatcagtcgcttttttgataatcagtcaggagaatggcaaatttggcgtgataatgagcttcaaacattaaaagcggataatctgaccgagcgacgcatacgtatggcgctatggaaaaaagagaagttggatacttggcttgtgttattatcggatgaggctaaacaaaaagcagaatggcgttattggttagcgaaaacagaaaaagatccacaaaagcgtactcaacagcttacaagtttggcgaaagagcgtggtttttatccgatgttagctgctcagcaattagatatgaattatcagtttaatcagcctgaagttaaaccgttaacagatgagcagatagcgcaatttacctcgcaatttatacgtattaaagaatggcgtgcgcttaatcgtttcgagtccgctaaaggattatgggttgaatggctgaagacgctatcgtttgaggagcaacttggattaagtgaatatgccaagcagcaagaatggtatgatttagccgttgaagccacgattcaagcaaaagcatgggattatatcgatctacgcctaccgaatgcttatgcacaatggtttgatttaaatcttactgagaaaggcgtgtctaacagttttgcgatggcaattgctcgtcaagaaagcgcttggagcagccaagctaagtcacacgcgaatgcgatggggctaatgcagatgttaccgagtacagcagcattaacggcgaaaaatatgggattgccgtttgagaacgataaagatttgtttgatccgcttagaaatattatgttaggtacagcacatttaaatgagttaaatgtgaagtatccaaataatcgtattttaattgctgcagcttataatgccggcgcaagtcgagtagagaagtggttagcacgaagtaatggcacattagcgatggatgaatttattgcttcaattccgttttatgaaacgagaggatatgtgcaaaatgtagtaacttatgattattactatcaaatgttacagggtaaaacaagcaaacaaatgttttataaagaggaatggcagaagcaatactaattagctgattaatttcttatactaataaaacaagcggttaaattcttcggattttttgcaaaatcttctgaaaatttaaccgcttgtttatatataaaactgttagtttaatgaaaacgctttgctggtagattcgtatttgatgccagaatgcgagccttcagcaccgttaaaataaacatttttagattgagaacaagcactgatcactaaaatgcttgctactaagaagataacttttttcatatctgtcctcgagtatgtaaaaaagcggccctatttgaccgcttatcattaaaattaagctgtaaaaccttcttttaaacttacagttaagttaaatactaagttttcagccgaaccgtctttactgtctaaacagtaatagccttcacgttcgaattggtagccttgttccgctttcgcattaacgaggctcggctcagcgaagccgtgtttgattaccaatgattccgggtttaataccgcattaatatcatcttccgcacctgggtttgctaccgtgaataaacggttgtaaatacggaattcagccggtttattatcttccgctgatacccagtgaattacccctttcactttgcgaccgtccgcaggatttttacctaaagtttccggatcgtaagtacagaaaatggtagtgattttaccgttttcgtctttttctacacgttcagctttaattacataagcattacgtaagcgcacttctttgcctaatactaaacgtttgtactgtttattcgcttcttcacggaagtccgcttcatcgatataaagttcacgagtaaacggtaaatcgcgttcgcctaattccggacgatttgggtgatttggtgcttttaagatttctttatcaccaaagttttcaatcacaacacgaactgggttgattactgccattgcacgtggtgcgttttcgtttaaatcttcacgaatacaagcttcaagcgctgagtattccaccacgttatcttgttttgtcacaccgatacggcgacaaaattcacgtaatgatgccggtgtataaccacgacgacgtaaacctgaaattgtcggcatacgagggtcattccaaccgtccaccgtgccatctgtcaccaatttcaataatttacgtttagaagtgagagtaccttctaaatttaaacgagaaaattcatattggtgcggtaatggacgctcgatagaaatattttcaagtacccaatcgtataaacggcggttatcttggaattcaagtgtacataatgagtgagtaattcgttcaatcgcatccgaaatacagtgtgtaaaatcgtacatcggatagatacaccatttatcaccagtttggtggtggtgagcaaatttgacacggtagattacagggtcacgcattacgataaacggtgatgccatatcaatcttagcacgtaaacatgctttgccttcttcaaactcaccgtttttcattttttcaaataacgctaagttttcttccacgctacggtcacggtatgggctgtttttgcccggctcggttaacgtaccacgatattcacgcatttcatccggcgaaagttcatcaacataagctaaacctttgttgattaactcaattgcatagccgtaaagttgatcaaaatagtcagatgcataacgcggttcgccttcccatttaaaacctaaccattctacgtcttgtttgattgaatcaacgtattcaacatcttcttttaccggattcgtatcatcaaaacgaaggttacataagcctttatattcttgggcaataccgaagtttaagcagatagattttgcgtgaccgatatgtaaatagccgttcggctcaggtgggaaacgagtgtaaacgttattgtgtttaccgctttttaaatcttcatcaataatatgggtaataaaattcgcacgggtttccggcacattttctaaaatttcttctgtcataattgttctctgttgcctttaaataaaaataacagagtattctacaccgtattacgaatttcataaagcagcaaacggtgagaaataaaaaagcggtcgaattgtttgcaaaatttgcaagaaattcgaccgcttatgattacatattttgaataattgcttcaccaaatgccgaggtggatagtaaagttgcatcagttagattgtcggcgaaatctgcggtaaccgttttattcgcaattgttttagatactgcatttatgactaagtcagccgcttcttcccaacctaaatgacgtagcatcatttctgcgcttaaaatcaatgaacaaggatttgcgatattttttccagcaagttttggggcgataccgtgggttgcttcaaaaatggctgcttcataaccgatatttgcgccgggggcgatacctatacccccgacctgagctgccaacatatcggaaatatagtcaccatttaaatttagggtggcaataacatcataatcttgaggatgaagtagcgcttcttgtaagaaggaatcggtaatgcaatctttgataataatgattcggcccgttttaggattaatcagctcatattctttattttcagatagagttgcgccgaattcctgtgcaacctcgtatccccatagcttaaaagcaccttccgtaaacttcataatgttgcctttatgcacgaaagtgaccgagctacgatcgttatctattgcatattggatagcggctcgaacaagacgtttggttccttgttctgatacgggtttaataccgataccacaatttttagtaaatcggatgttatttactcccatttcttgttgcaagaaattaaacaatttttcaacttgctctgaaccggcgagccattcgataccagcgtaaatatcttctgaattttcacgaaaaattaccatatcgaccaactcaggagatttaactggactcggtgtgccttcatagtagcgaacagggcgaaggcagttatagagatctaaagtttgtcgcatggtaacgttaagggaacgaatgccaccaccgacaggtgtcatcaatgggcctttaattgcaatatgaaatttttttattgctgctagcgtttcatcaggtaaccaaatgtcagttccataaagctttgttgctttttcgcctgcatagatttctaaccaatcaattttctttttagattggtaggcttgctgtaccgcagcatcaatcactttgatcatcacaggagtaatatctacaccaacgccatctccttcaataaaaggtatgatggggttatctggtacatttaatgaaccattatcttgtaacgtaataggtgtgccaaaaagcggggagtgaaggttgttaagcatagtttctcctgttgtatctgatgttccacaaaggagtaatatgcattaaacagtacaaaaaacaaacaccttgtcaaaggtaatgttataataaaaaattctattcaataagaaaaatctataaaaaaacggcagttatcactgccgtcttagataaaaagctaattattttacacgtgaaacgtattcgccagaacgagtgtcaacacggattacttcgccgatttgtacgaataatggtacacgaacaactgcacctgtgcttaatgttgccggtttaccaccagtacctgctgtatcaccttttaagcccggatctgtttcaactacttctaattcaacgaagtttggtggagttacagaaattgcagaaccgttccataacgtgatgatacattcagcttggtcaactaaccatttgtcgttgtcgcctaatgctttttggtctacagagatttgttcgaatgtttcagggtgcataaagtaccagaaatcttcgtctttgtatgagtaagtgtagttgtaatctacaacatccgctgcttcaacagaagtacctgatttgaagttgatctctaatactttgccagagattaatttacggattttagtacgggtaaatgcttgacctttacccggtttaacgaattcgttttcaacgattacacaaggttcgccatcttggatgaattttaaacccggtttgaagtcattagtgctgtaactagccattgtttcctcaattatttaacaataaattaacaaaatttgaaaacccactattggatttgtcaaaaagacccatataatacagtaattagcgaaagatctctaaaagtttttacgctatactttaaaaatcttatgaataagggaaactcaatgaaaaaagttattactctttctgcaatcattgctttatcgattgcaacggttgcggaagcaaagcgtggtagttcatctcgttcggtaacaggtaaaccgattgcagcacaaaaaacacaatctattcattcaaatacgcaaaaagatgcgacatttgataatacgcaaaaccgtgcgagcccgaatcaacagcctcaagcaaatggtggaaaccgtttagcgagcttcgcaaccggtgcggcggcaggttatgtattaagtgaaatgcttgcaccgacagcggctcaggctcaaacacagcaagcagcaacggtagcgcaaccgcaagcggttgaaaatgcaaaaaatattgcaaatagtgcaccggctacagtggcaacgtttaagagcattggtggtcaaattgacccgttcttagttgaaaaaacagatggctatcgccgctattgtattgccggtgtgcaatatttagctgcagcgcaaggtggtcaatctgcgccaatcgtgatggttaatccaaatggttcaccacttgcgtgtaatttagtacaataatttcttattttgcggaggggcgtagcattacgcccttttttgtttttctatcaatatttagggcagcccctatgagtagttatgcaaccagtccaaattgaatcttccaaaccccaatggctgattgaattagcgcaagcattcaatgatcctatcgctttattagaacatctagagctcaatccacaagagtttgaaacggcgataacggcacgtaagttattcgcgttgcgtgtgcctcgcccgtttgtcgaaaaaatgcgaaaaggcgataaaaatgatccgctttttttacaggcaatgtcggcggcggaagagtttttacagatgcaaggctttgtgaaagatcccttggaagaacagcatagccccgccccgaatattttgcataaataccataatcgtttgctgtttatgattaagaacagttgtgcgatcaattgccgttattgttttcgccgtcatttcccttatgatgaagtaaaaagcggtaaagcggtttggcaacagggattagactatattgcggaacatacagaattagaagaagtgattttctccggcggcgatccgctcatggcgaaagatagtgaattagactggctgatttccgctttggaacagattccgcatatcaaaacattgcgcattcatacccgtttgccggtggtgattccgagccgcattaccgagcaattatgtgaccgattatcaaaatctcgtttaaaagttgtgatagtaacccatattaatcatcctaacgaagtggatgaagtcttagtcgataaactcaatcaattgcgccaagcaaatgttgtgttactcaatcaatccgttttattgaaaggggttaatgataatgcgcaaacattgaaagcattaagtgataaattatttgatagcggcgtgttgccgtattatttgcatttgcttgatagagtggaaggggcgagtcatttctttattgaggatcaacaagcagcagaaatttataaagaattgcaacgcattagttcgggttatttagtaccgaaattagctagagaaattgcgagagagccaaataaaacattgatgggataggatagttcaacaagcggttaagttttgctgattttttgcaaattttgaccgcttatatgcaaaagggcgaataagattattcgcccttttttgttagtctcgattagaaattcgcattacgtggtgcacgtgggaatggaattacttcacggatgttttgtaaaccggttacataaacgattaaacgttcaaaacctaagccgaaaccggagtgtggaactgtaccgtatttacgtaaatcacgataccaccagtaatcttccggatttaagcccatttcaaccatacgagcgtctaatacgtctaaacgttcttcacgttgtgaaccaccgataatctcaccgattcccggtgctaatacgtccattgccgctacagttttaccgtcatcgtttaagcgcatatagaatgctttaatgtctttcggatagtttttcacaactaccggcgatttgaaatattcttccgctaagaaacgctcgtgttcagaagaaagatcgataccccaagaaaccgggaactcaaattctttacctgattttaataagatttcaatcgcatcggtataatctacttgtgcgaatggtgacgcaataaagttttctaaacgagtgataacatctttatcaatatgttttgcgaagaattgcatatcatctttacgctcttcaagtaccgctttaaacacatatttcagcatatcttccgctaattttgcattgtccgctaaggttgcgaatgcaaattcaggttcaaccatccagaattccgctaagtggcgagtggtatttgagttttccgcacggaatgtcgggccgaacgtataaactttgcttaatgcacaagcgtaagtttcaccgtttaactgacctgatacggttaagaaagactctttaccgaaaaagtcttggctgaaatcgactttaccttcatcagtacgcggtaagttttctaaatctaatgttgaaacacggaacatttcgcccgcgccttccgtatccgatgctgtaataagcggagttgcaacccaatagaaaccttgttcgttaaagaaacgatgaatcgcttgtgctaaacaatgacgaacacgagctaccgcaccgattaagttagtacgaggacgtaagtgtgccacttcacgtaaatattcgatagagtgacgttttgccgccatcggataagtatcaggatcttcaacccaaccaaccacttctacctgtgttgcgtgtaattcaactgcttgaccttctgccggagattcaaccactttaccggttacgataacggaacaacctgcggttaaacgtaaaacttcatcgttataatttgctaaatcgttattaatgatcgcttggatcggatcaaaacaagaaccgtcataaacggctaaaaatgataaacctgcttttgagtcacggcgggtacgtacccaaccacgtactgcaacttcttcgcctaccgcaactttgcctgataggatctccgaaactgttggaaatttagacattgaatacctcaatctttattgtgagttttatagaaaataatcgttcggtattttacaagaataagtaaggaaataaaggaaattgtcgatttttttctgcattttcgttgctagaacaagaatttgctaaaaattctttgtgcttttaattagattacaaattactgatgctcaaaaataaggcaatgtaagaaaaaattcaaagaatctgccatattatgcagttcagtataaatttctcacacagtgaattcatctaacttattgatatataagaaaaataaaataaattcaaaaaaattaaaaatttttaatatttttgtgaactttctgaaatccgtccagtcatacttaacgctaactgaacagaattcatgtaagtttttttcatttccttaggtaagacctcccccggcatcgctttcttggtgtcgggtttttttctatccataattcccttatttgtaaaatttcctgcaaatttaaccgcttagctatgctacaatgtgattaatttttcctaattgaagcgatcaatgaataaaaatcttacttttttcttttatgattacgaaagtttcggtgtgagtccggcgttagatcgtccggcacagtttgccggtattcgtaccgatagtgattttaatatcatcggtgagccggtgatgttctattgtaagcaaacaccggattatttaccctcgcccgaagcggtgatggtaaccggtatcactccgcaacagtgtaacgctgaaggcgtgtcagaaccggaatttgctgcacgtattcacgctgaattcagccaaccgaacacttgtattttaggctataacaatattcgttatgatgatgaaatgacccgttatacctttttccgcaatttctttgacccgtatgaatatagttggaaaaacggcaattcacgttgggatctgttagatcttgttcgagcttgttatgcactgcgtccggatggtattgaatgggtaacggacgaaaacggtgtgccgaatttcaaattagagaatctcaccaaagcgaacggcattgctcatgaaaatgcgcacgatgcaatggcggacgtttacgccacgattgcgatggcgaaattgattaagcaaaaacagccgaaacttttccaatttttctttgaaaatcgtggtaagaaagaaattgagaaaatgattgataccggtgatatgactccgttggtacacgtttccggtatgtttggcaacgcacgaggcaatactgcttggattgcaccgattgcgtggcatccgaccaatcaaaatcaagtgttatgctgcgatctatcgggcgatgttagtgccttattaacggattcggcagaagaattacgtactcgtttatacactaaaaaagaagagttagctgaaggtgttgcacccgtgtcattaaaaggcgtgcatatcaaccgctgtccgattattgcgccggcaaaagtgttgttgcctgaaaatgcggctcgcttaggcattgatcgtgagcgttgcttggaaaatctcaaattactgaaagcaaataaaagtttagtacgtgagaaagtaactgaaatttttatggaagaacgtcgtttcgagtcttctgcgaatgtggaaaccacgttatatgacggtttcttctcgccggcggataaaaataatatggcgattttacgtactttaccgccgcaagaattggcgcatcacggcttacagtttgctgatgaacgagtagaagctttactattccactatcgtgctagacattatcccgaaacattgagccgagcggaacagattaaatggcagaaatattgccatcagcagatagatgccaaatcggcacaatttgccgaagcgattgataacttattccaaattcatcacgataatccggaaaaggtaaaattattggaaaatttgaccgcttacgctgcacaaattgcggaatttcaggtagttaaacacaccgataatgcgcaaaatgaacagttggtttcagccttaaatcaagtggtggaacagggtatggataaagcggcgaagttggaaatgctaaaggcattaattaaataagtaggagaaaacggctatgcaacaacctttagaacatcacccgtttcaaccggtgttaccaacctccgcaaccgtagtgatgatggggacttttccgccgacaggtgaaaaacgctgtatggaatttcattacccgaatttccaaaacgatatgtggcgtattatgggcgcagttttctatgatgataccgaccatttccgtgttggcgatgaaaaacgttttgacccaataaaaatcgaagcgtttttacgcgaaaagggcattgcgttgtgttcatcagcacaaacagccattcgcttaaagggtaatgcttcggataaggatttaaaaatcgttgatccggtagatatgccgcaattattaaaaacattacctcatgtgaaatggatttttaccactggcggtttggcaacagatacgttactcggtttattaaatgaaaaaattaaagcaccgaaaacgaatgaatggattcactatccgtactgtgccgagcgtgaacttttcctttaccgtttgccatctacctctcgggcttatccattgagtttagctaagaaaatcgaggcgtatcgacaattttttattcaagcaggattactttaacgcatgaaatatgatttacattcacacagcaccgcatcggacggtatgcttagcccgaccgaattggttcagcgtgcgttagagcaacaaatcgaaatgcttgccttaaccgatcacgataccgtagcagggattcaagaagcgaaacacgcagcacaagggcaaccgattcgctttattgctggcgtagaaatttctatcgtttgggaaggtaaaagcattcaccttgccgctttaaacgtggatgagacgcatcctgcattagtagcattgttagataagcaagcgttactgcgtgagcaaagagcggtcgaaatcggcgaaaaacttgcaaaagccggcatcccaaatgcttacgaaggggcaaaagcgttagcaagcggagaagttacccgtgcgcattacgggcgttttttacatgaaaacggttatgtacgaaatatcgaacacgcctttaagaaatacctcgggggcggtaaaccagcttacgttaagccaatgtggtgtagtctagaagaagcgattgaagtaacgcatcaagcgggtggggtgatttgtattgcgcatccgttgcgttataaattaaccggacgctggattcgccgtttaatcgctgattttaaattagccggtggtgacggcattgaggttgccggctgcgggcaaacgccggatcaacgtcaattgatcgcacgttgggcaaaagagtttgatttatatgcttcggtcggttcggatttccattacccgaccggttggattgaacttggcagaggtctaacactgccggcagattgcaaaccgatttgggatttgttttaagggaaaagggcgtgttaaacgccctttgctttatctgaattattgcactttaaattggctaaactcagccattactttgcctaattcagctactctccgttcaatcttagccatatccggtttttcagcggtaatcgcaatccgcattaatccgagtgaacgttcaaatttaccatagtgagttaaactcatttcacggatcgttttttcgtatttcgcccaatttttaccgaaatgacgtgccgccattctaatttgcttaagctctttggtttgtaccgcacgttgcaaattgtaataaagtggggtcatttgtttaacgaaagtttggtgtttagctgcatagtccaccggattttgttctttttcaaaacggtatagatgcttagcgacattttctacgttggctagatccgtagttttaatcgcttggcttaaagcatccgctacgtttttacccgcttccgaatgatgcgcctcaaactgattaaaggcctgctgtaaagcggtcaaattttgctgagattttgtaacttcaccttttttaagttctgccattgcttcagagagctgtacgaataacgggctaacgtctactttcgctaatgtgattgaactagcaaagagcagaggaatgatgattaatttttttaatgtcatttgctattccttagagtaaatcgaataaggctttgccaagataatcattttcgtcttttacaccggcaaagcaggcaaataagccgctgccgatatgggtaatatattcgttcattttgtcgatatttcctaaagcgttttgcactttgataaattgctcggggctttgttggaacgaaataaacagtaagcccgagtcaaattgccctttatcgtcaataccgctggcgtaggagaacgaacgtctgagcatttttactcccgttttatgggcaaggtgtgtatgcgaaatttccggcatcactggattacctttatcatcttttttcgccagatcgaatttttcaaattcgtgtttataaccaagtgccgcccctgaatcacgataacgaccgaaggtttcttcctgcgatcttaaatgtgtacgatcccaagtttctaagaacattttgacacggcgaaccactaaataagaaccgccttgtagccaaccgttttgtacccaaaccacattatcctgatcttttaaactctcggcatttgcggtaccgtctttaaatgcaaataagttacgtggcgtttcattatttaaaaatgagttaaagcccatttgcgaccatttcattttgacttcaccacgaacagcccgcactaaattacgcaccgcatggaaggcaacttggggatcgtcggcacaggcttgaatacaaatatcgccaccgctaaattcagcttgcaattgatcacgaggaaagtgtggcaaatcttgtaattcggtcggcttatgtttttcaatacctaattttttaaagaaagcagcactgatgccaaaagtgagtgtgagatgttgcggctctaagctatccgcttcaccggtatcagcaggcggaacataggcattattgctatagggttttacatttttaccttgtgtcaaattacggctataacttgtccaagtctgaaaaattgctttcacttttgcaatatcagtagtatctaaatccaagacgagaaaatagatatgtttttgtgcaggggtgacgataccggcttgatgttgaccataaaaaggatattgattctgtacgtgtgagctaagttgtcgtgattctaaagcaaaagtaggagcggacaataagcctgctcctaccaatgcggtgttttttagaaaatcacggcgagaatgtgtgtctgccataatttattcctaccttatttctctaatagaacacctaattgggctaacggttcgccaagttgatttaccgcttcggctagtgctttcacatccgcttttgacagagtgttataagctacgtaatcgtaaccgtttttcgatttattgtgttttgccagtaaggtattgactgcagcaaagcgagcggcaatttccgccgaaagtttcgcatccgttttgtctaattgcggtttaaagatttcatagattttttctgccccttcaatgttggctttaaaatcgtaaaggtcggttttagagaaaatttcctcttcgccggttactttagtagtggacacctcatttaataaatcgactgcaccggtgatcattaattcaggcgtaacttccgccgtcggaattttcgcacgtaattctttaacgtctttcagtaactgttccgcaatagcttttgtacctttggtcgtatttttttcccataagactttttcgattttatggaaacctgaccaatctttttccgttttaccttcttcggttaaatcggcaagacgtgcatcaatacgaggatctaaatcaccaaaactttcggcaatcggttctgaacgttcaaaatacattcgtgcaagcgggtaaatttgcttcgctttttgcacatcgccttggtttaaataatcaacaaacttttccgtatccatcactaattgatcaatctgttcaaccacaaattgcttatatgcttcggtttctttcgttaaatctaaagcaaaagattgggtcgtgagtagtaaacccgaaagcaaagctgctaattttgttaactgcataaaaatgtccttttagctaaatatagtgttgcaactatattcttattaataatcattatcaaattaatactggtaattttgttatctaattcacatttttatttgcaaattttcttaaaaaattcaccgcttgcttatgttaaaataacgataaattttctcggataggatgttatatgagcaagcaaggcaaaccttttattttacacagcccatttaaacccactggcgatcagccatcagcgattgctaaattgaccgaagggttaaatgacggattggcgcatcaaacattacttggggtaaccggttcgggtaaaacctttactattgcgaatgtgatcgctcaactcaatcgtccggcaatgttgcttgcgccgaataaaacgcttgccgcccagctgtatgcggagatgaaagccttcttccctgaaaatgcggtggagtatttcgtttcctactatgactattaccaaccggaagcctatgtgccgagtagtgatacctttatcgaaaaagatgcgtcgattaatgaacaaatcgaacagatgcgactgtcggcaaccaaatcattccttgaacgccgagacaccatcgtagttgcctcggtttccgccatttacggtttgggggacgtggatgcctatatgcaaatgatgctgcatttgcaagtgggggcgattatcgaccaacgagagctcctcgctcgtcttgccgaattgcaatatacccgcaatgatcaagcatttcagcgttcgactttccgtgtgcgtggcgaagtaattgatattttccctgccgaatcggatgaaattgcgttacgtgttgaattgtttgacgatgaaatcgaaagcctttcgttgtttgatccgcttaccggacatagcttgggcaaagtgcctcgctatactatttatccgaaaacgcactacgttacccctcgtgaacgcattttgaatgcgattgaagaaattaaacaagagctggtggaacgccgcgagtatttcatcaaagaaaataaattgttggaagaacaacgtattactcaacgcgcgcaattcgatattgaaatgatgaatgagctgggctattgctcgggcattgaaaactattcacgctatctgtcgggcagaaaagagggtgaaccgcctccgacattattcgactatatgccggcggacggcttgctgattattgacgaaagccacgttaccgtgccgcaaatcggcggtatgtatcgaggcgaccgagccagaaaagaaacgttggtgcaatacggtttccgcttgccgtctgcattggataaccgcccattacgctttgaagaatttgaacgccttgcaccgcagacgatttatgtttcggcaacaccgggcaattatgaattagaaaaatcaaacggtgatgtggtggatcaagtggttcgcccaacgggattattagacccgatcatagaagttcgccctgtggccacgcaagttgatgatgtgttatcggaaatccataaacgagtggcggttgatgaacgagtgttaattactacgctaaccaaaaaaatggcggaagatttaaccgattatctcgatgaacacggcgtgcgtgtgcgttatctgcatagcgatattgatacggttgaacgggtagaaattattcacgacttgcgtatgggaatgtttgacgtattggtcggcatcaacttattgcgtgagggcttggatatgccggaagtgtcgttagtagcgattttagatgcggataaagaaggctttttacgttccgaacgttcattaattcagaccatcggacgtgcagctcgaaacctgaacggtaaagcaattctttacggcgaccgcattactaactctatgcaaaaagcgattaccgaaaccgaacgccgccgagaaaaacaacaaaaatacaacgaagaacacagtattactccgcaagccctcaacaaaaaagtaggcgaattgctcgacatcggacaaaccaacaagccgaaacgaggcaaacaagcggtcaaagtcgaagaaaaatttgcaaatacctacaaaccaaaatcccgcaaagagctggaaaaagaacttaaacagctcgagcaacaaatgcgagatttcgctaaagatctcgagtttgaaaaagcggcagcggtaagggataaaattgggcagttgaaggcggtgttgttggaggtttagtatgagtaataatctttttgaaagagaagcagatatgcaactttggttaaagaataaacttgaagaatgtgagggattaagcgagcttattgtaaatatagaacaactagaagaattctttccaaacaatgaggaagagcaaaagatttatactagttttaacaattgcttagaagcattacatttaaatactattttctcagcagatgaaaacatctctcttgcagataatgagattttgaaacccgattttgtactatatgcaccagaatctcaaggagtagtgattgttgaattaaaaaattctgcaaatgcagctagacaagcaggaacagaaatcagtgcatattcagcggaattaaaaaatcatcttttatttttatctgatggcgatatttttaatgtcattatttcaccagagtggagaactttattaaagcgtaatgtattgcatgaaattttctggaagcataggaatgttttatgtttaaagcctattaagctggaagatggagaaattaaattagaaatcttatcaattaaagaattattaaataccccattaaaatataatattcccgaggagtatctgtgtggttacctaatctgtctatatgacgatgaactttataagaaatctgataaatatgaagcaaactttgacactaatattaatcaaatgaaggcggctttatctcttatggcaacagagggagagcataaagcaagtcatggatttgcttttttatggaaagataacggattagttccaaatggttattctctttgcccatataatataaccttgatgaatattgctccatttcaatcagtggagcgttttttacagaatgatagcgatttatctaatatgcaaagaagatggcttgaattagttagaaaagaagatccaacagggcatggctatacttttaatagtattacaggtataggagaaaaatttttatcatctttttgtaaacctagatgtgaaggttatgactattggacagtccataaaagaataatgtttgaaactaatcgggctaatttagttgcttttgttggatggggtatttttaaatctgtatttaatgagaaattattaattgaatatagtaaaggtaacttgaatacgtctatagacagccctaaattaggtttagagactatagatactattattgataagtgtcatgaatatattaatccttcttggctttagatgaaaacgacgtttaagagtagatgaaggactatctctcaatagcggatgcctcctgatgcgtgcttgtttggtaagatatgccaaaagtattatcgagagttttatcttacaactttctcctttctctgatttttgtaaagctgtgactttacttaaatctgtctctctcccgcaggggagagagtcgtttaacaagcggttaaatttcttgaaaactttgcaaattgcaaaaatctagcaaatttggccgcttattttccgtaaacaataaagaaaacacctaaaagttagtttaatttacgatttcatcttaaattaaactaatttttcctttacttgtattgtattttttagtttaatttaagatgtaatcttagattaaacttatttttgcctatgaacttatattctcgtcaaatgaagccgttgattgaggctttaatcaaacaatttcctgcggtgttggtgacaggtccaagacaagtgggaaaatcaacgctgttacagcatattagtgaagattatcaatatgtgacctttgatgatcctatgttgctatcaatggcaaaaaacgatcctggcctatttatgcttaactattcaggtaagttgattttagacgaagtgcaatatgcaccggagctattttctagcttgaaattggcgattgataagcaaaaaatgtcagggctgtatttgctttcgggatcgcaagcctttcatttaatgcaaaatgtaacggaaagccttgcggggcgagtggcggagttgaaattacaaggtttctcattgcgagaaattcaacagctcgatttttcgttgccttttattcctaaccaagattatctttccgcccgagaaaaagctgctcaaccgattgaaaacatttggaaaattattcatcaaggttatatgccacgcttgtatgagcaagaaacgaactgggaaatttactatgcttcctacgtttccacctatattgaacgagatgttcgctcgcttacgaatgtgagtaatatcacggatttcactcgttttatggtggcgattgccgctcgtagtggcgaactgctaaattacagcaatgtggcacaggaagtgggcgtatcggtggatactatcaagcgttggacggcaattttggaaacatcgggcattatttatttgctcaagccgtacagcaataatcatctaaaacgagcgattaaaacccaaaaagtgtatatgttggatacgggcttaatggcgtggctaaccaaatggctcacgcccgaaactatttcaaaaggggctaaaagcagtcaattctttgaaacttttgtcgtgagcgaaatcattaaatcgttctataacaaagggatagagccgccgatttatttttatcgggatactaaccaaaaagaaatcgatttactgattgaatatgaccgcactttatacccggtggaaattaaaacatcggcaagtcctgataaaaaaatggtcaaagccttcggtattttgaaagataatctgcccgaatcagaaattaaaatcggcacgggcgtaattatcaaccaatatccgcaacgcctttggttagcggaagatttggttgccttgcctgtttggtatatttaagtttaattttacagcttcccttctctctgattttcgcaaagctgtgactttgctcaaatctgcctctctcccgcaaggggagagagtcatttaacaagcggttgaatttcttgaaaactttgcaaattgcaaaaaattcagcgaatttgaccgcttgttgtatgttttaatgtaggcggattgtattagaaatacgttatagcacattacactctcgccccttgcgggagagagacagcttgttgaagcgtgtagcgaaacaagcagagagaggggaaataccttaaaagtcagtttaatttacgatgttatcttagattaaactgactttttctttttttatgcagtttctttgtgaaatttgcgagaaatcagaccgcttgcttgtgttagaataaacagacatttgaagaggagaatagtatggatcttgcctacctagctgaattgccgagagaagaatttattgagcgtagaaatcgtgtatttgagcaaatgcaggataattctgcgttggtggtgtttaccgaaactgagaaacgccgtaatagcgattgcgattatttgttccgacctgatagttatttctggtatttaaccggttttgccgagccgaaatcggcattgttgctgattaaaaaagacggcaaaaatgagagcgtgatgtttgtgcgtaaaaaagatccgctaatggaaacctggaatggtcgccgtttgggtattgaaaaagcccctgaagctttgaacgtagatttggcgtttgatattgaggatatttcccgtgtttttgcagaaaaaacgcaaaatttgaccgcttgttattatgccaaaggcttacaggaatggggcgatagcgtggtggcggaacagtttgttgacgtgattgactggctgcccatgttgtcagaaatgcggttgattaaatcgacagcggaaattgcattgattcagcaagcctgtcatatttcgggcttggcacatattcgtgcgatgaaacaaactcgtcctaatcgttatgaattagaaattgagggcgaaatccagcacgaatttacccgctttggggcgagattccctgcttataattcgattgtggcaagcggtgaaaatgcctgtattttgcactacaacgaaaatgatcaggtattaaaagacggtgatttattgctgattgacgcaggtgcggaatttgctcattatgcgggcgatattactcgaaccttcccgattaacggtaaattttctgaaccgcaacgagagatttatcagctcgtgttggacgcaatgaaagaagcggctaaatggcttgttccgcaaagttcgatcaaaattgctaatgaaaaggcagtacaagtgctaaccgaaggtttagtccgcttaggtattttaaaaggcgaagtggagcagttaatcgccgataaagcctatcgtcaattttatatgcacggcttggggcattggttagggctagatgttcacgatgtgggcaattatggcacggagcgagatcgcccgcttgaaatcggtatggtgctaacccttgagccgggtttatacatttcaagtgatgcagatgtgccagagcaatacaaaggcattggcgtacgaattgaggataatttattgattaccgaatatggtaataaaaatctgacaagcggctgcccgaaagaaattgctgatattgaagcgattatgaatgttcagtagataggaaaagtaaataaccacagaacgcacggaatacacgggaaagttatttgtatgacgtgaaaactgtggttttttattacctaaaagctatacataaaaataaccacgaactatacagcgttcacagaataaattttccgtgtattcagtgtagtccgtggttttacaaaatagtgattaaagcacttttacaatcgcttcgcaaagggcatcaatgttttggtcggtgatacctgcaacattaatacgaccagaacgtaccacatagattgcgaactcttcacgtaggcgatccacttgttccggtgttaaaccgctaaatgagaacataccgttttgttgtgcgataaagtcgaaatcttgttttgcgcctttctcttttaataattgcaccatacggttacgcattgatttaatacgatcacgcatttcatctaactcagcgacccattctgcacgtaacgcttcatcacctaatacacgagcaactgtgcttgcgccgtgtgatgccgggttagagtaaagcacacgaataattgatttaatttgggtgaatgcgttattggctacttcggcattttctgcaactaaggtaaatgcaccaacacgctcgctatataaaccgaagtttttcgaatatgagcttgcgattaataattctttgtggtttttcacaaatgcacgtaaaccgtatgcatcttggtctaaaccgttgccgaaaccttggtaagcgaagtcaaataacggtaaccaacctttttctgcagaaagtttcgctaatgcatcccattgttcaggggttgggtcgataccggtcgggttatggcagcaaccgtgtaataacactacatcgccggcttccgcttggcttaaatcggcgagtaagttatcccaatctaaaccgtgtatatctttattgtaataacgatagcctttcacatttaaaccgaccgcttcggcaattgcattgtggtttggccaagtcgggtttgaaatccagatattttttgctgacgtttggcgtttgataaattcagccgcaatacgtaacgcgcctgtaccacctaagctttgtgcggtttttgcacgacctgaagcgataatttccgcccctttaccgaataaaagttcttgcgtgtaagaattaaaagcttgtacgccgtcaatcgtgaggtagtttttattcgtttcttgttctaacaataacgcttcggcttttttaaccgctttcacgataggcgttttaccttccgcattcatataaacaccgataccgagattgattttccctgcacgttgttccgctttaaatgcttcgcctaaacctaagattggatctgccggagcagcctgaatatggttgaacattgacatgtgttgtcctctaaaaagttgtgtttgaaattagaaatacttatacaattcattagctattttagcaatagaaaagcagtctgtttttcaaaattttttgcaaatttcagaagaaaacagaccgcttgtacttatttgagtttattaattgcccaatctaaccccgaatggaaatcgtcggttaaatgcggatgaagctgttcgagtaattgaaccaactgagcttgttccggatgacataaattaatatgtccaactttacgtccagcacgtacttctttaccataccaatgtaattgtgagaacggcacttccagccacgcattattgtgttcaataccaattagattgaccatcacgctcggtgcaatttgtttaagttgcggtgtcggcaagtcaagtaatgcacgtaaatgcaattcaaactggctaattgagcagcctagctgcgtccaatgtccactgttatgtacacgaggagcaagttcattaattaataatttctcgcccaccacaaaacattccatcgccattacgccgatatagtctaagtcttgcataatcgtgccaagcatttgctccgcttgggtttggtaagtttgctgatttggtaaattcacatcacaaacggagtaacgcaagatgccgttttgttgcaagttatggctaatcggatagaaacgggtagagccgtcacggaaacgagcgccgacaattgaaatttctccatcaaacggaataaatttttctgcaatcacttcaccgaaaagatccggcgtgatttggtcaatgctgtcttgcgtcacaatccattgacctctgccgtcataaccgccggtacggcgttttaccaccactttttcaccgacattgctgaatacgctttgccattgctcggcagattccaataattgccatggtgaagtagaaagctgaagtttgtctaacagtgatttttgggtgaaacgatctgcggttgtgccgaatacgtttaaattgacaaagtttttatgattaccgagtaattgggtgagtggcgtttctgcccaacgctcgatttctgcggtaatgatactgttttcttcaaggtcaaaaaccggtgcatcaaaagcaagcggttttacttcaatatcaagcggtgcgccggcatagcgtaacattctgccgagctgaccgttaccaagcacataaattggaggataaatagcacttttttgcattttttatgattccgtttgcggaaagttagagactccgatttgcaatttttggggtaaatttgaccgcttgtacggctcggaaacctcaaactttctgtgtttatcagagattaaaaatattcggcgagtggtttactcaagttttggtttagcaagactaacaatttgatacgtgctttttgaccgcttaaaccggtagtgaaaatgacgttttgttgtttaagttgtttaccgccgcctaaatagtcgtatacatcttgagtgacaccgttaaaggcacgagaaactaacacaacaggaatattagctcgtaatagcgcatctaaaccggctaaacaactcggcggtaaattacctgcgccgagagcttcaatcaccacaccatcacagccgtgatgagcaagctgttcaagtaagaaactatccattccggcgtaactcttgacgagctgcacgttggtacgggtaattgtttgagctgggaagcgttcatattcgattaattgttggaaatatagcacgcggtttttagcaattaatccgcaaggaccgaatgttggcgtttggaatgtcgctacgttggtcgtatgcgttttagtcacaaatttagcgttatggatttcatcattcatcaccactaatacgcctttgtcttggctttccggacaaagcgcaaccaaaatcgcactttgtaagttaattaaaccgtccgaacccaattcgttacttgaacgcattgcaccggtaatcgcaaccggtacatttacattcagtgctaggtcaaggaaataagcagtttcttctaatgtatccgtaccgtgggtaatcacgataccatcatagttttcttcattaaccgctttttcaatacgtgttttcaatagcaaccaatgctgtaaagtaatatgcggtgaaggcacattcagtacagattcttggctgagctgagcagggtggtttaaacgttctaacgcggcaagtagcggatttttctcagaaggcgaaaccttaccgtcttcgccttcactcattgaaatagtaccgcctgtatgtaggattaaaagtttctttgtcatgaaaaatagattaattacgtggatctggattgtctaataccgattgcgtttgttcattgcggaatgcgtgtaattttttcgctaattcaggatcaaaagctgctaaaatttgtgcagctaataaaccggcattcgctgcacctgcaggaccaatcgcaagtgtaccaaccggaatgccttttggcatttgaacgatagagtataaactatctacgccacttagcatcgaactttttaccggcacgcctaacactggcacaatcgtttttgccgcaatcatacccggtaaatgtgccgcaccgcctgcacctgcgataatcactttataaccgttttgttcggcactttccgcaaatgagaaaagcttatccggtgtgcggtgtgctgaaaccacctcgacatgataagcaagcttaaactgatctaaaatttgtgttgcttccgacatagttgcccagtcgctttttgaacccataacaatcgcaatttcaggtttttgtgacatagttgttccttgataaatgaaatagaggaaagtattcgaattatagcatgataggcaaacgattgctttagaaattatgctaactgaaaacaatctgaacaatgtaaagaattatccacaaagcacaatttaaagctattaaagggatgacgaaatgtgttactatatgcgaccattttttcaaattcatgtagttgcaatcagaatcggagatagaatatatatgacgagtagtgcgaataaacgttcagtaatgacccttttttcagataaaaatgatgtgtatagccatcaagtacgaatcgtattagcggaaaaaggcgttccttacgaaattgaaaatattagccctgatacgatttctgaagatttaatggaagtaaatccttacggtaatgtgcccacattagttgatcgtgatttagtgttattcaattcacgtatcattatggagtatttggacgagcgttttcctcatccaccattaatgcctgtatatccggtgttacgtggtaaatgccgtttaactatgcaccgcattgagcaagattggtactcgctgattgatatcgtaaataaagatcctgaatcaaaagaagcgaaaaaagctttacttcaattacgtgatgaaatgttagctttaggcccagtatttgcagcaacaccttattttatgaacgaagagtttagcttagtggattgctacgtagcgccgttattgtggaaaatgcataacttaggcgtggaatttaccggtgctggcagcaaagcgattaaagcatatatgactcgagttttccaacgtgaaagttttgtgcaatcaattggtggggccgcgcctaaacacttaatggatgaaaaagactaatgaaacctttacgcccttatctttatcatgcttattacagctggattatcgataatgacaatacgccgtacttgctagtcaatacagattatccggatgtggatgtgccaacagaatttattcgtgacggtaagattatcttaaatattgcacctcgttctattggacaatatattgtaaccgatgaagcaattcgttttaatgcgcgtttccaaggaatgttacgagacgtatatattccacttggtgcattagaagccatctatgcacaagaaacgggggacggtattatgtttcaagatgagccttattacagcgagcaagcttatcatgagcgtaatgttatttctcacgaggaaacggctaaacctaaagttgtgaagaaaaaggcaacgcatttgaaactggttaaataattcattgattgttaagcggttaaattttatcgaacttttgcaagttttgagacaaatttaaccgcttatttatatgcgaaataagccctattggctgaatataagaaaaaagccaccatgaaaaggtgactttctttgtttttaatattatttacgccgttgtttgtgcaataatcggagattgtgaacgcgtcacacctgccatatccgtaagttcatccatacggttaatcgtaatatacttaccttgcacagtaatcataccacttttttggaaacggcctaataaacggctgatcgtctcgatggttaaacctaaatagttaccgatatctccacgtgtcattgttaaacggaattcacgtgccgagaaaccacgagcagagtaacgctgagacagattatgcaaaaatgcagctaatttttcttccgcactcatttttgaaagtaaaagaatcatttcttgatcgcttttaatttcattactcattaagcgcataatttggtgccgaattttaggcattttaccagcaagatcatctaaaatatcaaatggaatttcgcaaatcattgacgtttcaagcgcttgtgcgaaaccaacgtgtttcatattagtaatcgcatcaaaaccgactaaatcaccaggcaaatgaaatgctgtaatttgttcttcaccgctctcgctgatggtataacttttgattgtacctgaacgaattgcataaatagaacgaagttcatcacctgattggaaaataatctgagatttttggacaggtttttttcgctcaataatattatcaagctgagttaattcatgttcgttcagtgtgaatggtaaacagagctgactaatactgcaattttggcaatgaatagtacaagctgtacgattcgtattttttacgtcagaaacgattttcataagacttaccgtattgtaaagtaggcaaaagtttgatttggcgcaaatattatcactaattattgttagaataaagatatatcagaattaatttaagtgaaaaagttattttcaatacagcttttatttttattttgaagaaaactgactccattatttgaaacattttttcaaaaatgagatctagttcaaactttaattggaaagaatatgctagtatttgaaccaaagataagatttagacaggcaaataaggagtctattatgtacaaacatattttagtcgcagttgatctttctgaagagagtctcattttactccgtaaaggtgcggatcttgctgaaaaatgtggtgcgaaactctcgcttatccacgttgatgtcaatttttcagacctctatacaggtttaatcgacattaatatgtcttctgtacaagatagtgtcgtgcaagaaaccactaaagcactcaacgaactttcttctaaaatctcgtatccggtatcagaatgtttaaatggtaccggcgatttcagtcaagtattggaagaggcagttgaaaaacatcaaattgatttattaattaccggacatcaccaagatttctggagcaagtttatgtcttcaactcgccaagtgatgaataatgttagtgttgatatgctcgtcgtgccgttagcagacgaataaaatttttataagaaggttttataacccgaccgcttgaaaacatctccgttttcaagcggtctttttgatgcattatattaaaaataaattaaaaagttttttacttgccaattagcaaagaaaagaaaaacgtgtagaatagtaaggcttacaactaacattattatttgttatacatttttagagtgctatttaaatgaaaacaacttcagaaattagacaatccttcttggatttcttccatagtaaaggacataccgttgtaccaagcagttctttggtaccagaaaatgaccctaccttattatttactaatgcagggatgaaccaatttaaagatgtttttctcggcttagaaaaacgaccttatactcgagcaactaccgcgcaacgctgtgttcgtgccggtggtaaacataatgacttagaaaatgtaggctatacggcacgccatcatactttctttgaaatgatgggtaacttcagttttggtgattactttaaacaagatgcaattcaattcggctgggaatatttaacttctccgcaatggcttgggcttccgaaagaaaaattatatgtaacggtttatgaaacggatgatgaagcttatgacatttggaataaaattgtaggtgtaccaactgatcacattattcgtatcggtgataacaaaggcgcaccttatgcttcggataacttttgggcaatgggcgatactggtccgtgtggtccttgtacagaaatcttttatgatcacggagatactttctggggtggtttaccaggaacgccagaagaagatggcgaccgttatatcgaagtatggaatatcgtattcatgcaatttaaccgtcaagcagacggtaccatggaaaagctaccgaaaccatctgtagatacgggtatgggtttagagcgtatgacggcagtaatgcagcacgtaaactcaaattatgaaacagatattttccaaacattgattaaagaagttgcaggtttattaaatgtaaccgatttagacaataagtctttgcgtgttgtggcagaccatattcgtgcttgttcatacttaattgcggatggagttattccgtcaaatgaaggacgtggttatgtattacgtcgtattattcgtcgagcagtacgtcatggtaacttattaggtgcaaaagaagctttcttctacaaattagtacctacacttgcaaccgtaatgggacatgcaggtgagattttaacccaaaaacaagcgcatattcagaaaacgctaaaagcggaagaagagcagtttgctcgtacacttgagcgtggtttagcattattagaagatgctttgactaaagtagaaaataatacgctttcaggtgaagttgcatttaaactttatgatacttacggctttccattagatttaactgccgatgtatgtcgtgaacgtaatatcacgattgatgaagcaggttttgaagcagaaatgagcgctcagcgtgagcgtgctaaagcaagcagtaactttggtactgactataacaatgtgatcaaagtagatggccaaactgactttatcggctacgataacttagaagctcaagcgacagttgttggtttatttagtaatggtaaggcagttgatacaatccactcaggcgagtcagcagttattattcttgatcaaactccattctatgcagaaatggggggacaagttggtgatagcggtttaatttctacagaaatttgcgaatttactgtaagtgatactcaaaaatatggtcaagtttttggacatatcggccaattaacatcaggtagtttggctattggtgataaagttactgcacatgtggaaataaaccgtcgtcaggcaatcacagcaaatcatagtgcaacacacttattacattcagcattgcgtgaagtattaggtgatcatgtagcacaaaaaggttcattggtgtctgaagatgcattgcgtttcgatttctctcaaccagaagccattaccaaagcgcagttagaagaaattgaacgtatcgtaaaccgtaagattcgcgagaatattcaagtagttatcgaaacaatggatattgagtctgcgaagcaaaaaggtgcgatggcattattcggtgagaaatatggtgatgttgtccgagttgtcggcatgactgagttctcaattgaactttgtggaggtacccacgtccaacacacaggcgagattggtttattcaaactagtttctgaaggcgctgttgctgcaggtgtaagacgtgtagaagccgtaacaggcgaaaaagcaatggattggttacataatcagcaaagagtcattcagcaaagtgctgaattattaaaagcggatagtaactcattagttgaaaaaattcagcagcttcaagataaggctaagcgtacagaaaaagagcttcaacagcttaaagataaatttgctgcacaagccggttctgaattagcaaaacaagctagtcaaattaacggtgtaaatgtcattgttcagaaacttgaaggtgtagaaactaaatcgttacgtacgatggttgatgatcttaaaaatcaatttgaaaatgccattgtcgtttttggtagcgtagcagatgataaagtaaacttaattgttggtgttacaaaggatctttcaagcaaagttaatgctggtgaactggtaggtgctatggcacaacaggttggtggtaaaggtggtgggcgagctgatatggcgatggctggcggttcagaaccacaacatcttgattcagcactcaaatttgcgcaagaatggattcaagcgaaactttaataatttaaaagaggcaaggctgagggataaagccttgccataaaagttctatatgagtgtaatagagcttttaacccaggagattaactatgcttatactaactcgtaaaattggggaaagtttactaataggggacaacgttgagataactgtactcagtgttcgaggtaatcaggtaaaattgggtgtaaacgcaccaaaagaaatctcagttcaccgtgaagaaatttatcacagaattaaagcattggcagatgatactgctgatgagaagcaagaataaatatttctccaattagtagagataaggatcatgagtaaacttacttgttctaaagcctatgatattcgtgagcaattcagtattgaattaaatacggatattgcctatcgaatcggaagtgctttgggccaatttctgaatccgaaaagtattactattggtgatgatgtacatattaacgagtaatgaacttaaaagtacaactcaccattaattactagattcaggtgtaaatgttattgatttggaattaacggatacggaagatgtttactttaaacttcatttttgaaaatgatagatggcggtattcaagtaaccgctagctatatccgaaggactacaataggatgaaattggggcggattgacgcccaattagtgccgatacaggtttagtggaaaataatttcccagtagcaataatgtggtgtatatgcacagaaaagagtgcaaggagaatatgtagagcatctgttttatatattgacgcacataaacttacctcaaaaaaaacggtgggaatagctgcaggacattgtatgttgatgctattaagcacaattcaaggcaaaaatgtaccggttgaatttgttaaggttcataataatccgaatgggtctttccaaaatggtattcctaatctgattcttcatgaaaatcaagcagattctattcaagctgagtgatcaaataaggcagatatcggatgcatttgatggtggttttagctgttacttcttttttgatgaaaaagccggatttttaaagttacaatgtagcaagcttattgtctctaatttacgtagttcgaatacagaactcgtagccagtttaaatttagagatgaggggcggaagcaattaaggtaagaaaaaaataggtgaaactcttgctttacttcttcggtaattgttagaatttagacaaaattagaccgcttgcataaattgctagcggttttttatcaatgcgcataaaagcgtatatttattgatgcaatcgcatctatttataaggattatataatgaaagtgattattcctgtagcgggtcttggtactcgtatgcttccggcgactaaagcaattccaaaggaaatgttaacaattgcagataagccgttaattcaatatattgttaatgagtgtgtggccgcaggcattaaagaaattgtgttagtaacacattcatcaaaaaatgctatcgaaaaccattttgatacgtcttttgagcttgaaacaatgcttgaaaaacgtgtaaaacgtcaattattagatgaagtacgttcaattgtaccgaaagacgtaacattaatgcatgtacgccaagggcaagcaaaaggtttaggccacgcagtgttatgtggtagagcggttgtgggtaatgaaccgtttgctgttgttcttcctgatgtgattttagcggatttcacagcaaatcagaaaactgaaaaccttgcagcaatgatcaaacgctttaatgaaactaaacatagccaaattatggttgctccggtaccaaaagaagatgtaagtagctatggtgtagccgattgcgcaggtgtggaaattccggcgggtgagacagcgaaaatcgtgaaaatggtggaaaaaccaagtgttgaagaagcaccgtctaacttagcggttgttggtcgttacgtattctctgaaaacatttgggatctgcttgaaaaaacaccagtgggcgtaggtgatgaaattcaattaactgatgcgattgatatgctaattgagcaagaaaccgtggaagcattccatatgactgggcgtacttttgactgtggtgataaattaggctatatgcaagcatttactgaatatagtttacgtcatgataagtttggcgatgattttaaagacttcatcaaaaaattagctaaaacattataattttaaaaggaaggcgcttttatagcgcctttcttattaccttctctaaaacataattatttaaattgtgtttgctcttcaagatcctcaattgcctttaagcacttcattttacggtattctgtttcttgaatctgcctttctaacaagactttgtcagcttctgaagcattataacgcttttcaactaaccagctaattttctcatttaatgctcttaatgctttccggtattcatttaaacggcgggtaggcgcaagcgaatgaatatttttagggaattgaaaggatgactgaaagagcagagtatcattactttgcgttaattttaaggtcttaacagcttgtgctaatgcttcatattgatgaaaaagtttagccgcatatgcattagcataatcttcagaatattgtttatttaattcatttgctgtttgtgttatttcttgaacaaaaaatgatactttttgtttggatatagagaatatattttcagaaataatcacctcataatcataaaaaggtaaaaaaatatctaattgtttttgtactaaaattggaaagtttctaatcatatcggtgtagttaagagtgatttttaactattataaattgatttttaatgattgtaaccgtttgcttttgtgtaaaaactctactaaaaaataagaattttctaaatttgtgagctttatcacaaaaaaaataactttttttgtaagtttaataaatatcaaagttatacaaaaaatgacttttatatcaataacttagataaagcttaaatttggagtgttttatctttttttaagcaaatttcattttgatttgtaaatgttttttgcaacctgttgtttttaaatggttttttacgcatttgtgtttggagtgtagcactattgacaggttatgttgattttgccattattcgctcgcaatcacatttactgaagaattcttacacggtaaatgttagttttggaaaattactcttacaccttatcgagagtaattttaaataaacttaaaattaaaaattaaggtgaacattatgaaaaaaactctagttgcattagcagtaacggcattcgcagcatcagcttcagctgtaacagtgtatgacgcagaaggtactaaagtacaggttgatggttctttacgtttagtgcttgaacaagcaagttcaaaaactaaatatgcaaacggtcaaacagtaaaaaataaaaatgcgcattcacaattacgtaatgctggctcacgttttggtgtacgtgtaaatcatgacttaggtaatgatttctatgcattaggtcgtttagaaattcgttttgataaaaacaattcagatgatcaatttggtgatttatacgctaaacgtgcatatgttggtttaggtagcaaacagtatggtgaagtaacatttggtcgtcaattaacaattgctgatgattacggtcaaacagatgattacgaatacggtatcgtaccatcatatatcgcaacttcaggtaaccaagtgatccgctatgactataaaggtattgaaggtttacagatcggtgcaaactataactttgcagaaaaacgtgatgcggctggtgaagtattaccgaatgaacttaaaaatgcatatggtttaggtgcggtatatgaaacgcaattaggtggtaacacatttaatgttgaaggtggtatcggtcgttctaactatgcaacaggtacaaaccacaaacattaccaagatggttatgaaatcgcattaggctatactattggtgatttaaaattagttggtgactttggttataaatatgaaaaagatggtagcgaacgtacgaaagcattcttcgtagcaccaggtttccaataccaagtgatcccagcttcacgtatctatggtaactacttatatgagcgtgcagaaacaactgtagctaaagctgattctgcaaaagagaaaactcacggtttcttattaggtgttgactatcaattccacaaacaagttgtagcatttgttgaaggtaaatacgttcaaactaaagactacgatgcagtgggcaatggttacagctataacggcaaaacaactgataaagctatcggtgtaggtatgcgtgtttactggtaatattcttgccaacgcttaactaaataagcttaaaaccccaatggtgaaaactgttggggttttgttttttatgaaatattaactacggaatacacagagtacgcggaaggaatggggcatgtttgttgatgtaagataataaaccaaactatatatatttcggcaataatcaaaggattaagctttctgtgtaatccgtgtgttctgtggtggttaaataaagaaagtagtacaagctaatatttctaaatatataaaataattttctatttaacataatctacattatgcgaagtaaaatgattgtaactttgatagcatatctagtgttattctttttagttttaatgctatctataagcggtcaaatttgtacaggcatttgcagcttttgatactagttaatattaactctataatgcgagttacatataagatcaccaaatgcatttggttaatatatattacaaatttgttgttatctgtacatatggttatagaaataaaataaatccttatcatttgtttgttgcatatggtagactttattttagtttaaaaaagattaaggtagcattatgtgtagtttattaaacaaatatcaaagatcgagtgcgattccatccttattatgcgacttttataaaacgtctcatcgaattcagtatcctgaaaatacgcaaattctgtatagcacctttacccctcgtagcaataaacaagcgccttatttaatccgtgttgtttcttttggagtccaagcatttattactaaatatttaatccattactttaatgataatttttttaatcgcccaaaagctgaggttgtatcagaatattcgcaatttattgctcaaacactacagattaaggattccggtgaacatattgcgcaattgcatcaattaggctatttacctattcgtatcaaggcgattccggaaggaaaatcggttgcaattaaagtgccggtaatgacgattgaaaatacacatccggatttcttttggttaaccaactatttagaaacgctgattaatgtctgtttatggcagcctatgacgtctgcatcaattgcatttgcttatcgctctgctctggctaaatttgcagagaaaacctgtgataataaagctcatattccatttcaatcgcatgacttttcaatgcgaggaatgagttcgttagaatccgctgagatgtccggagccggtcatttaaccagttttttaggtacggacactatcccagcgatttcatttatcagcagttattatggttcacagaacttaattggcacttctatacccgcttctgaacattcggttatgagtgcgcatggtgtggatgagctacctactttccgctatttaatgcagaaatttccggatagtatgttatcaattgtagcggatacgaccgatttttggcataacattagtgttaacttgccattactaaaagatgaaattatggctcgccctgcgcatgctaaggtcgttattcgtcctgatagcggtgatttttttgcaattctttgcggaaattcgaccgcttgtaatgagcatgagcgtaaaggtttaattgaatgcttatgggatatttttggtggaacaattaataccaagggctataaagttttagaccctcatattggcgctatttacggtgatggtgtgacttacgataaaatgttatccgtgttgaaagggcttgagcaaaaaggctttgcttcaagtaatattgtgtttggtgttggggcacagacttatcagcgcaatacgcgagatacgcttggttttgcggtaaaagcaacttcaattacaatcaatggtgctgagaaagcgatttttaaaaatcctaaaacagatgacggcttaaaaaaatcacaaaaaggtcgagtaaaagtaattgctttcgatcattatattgatgagttaactgctaaggatgatttttctgatgatctattagaactgatttttgaaaacggtaaattagtgaaacagattagttttgatcaaattagagcgaatatcaatatgcaacgataaaaccacggaatactcagatagattagataaaatatcggtgtaatccgagtattccgtggtaattaaaaataacgcaaattatttcgttaaatcaacttgatatacagcaaaaccaatttcgtctgtgccgactaaagtcattggatattgcgctttttctttaataaatgctgctgctttttcggttggagaagtttcaaaacgaacatctaatttagcttttgcattaattggtgcaatgcgccagttcttgtctgccgttggtacaacatgaccgtttgctttactttctgccgaaatgtaatttgctaaaatctgacgattttcatcaggtgcagcaaaaacgatatggctatcaccagtacctgggaatttaccgccgtatgcacggtaattgttggtcgcaattaagaactcttgcttcggatcaactggtttgccattgaaagtcaaattaaccacacgatgtgcattttcattgattaatttgcattcaccatcgtaacgcgccggttgagtaatatcaaattggtactctactccatcaattacgtcaaagttataagtacggaaaccggtccaatctaataaaccttgaggttgtgagctagccggatcaatttgtttgaacataccggcactgcactctaaccactcttttaactctgctccagtcgcttttactaccactaaagtatttggatagagatataagtctgctgcgttacggaaagttaattgacctttatccacttcggtaaagcctgttgggtcatttttacgaccgcctgctttaaatggcgcgccggcacttaatactggtaagccggcaagttccggtaaacctttaacaacaacgttttctacataagctttttgcgcttggtttacaatttggatcgttggatcatcttgtactaacgctaagtagctatacatattatctgtagctttaccaatcggttgtgacacaaatttacgggttgcttcgtgtgtttctttaagtaatgttgtaatttccggatgattttcaatcgttgcttttttcttttcagcgtcatagatcgggcgcagtgccgcttttccgtctacaactgcccatttaccgttctgctccgctaaacttaaatcaaccacgctgaggttattaccccaatagccggccatactttcaggaacacctttcattgtgccttttgcaatatcggcattcggtgatttttcaaattctttatttgggaataagcggtgcgagtgaccaaaaataaccgcatcaatgcctttcacatcagcaaggtagaatgcacagttttctgctccttctttatatggttcatcagaagggcctgtgtgtgctaatgcgataatcacatcagcacccttcgctttaacaattggtacatatttttcggcagttttgacaatatcacgtgcttcaactttgccttcaagatttgctttatcccaaaccataacttgtggtggaacaaagccgatataaccgatttttaatgtttgaggtttgccgtttgtatcaacgatagctttttcttgaataaagtaaggctggaagaacggttcgtctgtacctggttttacaatattagcattcacgatcgggaactgcgcttgtttaatcacgttatttaagtagcttaaaccatagttaaattcgtggttaccgagcgtaccgacttcatatttcattgcattaagtgccttaatagccggatctgcttttccttcttttgaacccaccgctgcttggtaatcggcgattgggttaccttggattaagtcaccgttatccaccaacacactatttttcacttctttacgagcttgttcaattaaacttgccgtacgagtaaaaccgaatttttcggttggtgcgtctttataatagtcaaagtcggttaaaaaactatgaatatcagttgttgcaataatacgtaaatccgcattattacttgccccaccagctgcaaatgcaaaacgttgtgtgcctaacacaagcattgcgcttgcacctaattgaataaaacgtcttctatttagcatagaaacactcctccttgtttgacataaaaaattgcaaattattgtaagaaaataaccgcttatgctctagcgcttttttcctatttcgtgatcgagtgcaaataaaaattggtcctttattcagaatttgtactttaatttgaaataaaacgctggctcgaatcaaattttaagcagtttttcactattattttggaataggaatttattttatgtgccgaaaagtgtattcttataaagacgtacacacgccactgtgtgtcaatttatcaatcctttcataaacaaagaaaaaaaggtgtttgacatgtctaaaaacttaatccttatccttaactgtggtagctcttctctaaaatttgctatcttagatcctaaaacaggtgatgaaaaattatctggtttagcagaagcatttcatttagaagacgctcgtatcaaatggaaattaaacggcgaaaaaggcaatgcagatttaggtgcgggtgcagcacatagcgaagcattaacattcattgcaaatgaattattatcggaagaattaaaggcaagcattggtgctatcggtcatcgtatcgttcacggtggtgagcaatttacttcatctgtagttatcaatgacgatgtagttaaaggcatcgaaaacgcaattcaattcgcaccacttcacaatccggctcacttaatcggtattcaagaagcgttccgtattttccctgaattaaaagagaaaaacgttgccgtattcgacacggctttccaccaaacaatgccggaagaagcattcttatacgcacttccatacaaactatataaagaaaatggtattcgtcgttatggtgcgcacggtactagccacctattcatcacatcacaagttgctgaattagcaggtaaaccggtagatcaaacaaacgcaattatttgtcacttaggtaacggtggttctgtatctgttgttcgtaacggtaaatgtatcgatacttcaatgggtttaacaccattagaaggtttagtgatgggtactcgttcaggtgacatcgatcctgcaatcattttctacctatacaaaaacttaggtatgtcaatggagcaaatcgaagatacattagtgaaaaaatcaggtcttttaggtttaacagaagtaactagcgactgtcgttatgcagaagataactatgacgatgcatcaaaaccggaagcaaaacgtgcattagacgtatacagctaccgtttagcaaaatatattggtgcatatatggcaatcttaggtgattctcacttagacgctatcgcatttactggcggtatcggtgaaaactcaggtcacgtacgtgaattaaccttaaatcacttaaaattattcggtatcaaattagataacgaacgtaacttagcagcacgcttcggtaaatcaggtacaattactgctgatgactcagcattcaaagcagtagtaatccctacaaacgaagaattagtgattgcacaagatacagctaaattagcattataattccaaggggcagacaattctgcccttttcctatttcacataaacggattaaatatgtctagaacgattattcttattccaaccacaaccggcgtgggtttaacaagtgttagccttggtttagttcatgcattagagcaaaaaggcacaaaagttggctttttaaaacctatcgcacaaccgattaccggtgaagatactttagaccgctctacttctatcattaaagctgcacaaaccacagaagtgggcgaaccatttatgctaagcgaagcggaagcgttaattggtcaaaaccaaagtgatgttttattagaaaaagtggttgagcgtcaccaacagttatcaaaaaataatgaagttatcgttgttgaaggtctaattccaacacgtaaaaactcatacgcaaatagcgtaaactatgatattgctcaagcgttagatgcggaaatcatcttagttgcggcaccaggttcagataaaccggcacaattaaaagaacgcattgaagcggctgcttcagaattcggtggtcgtcacaaccctaacttattaggtgtgatcatcaacaaatttaatgcaccggttgatgaatctggccgtactcgcccggacttaacggaaattttcgattcattccaacatagcacacaaaatgttgctgaagtggaagcattatttgcgaaaagtccaatcaaattacttgcttgcgttgaatggaaatcggatttaattgcgactcgtgcgattgatttagcgaaacacttacacgctgcaattatcaatgaaggtgacatccaatctcgtcgtatccgtggcgtaacgttctgtgctcgtagccttccacatatggttgatcatttcaaagcaggtagcttattagtaacttctgcggatcgtccggaagttttagtagctgcatctttagcggtaatgaatggcgttgaaatcggtgcaatcttattaaccggcggttataaaattgaaactccaattgcaaaactttgccaacaagcatttgaatctggtgtaccggtattccgtgtagaaggtaacacatggcaaacagcgcttagcttacaaagctttagcttagaagtgccagtagatgataaagagcgtattacttcaatcaaagaatatgttgcaagccaattcaacgctggtttcgttgatgaagtatctaaagcggcaactcgtgctcgtcgtttatctccagcagcgttccgttatcaattaactgaatatgcgcgtcaagcgaaaaaacgcatcgtattacctgaaggtgatgaacctcgtaccgtgaaagcggcggcattatgtgctgaacgtggtatcgcagaatgtgtacttttagcaaatcctactgatgttcaacgtgtagcggaatctcaaggtgtggtattaggtaaaggtatcacaatcatcaatcctgaagaagtacgtgaaaactatgttgctcgtttagttgagttacgtaaaaacaaaggtatgacagaagttgttgcgcgtgagcaattaacagataccgtagtacttggtacgatgatgttagaagctggtgaagttgacggtttagtatctggtgcggtacataccacagcaaatacaattcgtccgccgatgcaaatcatcaaaactgcaccgggtagttcaattgtttcttcaatcttcttcatgttattaccagaccaagtgcttgtgtacggtgactgtgcggtaaacccagatccgacagcagaacaattagctgaaattgcgattcaatctgcagaatcagcgaaagcattcggtattgacccacgtgttgcaatgatttcttactcaacaggtacatcaggttctggtgcagacgtagagaaagtgaaagaagcgactcgtatcgcacaagaaaaacgtcctgatttaattatcgatggtccgttacaatatgatgcggcggtaatggaagatgtggctcgttctaaagcgcctaactctccggtagccggtaaagcgacggtattcgtattcccagacttaaataccggtaatacgacatataaagcggtacaacgttctgcagatttagtgtctatcggtccaatgcttcaaggtatgcgtaaaccggttaatgacctttctcgtggtgcgttagttgacgatatcatatatacaatcgcattaactgcgattcaagcaactcaaggttaattataatccttttaaagcaaaatgccctcgtttgagggcattttttatatacaaagaaaaaagcgctgaatctcagcgctttacttattgcatagaggttatgcttattctttggttaagtctttaacttcagtttccgcagtaatttttttcaccgcttcaatacccttctggcagctttgcttagttgcatagccttccccacctgttgcgacagtttggtgattgccagattttaaacgccaacggaattcacctttcgcatctttataaatttcaaaatacatatttatttcctcatttaaaaccaaacatcgtgtttggtagcgacaagattacttatttaatgaaaaattgcaaatttttcgcaaaaaatgaccgcttatttacgtaaatttgctcaacaagtagatattttgtctgttatgatgttgttaattcttattacaagaggataacaaaatgtctgcacaacaacttattgcacaacttactcaaattgtaggtaatcaacatattattaccgaaccggctaaaacagagtcatatcgaagcggttatcgctttggttccggtgcagcgcttgcagtcgttagacctgccaatttattggagttttggcagattttaaaagcttgtgttgcgcatgatgtgattgtgattaaccaagcggctaatacgggcttaaccggcggctctaccccaagtggcaatgattacgatcgtgatattgtgattattaatgcgatgcggattaacggtattcaattgattaatcatgcagcgcaagtagtttgtttacccggttcgacactgaatgaacttgaaaatcagttaaaaccatatgggcgagaacctcattcggtcatcggttcatcttgtattggtgcttctgtaatcggtggaatttgtaataattcgggcggtgcattggtacaacgagggcctgcttatacggaaatggcactttatgcgcaattgaatgagcaaggcgaactggaattgcataaccaccttggtattgagttaggttcgacaccggaagaaatactaacgaatttgcaaatgcaacgttaccaacaaaaagatattcagcaagattgcggaaaaggacatgatcacagttattgcaatcatgttcgccaagtagatgaaaactcccctgctcgtttcaatgctgatccagctcgccattttgaagcttctggtagcgccggaaaactcgctatcttcgctgttcgtttagatactttccctctcgaaaaagataccgccgtattttatatcggtaccaatcaaaccaatgttcttaatgatttacgtcgccatatgctgagtcaatttgaacaattaccaatttctggtgaatacattcatcgtgatgcctttgatgtggcagctcgttatggtaaggatacattctgggttattaaaaaatttggtactcaatggctaccgaagttgtttgctctaaaggcaaatgtcgatcgtctcagtaaaaagataccattcttaccacatcatctgagtgataaggtcatgcaattgatctcaaagggattgccggaacatttgccacaaagtttatggcaattccgtgatcgttatgaacaccatttaattatcaaaatggggggtaaaggtgttgatgaagctcgtaactaccttaaacactattttactcaacatgaaaaaggcgacttttttgaatgtaatgcgttagaaacgcaagcagcgatgttacaccggtttgcggttgccagtgcggctattcgttatcgtgcaatccatgaacaagaagtggaagacattgtcgcactggatgttgctctgcgccgtaacgatccagattggtttgaacaattgccggcagaaattgatgcacaaattagtcataaactctattatggccattttatgtgtcatgtgttccaccaagactatattgtcaagaaaggctgtgattgtgtgaagttagaacacgaaatgctgaagttgttagataagcgtggcgcgcaatatccggcggaacataatgtcggtcatctctatgaagcaaaaccagaattacgtaagttctataaggctctcgatccgaccaatagctttaatccggggattgggcaaaccactaagaaaaaatattggcaagaatagcttttacgccattcattaaataaacaagcggttagatttgcaaaattttttacaaatttaaccgcttgttttagctattgcccaacagaagcattaatacgatcagcaaatttaccaatacttataccgaaattatttgatctattccaatccattaatgtacggaaattactggttactaagaatgctctgccgacctctttatccggacgaaccaaccataattttttaccacttagtgcgcttaattttgcgctatcttgtgcagttgggtaagcgagatagactccccaagattgccactcgcctaagctttttgcttggttctccgcaagtcctgaaaatgacatatcaattgggctagataacttaacttcaattccccaaggcaatctgtcttcccatccgactgtagaaagataagaagcaattgaagcaaacgcgtccgcttcattgttccaaatatcttttttaccgtcaccgtcaccatcggcggcatagcttaaataagcagtcggcatgaattgtgtttgccccatagcgcccgcccaagaaccttgcatttcataacgattgatcgtgccatcatctagcattttcatcgcattgacaaattcttgcgtgaagagcttttcacggcgaccgtcaaaagcgagtgtcgctaaaacggataacacatcaaaatcaccttggtaacgaccaaagctactttccatgccccaaagtgccataatatattctttttgaacgccgtatttctggcttgctttggttagtggtgaaccaaattcataccaattctcaaccgccgtattcactttagcctgtgttagcactttgttgagataattggttacaccattaggattcggctgcggtgtaggcgcatttggatctctttttcgcccggcttgctgctgatctagctgtaccgcacgtgcattgtaatgaatgaaacgttgtgcattgagtgttttatccgaaacgccggcagccgctgctttttgttttagaaaatgtacgtaatcattaaagttattgagcgtacgagctttgttatattgcgcatcaagcggtaattcttgaaatgaatttttatttgaacagcctgcaattaccaaggtaatcacggtaaaaggaatggctaaaaatttgaatttcatattgttctttgcattaaagcggtctgctcctacttttgcagaaacaaaccgtaaaaactaaaggtttaccattcgactcgggcgaatcacattatcattggtgatttccgctactccgaggaattgaccatgttctgaaaataaacgaacttgaccgtaagtttgatcgatattttcaaatttgactctttgaccgaaaccgaccgctttggtttgctctgctgttagatttattttaggcagactttctacggcggtatctaaaggtaaaagatattgatccaatgcttcaagcggttgattttcacttaaattttgcaaatctgcatagctcatcatcgcttcaatcggataatttgcaaccgccaaacggcgtaaaaccgtaacatgtgcgccacaacctaatacttcacctaaatcatccaccaaagtacggatataagtaccttttgagcaatgtacttctaacgtaagataaggcgcggaatattcgataaagcgtaactcaaaaatcgtaatcgggcgcgcttctcgttccaccgtaatgccttgacgagcatattcataaagtggtttgccgttatgtttcaatgcggaaaacatagttggaacttgtaaaatatcaccacgaaattgatctaacgctgaaataatttccgtttcacttacgttcacagcacgggtttcaacaacttgcccttctgcgtccgacgtatcggtacgttcacctaattttgcagtaacttgataacgtttgtccgaatcaagcaaaaattgcgaaaatttagtcgcttcccccaaacaaattggtaacattccggtcgcaagcggatctaatgcaccggtatgccccgctttatttgcttgaaataagcgtttgaccttttgcagaatatcatttgacgacattccttgcggtttatctaataaaaatacgccgtgaacatcacgcccttttttacgaggtctagacacctattcttcctctttatgtttagcttcgtcgtttttaatcacattcgatacaaggttagacatacgcatgccttcaactaatgattgatcgtaaataaaacgaagctcaggcacgatacgtaaacgcattgctttaccgactaacgaacgaatatacgggcttgctttttctaaacctttcataccctgttcaattgcgctttgatcattatcgaataagaaagtcacaaagatttttgcataagccaaatcacggctcacttccacatccgataccgttaccataccgatacgaggatctttcacctcacgttgtaaaatcacagcaatctctttttgtagctcttgcgctacacgatcactgcgtttaaattctctgctcatgttttctccaaaatgcaaatgaggcaccacgaagcgcctcaaaattttgttaggattataccctaatttgtcgttattagcgatgttacgccaaaaacaagcggtcagtttctactaaatttttgcaaatttatgcagaaatctgaccgctttcactaatgaaacgaaattagattgtgcgtttcacttcaactacttcgaatacctcgatttggtcgccgacttttacatcgttgtagttcttaacgccgataccacattccataccgttacgcacttctgaaacgtcgtctttgaaacggcggagcgattctaactcgccttcaaagattactacgttgtcacgtaatacacggattgggttgttacgtttcaccacaccttcagttaccatacaaccagcgattgcaccgaattttggatgacggaatacgtcacgtacttctgctaagccgatgatttcttgtttgaactcaggctgtaacataccgctcattgccgctttgatttcgttgagcaattcgtagatgattgagtagtaacgtaagtcgatgttttccgcttcgattacacgacgagccgatgcgtccgcacgaacgttgaaaccaaccataatcgcatttgaagctgcagctaaagttgcatccgtttcggtgataccacctacaccagaacctactactttcacttttacttcgtctgttgaaagttctgctaatgcttggcaaattgcttctaccgaaccttgtacgtccgctttaacaatcacattaagttctgcaacatcacctgccgtcatattgctaaacatattttcaagtttcgctttttgctgacgagcaagtttcacttcacggaatttaccttgacggaataatgctacttcacgtgcttttttctcgtcacgtacaacggttgcttcatcaccggctgccggtacgcctgaaagacctaatacctcaacaggaattgatgggccagcagaattgatgtctttaccgttttcatcacgcatcgcacgcacacgaccgtattcgaagccacaaagtacgatatcgcctttgtttaatgtacctgattgcacaagaatcgtcgctaccggaccacgacctttatcaagataagattcgattacgacaccgcttgccataccttctttaaccgctgtaagttctaatacttcagattgaagaagaatcgcttctagtaattcgtcaatacctaaaccttttttcgctgatacaggtacgaactgaacgtcaccaccgaatttctctgaaatcacttcgtgttgaagtaattcttgttctacaagatcaggatttgcttccggtttatcaattttgtttaccgcaacgacaatcggtgcgcctgccgctttcgcgtgctgaatcgcttcgatagtttgtggcattacaccatcgtctgccgctacaacaagaacaacgatatccgttgctttcgcaccacgtgcacgcatagaagtaaacgctgcgtgtcccggtgtatctaagaaggtaatcatcttaccgtcatcggtttcaacgtggtaagcaccgatgtgctgagtaataccacccgcttcacctgctgcaactttcgctttacggatatagtcaagtaatgacgttttaccgtggtcaacgtgacccatgatggttactaccggagcacgtgttactttttccgcatcaacgtcacgatcttccattactgcgtcttcaagttcgttttcgttacgtaaaataactttatgacccatttcttccgcaacaagttgagcagtttcttggtcgataacttggttaatcgttaccatctcacccattttcatcatcgttttgataatttcggttgcttttaccgccattttattagcaagttcagcaacagtgatggtttcaccgataacgacatcagctttatttacttgaacaggtttagtgaaggcttgttgtaatgcagaacctttcttcgcatttttacctttacctttcacatctttttggttacgacggtctgcgctacgctcgtttttatcttcacgatcgccttttttcgctttatttacaccgcctttaccacgaccgcgatttgcttcgctacggcggtcattatcacgatccgcttcacgtgcatagcttgaagtaaaacgatcatcttcaaattcttcaccgctttcagccgcttcttcacgtgcaatttccgctaaacgacgcgcattttctgctgcgcgtttcgcttccatttccgctttttgacgcgctaattcttcttgtttacggcggagttcagcttcttcttttttcttcgcttctttttccggatcaagcgctttttcttgttttggttgttctacttttggtgttgccgcttttggcttgctgttaggcattaccggtacagcgtgctttttcgcttcagccgcttttgcttcttccgcttttttagctgcctctgcttccgccttcgctttttccgctgcttctttttcagcttgtgcttttgcttccgcttcttgttttgcttttaaagcagcttcttcttgcgctttttttaccgcttctgtatcgattttacgagatttgcgcacttcaacttgaactttaccgtcagccactgtagtttttgtgcgacgttgtaagctcaattttttaggtgcttcgtttttaatttcgttatcactcatagttatactccttacaacgattaactaaaccaacaaatttgacgagcagccataattaattcgcttgctttgtctgctggtaattcttcaatatctgaaaggtcatctgtagcttgttctgctaattcttcaagcgttgtgatacctttttcagccagtttaaatgcgatatgacgatctaaaccttctaagtttaataaacgatcttcaatatgcgcttgttttaatgcttcttcttccgctaatgcttttgcagtaattgcattttttgcacgagcttgcaactcttccactaaatcttcatcttcaagaccatcgatagaagttaattcgcttaccggaatgaatgcaagttcttctaggctagagaaaccttcatctactaagatttgtgcaaattcttggtcgatttctaatgaagttacgaataaatcgataactttattatcttccgcttgatgcttcttatctaagtcttccgtagtcattacgtttaatgtccaaccggttaattgggtagctaaacgtacgttttgaccattacgaccgattgcttgcgcaaggtttttgctttcaacggcaatatccattgcgtgtttatcttcatcaactacgatagaacttacatcagccggtgccattgcattaatcacaaattgtgccggattatcgtcccaaagtacgatatctacacgttcaccgcctaattcgttactaattgcttgaacacgcgcacctcgcataccaacacaagcacctactggatcgatacgtttatcgtgtgatttaactgcaattttcgcacgagaacccggatcacgagatgcacctttaatttcgataacatcttcaccgatttccggtacttcaagtttaaataactcttctaacataatcggttttgcacgtgttacgaaaagttgtgggccttttgactcaggtttaatcgcatataatacgccacgtacacggtcacccggacggaagttttcacgtggaagcatatcttcacgtacgattaccgcttccgcttggttacctaaatctaaaataatttgatcacggtttactttcttaacggttgcagtgatgatggtatttaattgtgaacggaattgatcaataactttgttacgctcagcttcacgaattttcgtactgatcacttggcgtgcagtttgcatcgtaatacggtcgaatggaattgaatctacttcatcttcaacgatatcgcctaattgcacgctagggttttcgtattgcgccgcttctaagctgatctcacgtgtcatattgtgtacttgttcaaccacaatccaacgacggaaagtttggaaatcaccggttttacggtcaattaccacacgcacatcaatatccatttcttttttctttttagtcgaaatggctaatgccgtttcaagcgcttcaaagatagcttcttttggcagtaacttctcgttagataccgcttctgcggctaataaaatttctttactcattttctgggttaaccttctagaaattaaaaactggaactaagtttgctttttgaatattaccgaatgcaaattggcgagcttcgttatccaccgagagtgtaattaaatcgccttctacgctctctaatttaccctgccatttacggcgatcgaacatcggaatacgtaaatgaatcacgacttcttgtccgataaaacgttggtaatgtgcaagcgtaaagagcggacgatctaaacccggtgatgaaacttctaagttgtatttatccgcaatcggatcttcaacatctagaattgcgctcacttgacggctcacatcactgcaatcatcaatggttacgccgccttctttatcaatatataaacgtactgttaaaaaacgccctgctcgttgacactcaataccgactaattcgcagcccattgattcaatggtgtcagaaacgagttcttctaatttttgttctaaagttgccaaggaggcctcctaaatgacagatataaaaaaagagccttaaccagctcttttgatacgattattatgtaccagccacaaaaaaaccccagacggaaaaccgtggggctttaagcggtttgttttatacaaaattttgcgaattatgttcgttatcgaaaattagcaaaggctatataaaacaaaactcacagttttaatcaaaactgtgagccttaaaactggttgcgggggccggatttgaaccaacgaccttcgggttatgagcccgacgagctaccaagctgctccaccccgcgtctgatgtggctcattatagagatttccaaaaccaatgcaagcacttttttcaaatttgtttttgtttggttaacaaagcaacactaaggtgaacttaattcatcggcaatcacttccgcttgtcttaatacaaactcaactgcttccacttgtttatcgggcggatatttgaataatcttaacgctcggcggatttcaattcgcattttggctcgcacggaatctttaaattgccagtcaatggtggcagattggcggatcttctcggtgattgtcattgccaaatttttcaagacttcatcgcctaattctcgcaccgcactttcgttttgagccaaagcgtcataaaaggcgatttccgcaggcgttagccctaatttttcgccacgagccaaacgttcggcaaattctttccccattgccaataattcgtccaaaatttcaagtaacgtgagattttgattgcgatatttattcatcgcctcttttaatcgagtttcaaaatctttttgcacggaaagattactcgctcctttttccttaatttccgcttgcagataacgttgaatcgcctcaagccacaacgcttggtggcggctatttttcactttttctaaaaactgctccgacaaaatctcaatgttcggctgatctcgattaagcaacgcaaataagtccactgccccatcggcttttaccgcttggtttagcaacgccaccaatttaagctgtcggtcggcagggttaacggtcgaatttggctcacgttttgcaagcattgctcgcaccgcatcaataaacgctaattctcgctgataaacctgcacttcaggcaacgaaccacacaaaccgtaaccctttttcgctaatcttaccgcttgcaagaagcgatttttgcgtggcgttttatccttcgctttgtcatcaacaggattttgctgatcgaggcttaaaatatggtttgctgccgttagaatttgctcaaataacgccatttcatcgtgaatttttaatgcgtcaaataatggaaaaatctggccgcttacagggctggcaaacattcctcgcacaatatcaaggcactctaaaaatttgagtttgatttgctcaatatcttgcgtcatttcgcccttaccatttgcattggtatattcagccgttgccgatttaagttcgtccaccaagcccacataatcgacaattaacccaccattttcacggcttttattgcggaaaacacggtttactcgggcaattgcctgcattaaattatgccctttcatcggcttgtcgatatacattgtattacaacaaggggcgtcaaaacctgtcagccacatatctcgcacaatcacaagtttgaacggatcactcggatctttaaaacgtttttcgaggcttttcttctcttgattgccataaatgtgcggttgaaaatggtcaggatcacttgctgagcctgtcatcacaattttaatcgccccttcgttgagattatcgctatgccattcagggcgaagggcaatgattttgtcatacaacaccacacaaatttgacggctcattgccacaatcatcgccttaccgtccattaaagcggtgcgattttcaaaatgttttaccaaatcttccgctaattttgtgagccgtgtatccgcccctattagcttttcacgcaagcggaaactgtaactttgctcatcgtccgaaaataaatcgtccgcctcacgcaccgcatttttgaaatcttggctctcgttaatcggaatttggcgagcctcatacacaatcggcacggttgcaccgtcttccaccgcatcttgaatgtcgtaaatcgacacataacgcccaaacactgcttgagtatctttatcttcaagggaaattggcgtaccagtaaagccaataaacgaggcattcggcaacgcatttcgtaaatgtttggcatagcccactcggtaagtagcggattgtgttcccatagctaaatgttggctaaaaccatattgcgaacgatgagcctcatcgctgatgacgataatgttgtggcgatcattcaaaatcgggtgctgattttcgccctcgtgcaagccaaatttttgaatggtggtaaaaataatgccgcctgtttcacgcttggcaagctcggttcgcaatgcttctcgtccgtctgcttgaatgggtgtttggcgaataagatctttacccgctgaaaaggtcgcaaatagctgaccgtctaagtcgttacggtcggttaccactacaatggttgggttgcgtaagcttggctcggcttgcaattttgccgcatagaacagcatcgaaatggatttgcccgaaccttgcgtatgccacattaccccaattttgcgatcgccttgctcgcttgcggcaagcaacgtggactccactgcctcattcacgccatagaattgatgataagcggcaatttttttgattaacagaccgctttccgaacgctcaaatagcacgaaattctgcacataattgagtaaattttcaggcgacatcaagccttgcaccagccccgccaattcattctcaaacggcactcgctgtttagctttttcgtccaccactcgccacggtgtaaagcggtcaaaattggcggttaaagaaccaatgcgagcgtgcgtaccgtcactaatcacaagggcttggttgaaaacaaagagatcgctaatttccgctttataagtttggaactgctgaaatgcctgttgcaaatcggctgattctgtaagcggatttttcaactcaaacaccaccaacggcaaaccattcacaaagcaaatcacatcagggcggcggttgcctttcacccccttaatggtaaattgatttaccacatcaaactggttgttgtgaacattttgaaaatcaatcaaacgaacaatgtcgattttctgctcatcattttcacgatactccacctgcacgccttcacgcaacaagcggtaaaattgctgattacgctcagttaaatcggtaatatcgcccttacacaccaacgccaccacgtcattgaccacattactcggtaactgcggatttagccttgttatcgcattcgccaacaccgatttcagcaccacctcttcagctcgctcccgctcaatctccgaaccaaaggtataagcccaccccaagccttgtaatgcctgaatacaggcttgctctattgtgttttcgttgatgtgcattgttgttccctctttttttgcgatcgagatcgaaaaattaaaaattattgattttaatatttctaaaaaatgtaatcgttgtattacggacgcacgcagtgcgtccctaccgatcacattgaattaatatcaacgtgaattttgaataaattatttttaaagccccaaaatttcaaataacgtgatcgtagggacactctgcgtgtgtccgattttttcaaattcatcatattttttaattacatattatgaataaaccaaatcgaaaatctgtccgtgtaaaatgggattcttaccaaaatggttgttatttcgtcacagtttgtaccaaagacaaataccattatttcggcgaaattatgaataatgaaatgcaattcacacatttaggattggaattgcaaaaaatcatcgaaaatacaccgcttgtgcgaaataaccaatatatcgaaatccctatttacaccataatgccaagccattttcatctgctgattatcattaattcggatattgaccgacatcagcattattttggtgttcaacggaaaaatttagcctccgtcattcgtggtataaaatcaaaattaaccagttttgccattaaacataatctttcatttcaatggcagtcaggtttccacgaacatattgtcaaatcagaacgtgcctttgagcatatttacaattatgttcaaaataacgtcattaactggtcacaagattgtttccattccccaaaatctcattaacctgaccagtagggacgccacgctgccgtccattacgatataaaattatcgctgatttgaattttggtgttgggggatttgggacgccagcgtggcgtccctaccagtcacgttgaattaatatcaatttatttataatgtttcttgcagtcgctcctgttctaatgaaatatattcttcataaaatcccttatatgcctcaatatcttgttcaaataatgctaatgaatatgaaatactcaatccatcaggaaattttggagcatattcttcatctaaaaattgattaaattctgcatagtcttcataccgtattctatgatttatccgaagatcatctgaaaaaatatatagatgaagaataaatcctaatactgaatttgttgtatgtgaaacaaataaagctaaatctttggttggctttttatgttcaatatcttgaccgtgtgaagcataacaaccaacactatttctaatttcaccaatatattgaataactccattcaaacgagaaaataattgattaatatgctcataatcagggtggttatttatatttaatgaatttaatgtttcaataaccaatttaggaaattgttcaggaattctatttcctttatccgtcagaatagttttacaaacaccttcaattaatgctttacaaatttctatacttaatgttggatttctttcaaaattatttaaaacaccatcaacctgtgcttgataaactgaaaatctcggagatttagcaaatagttcaattatccattgcattaagtaaatctccattaagtagctttggtaataataaatctcgtatagaaatcaattttttgttctcatctgataaattacggacatttttgtaaaaatccattattaatttattaaatatatcatttatttcattattagcttttataaatggaatactattcatattggcttgatttaacttcatctgaactgcaccagtaacataagccttaatattagttaaactcatgaagatcatcagttgctcagttgaaactccattcttaccttgtaaaacatgggcatggttattaacccaagattttccccatatatactgaatgaatggcgtcccatcttcttttaaaacagagccatcctctccaatcaaaagataaatatcatcaaaaatactttcatcaacataatccattactgatgttgcaccatagtaaggaatattccctttacgctttgctctatggtgtttagataatggaattcgccttttatcaaaacattctgatacctcaccaaagctcgtgacttcccaccccacaggcacgccatcttccccaatctcatcaggaaatgcgtctgcgattgcccagagtttttggtattctgttgggttttcggtttgcaagcggtgtaattcttcactgtttttgcctgaaatagcttccattgcggcgagattaccaccttgcattttggctttgacaggctcgaaatccacaaaccaacttttgaaaatcgcttgggcgatttgttctagggtttggttggtttgggtgttgagttctattttttcgtctattggacttaaaatatctactatatttttttgaatttcataattaggtatttttaattctgtatcttttaatacttgccctgaaatttctttaaatgttgaaccagtagatcttgcctctaataagggaacattatgcttcaataaataataataaaattctggaatatgtccttcttttaaaaccaaacttttaaagccttgatttgtggctaattcattttttgcaatagcaacatatccaataggtgctcgacttgtaaataaaacacttccttttggtaacaatttagcactactattctttaatcctaattctgttatatttctttcacctttcgatatataacggtaattatatcctgataaatccttaggggttatccaagatatatctccattaaaatatgtatcttctgatgatttaggcgttcccccacctataatatctgcaacatccgataatcttgttaatttccaatcgttcatattctttcccaaatcccaccgcttgtggatttcatcaataatgttataaaacgtgattggtagggacgccacgctggcgtccctaccttcatcttgaattaacatcagcgttaattttggataacttgattgtgttttcgtccctacgtttaaaaccccaacgtttttaaattcgctcggatttttgcctctaattccgccccttgtttgaattgttggtctaaaagtgcggtcagattttgtattttttctgcaaatggaatgccgtcatcttccacttcagctgtgccaacatatcgccccggggttaacacaaaatcgtggctttcgatctcggcaagagtggcggatttgcagaacgcaggcacatcttggtagccttcgcctttttgccattggtggtaggtttccgccacgctggcgatgtcttttggcgtgaaatcacgcattacacgggttttcatataaccaagttggcgagcgtcaataaacagcacttcgccctttcgtggtttggctttgttcaacacccaaatgcaagcggggatttgtgtattggtaaataattggcttggcaaggcaatcatcgcctccactaaatcggctcgcacgatgttacggcggatttcgccctcgttgttggtgttgctcgacattgagccgttagcaagcaataacgccattttgcccttttcggaaaggtggtaaatcatatgttgtaaccacgcaaagttggcgttgctagacggtggcgtgccgaacttccagcgtgggtcattagcaaggctttggttccaccattcgttcatattgaacggcgggttcgccatcacaaaatccattcgtttatcaaggtgttgcggattgctgaaggtgtcggcattacccttaccaaaatcaaacgacaagccatgaatcgccatattcattgccgccagtttccacgtggtagggttaaattcctgcccataaatcgacacacggtttggattgccctgatgctcacggataaagcgttcggtttgcacgaagaatccgcccgatcccattgcagggtcgtaaattcgcccctcatagggttcgagcatttcgataatcagggtaacaatggattttggcgtgaaatactgcccgccttttttgccttcggcgagagcaaattgcccgagaaaatactcataaacgtgtcctaaaatatcttttgctgccaaagaaacaggcttgccgttaagcgttgggcgagtgaaattggtgtcagaaaatagttccaccaaaccgattaaaatgctttcatccacgttgtagctagaaatacgttggatcacgcctttcaattttgggttgtctttttcgatagcgtcaaaggcttcatcaatcaaatttgccacgcctttaaaggttttatcgccgaaaatagtgtcgcctaaattgcttctcaccaccgctttgatttcgtcccaacgggcggtttgtggcacccaaaaaacgttatcctgagtgtaataatctcgttcttcgagttcagattcgatttcttcttgggttgcgtctggcaaatagtagtcagaatttggatcttggaattgtgcagaaaggcgttcacgctgtgcggtgaaactatcagaaacgtatttgaggaaaattaaaccaagcacaatatgcttgtagttggcggcgtctaattgctggcggagtttgtcggcagctttcaaaaggcgatcatcaagatcgttaagaaaggattgttgagcgattgaattttcagcagttgttggttgttggttgttggttgttggcattatgataaattcctacattagaaaaacaatactgatgtaggaaattttatataaattttagtaaatgttaaagtaacataaatagacatcagtaaaaaaatcactgatgtctattcattttattccccaatccaaactaaaaaatcgctcacggtgtggaatgagccgaaaatcaggataatatcggttttgctcgctttggcgaataatgattcagctgcttcgggaacggtttggtaataacaagcggtcgaatttggtaaaacttttgccagtttttgatagaccgcttcacctgactgtcctcgatatccggctaaaccggcacaatgccattcatcaataacatttgccaatggctctacgatgccgcttaagtctttatcaactaatgcactaaatacggcaaaaatcttttggttcggctgttttagtgaatttaatcgtcctgccaaatattttgctgcatgcggattgtgtccgacatcaatgatcacttgagcaagcggtcgttttgctgaaaagtttgcaaaatcttgttcgtttagcgtttggaaacgagcggtcatttgcgcttcttgtaatgcggctctaaccacttgttcattgatttcaaatggaagttgagccaaagcggctaaagcggtaccggcattcggaatcggaatttgtggcatcggtaaatcttgccaatcaataaattctgattgccagtggaagcggtcattttctatggaaaatttccaattcacattacgtcttattacttggcaattaagtgctttcgcttgctgtaagatacttctcgggcaatccggttcaccgataatcactggtatattttcacggaaaatgcctgctttctctcgcccaatatcttctcggttatcgccgagaaaatccacgtggtcgatgtcgattgaggtaattatcgctaaatgcggatcaacaatattggttgcatctaaacgcccgccaagtccaacttctaaaatcacaatatccaaatttgcttctttacaaagctgcaatgccgaaagtgtactaaactcaaaataggttaaagaagcggtctttttttgttggatttttgcaaatgactgcacatgggcttcatcattgagtaattcgccttgaattctcactcgttcgttataacgaatcaaatgcggtgatgaataaacaccgacacgatagccggctttaagtaaagccacttccaataaacggcaagttgaacctttaccattagtgccggcaacggtaatgacataaggtgccggctgaagtaattcgagcgcttccgctacgcttttaatacgttctaagcccatatcaattggcttaaaatgtgatttttctaaatagtcgagccacgtagagagactgtcgttaatacttggagctgttaaagtactcattattgcttctccaaaaagaaagccacgtataacgtggcttaagtcatgcttaataaaattaggcttcttcaacaattaattctgctgttttaaaaggcgttggtttattggtcattttggcacataaacgagcaagcgtatcacgcatatctttacgttgcacaatcatatcaattgcgccgtgttctaataagaactccgcacgttggaaaccttccggcaatttttcacgtacagtttgttcgataacacgtggaccggcaaaaccgattaatgctttaggttctgcgatattgatatcacctaacattgctaaacttgctgaaacaccgcctagtgtcggatccgttaaaacagaaataaacggtacacctttttcacgtattttcgctaagatcgcactggttttcgccatctgcattaaagagaacaatgcttcttgcatacgagcaccgccagatgcagagaaacagataaacggaatattttccgctaatgcacgctccgccgcacgtacgaattttgcgccgacaaccgagcccattgagccgcccataaattcaaagttaaatgacgcaaccacaaccggcatattatgcaatgtaccgtacattgtaataaaagagtctttctcaccggtttgtttttgtgctgcggttaaacgatctttatattttttcaaatctttaaattttaagatatcttgcggttctagctcggctgcaatttcttgtgcgctatcttggtctaataacgataataaacgagtacgtgcatcaaaacgcatatggtggttacacttcgggcaaacgtgcatattacgtttaagttcttcgctgtatagaacctgttcacagcttgtacattttgtccaaacgccttcaggcactttagatttgctactgcttgatgatgaagaggttcttcctaaaattctttcaatccagctcattttttaaccttgttattttgacaaaaaattatcggtattaaagcataatttcagtcttttggatatgctttaataatacaatctgctctgatcagctgaaatatcagctatatgtataagtacgataaagaaaagctccaattaagatacatagcattactacaatttggataagtcttttcttggtgagtttttccgctgccatacgctctccttaactaatcattaacataatgccataaaattggtcggggttgtgagtattttatgatttttagttgaatctcagggagataaagtgccaaaatagcttaatgttttgacattggagaggtaaaaatgactaaaattgaccaatttcttgatgttgtagctcaacttcgcgatcctcgaacaggatgtccttgggatattaaacaggattttgactcgatgctgccttgtttgttagaagaaacttatgaagttgccgaagcaattcatacgaaagaccgctctgctcttcgcgaagaattaggcgatttattactacaggttgtatttcttagtcagttggctaaggaggaaggaacttttactttttacgatgtactaaacgatattcatgaaaaattgatttataggcatcctcacgtttttggtgatagctcagccgagaatagtgaagaagcattaagaaattgggaagaacgtaaagcagcggaagccaaacgccaacaacatgaatcaattttagatgatgttccttttgctttgccggcgctaacccgagcgaataaacttcaaaaacgttgcgcaaaagtcggttttgattggaccgaccctcaagatgtgctcgcaaaagtagaagaagagttgcaagaagtcaaagatgaaattgctcaatatcctcaaagtgcaggaaaactagaggaagaactaggggattttctctttgcaacggtaaatttatgccgccattatcatatcgatgctgaatcttgtttgcgcacggcaaacgtcaaatttgaaagtcgatttaaaaaagtagaaaagcttgttaagcaacgaggcaaaactgtggcaaaatgctctttatctgagctagattcaatttgggaacaaataaaatctcaggaataattgacaaactttgataaagctgtaaattgtagctgttatgtcaagtaattacagcaataaatataattgaataaaaataggaattagttatgcctagaattttactagttgatgatgatgttgaattgactgaacttttagcagagttactttcactagaaggttttgatattcactgtgtacacaatggtcaagatgctctcactgaattagaattacaagcttatgatcttattttattagatgtaatgatgcctgtattaaatggtattgagaccttgaaacaattacgtcagaaatactctactccggtattgatgctaagtgcacgtgatgatgaaatcgaccgtgttttaggtttagagcttggtgcagacgactatttaccaaaaccgtttaatgatcgtgagcttgttgcacgtatcaaagcgattttacgtcgtaccgtctcaacaagtttaaatagtgcagatgtgattacttcggcaaatcaatcactggaagaaaacagcaaacaactttcttttggtggtgtggaattacatccaggacgtcaacaagctatttttgaaggtcgtgatttagatttaaccggtacagaattcgcattattacaaatgttaatgcgtaacccaggacaaattctttctcgtgaactacttagccttgaaattttaggtaagcgtttaacaccttacgatcgtgcaattgatatgcacatttcaaatctccgtaaaaaattaccggaacgtaatgataacctaccatggtttaaaaccttacgtggacgcggttatttactcgtgacggaaaaataattatcttgtttgatataaaaacaatccctcgtttttcgagggattttttctatattgattgataggtacttttaatgcttaaatttatttctcattttcttagcaaagctatgtcggtaagaaattatcttgcctatcagctttttgcctattttggtcttacttttgctacattgctggccattacccttgcattacctaattttgatgcccgctctttttctcctattgaaacagaagaacgctttttctttgaacaagaaactaaaaataccgaattgcaatataacttggatgaaatttttgaacgtaagctttttgtttcaactgctaatggttttgatgtgattcttttggatcgcaaatccggtatttttgtaggggcagatccgaataaagtcacttcattccaagtattcttatatcgagccgaaaacatcactgaaccgttacaacgtcgctttggaaatctagaaatttatggcccatttttagtcaaaacgaataagcgcgaatactatcaatattttgctaaaatggttgaccctcaagaagaattttttaaccaaatctttgactcgccttggctgatgttattgattgtattaggcgttagtgtaccgattttattatggttatcatggaaaatcgctcgcccggtaaaagcattacgactttcagccaatgctgtagcaactggtaatttttcaattaatccggcattggagactgaaggcatcaatgaattgcgagaagtaggcaaaagctttaaccagatgatcacttcattacaagatttgacgttgcatcaacagcgtttgctttcggatatttcgcatgaattaaaaacaccgttggctcgtttacatctagccaccgcattaattcgtcgtcgtaatggcgaatcaattgatttatttattagccaacgtgttgctaatcctgaacgtttttatattaacggtaatcaaaatattttggctagtgcattggagaatgtgattcgtaatgcgcaaaaatatgcgaataaaagtattaaagtattgatgtatattgataatactgaattagttatctctattgatgatgatggtgaaggagtaccggaaagtgaatataaacaaatattccgccctttctatcgcgtagatgaggctcgagccagacaaaccggaggaaccggcttaggccttgctattgtggcgaatgcaatgcaacagcataaaggttctgttgaggcaatgaaaagcacattgggcggtctacgagtagaaattcgtttaccgctttggattgaataacctctctgaatacaagcggtcgttttttgcaaaaactttgcaaagttcaaccgctttcatttgtataaacattgtgagttttaccgcttatactcggaatattaggaataatgaagttaattgaaattgaaaatctgaataagtattttggttcaggtgagaacaaagcacatattctaagaaatgttaatttagccattgaacaaggtgactttgtcgcaattatcggtgcatccggctctggtaaatcaacgttgatgaatattatcggctgtttagatactgccagttccggtatttgccgtattgatggtaaagaaacactgcaaatgaatagtgatgaactttcggatcttcgccaaagaaaatttggctttatttttcaacgttacaacctcctttccgcattaacggcaaatgaaaacgtagcattgccggctatttatgccggtatggatagtcactctcggaaagcgcgagccgatcaattgctggataagttaggactgtcggataaaacacttaatcgtccaaatcagctatcgggtgggcaacaacaacgggtcagtattgctcgtgcgttgatgaacggtggtgaaattattcttgccgatgagccgactggtgccttggattccaaaagtggtgaaaccgtactgcaaatcttacaagacctacataaagagggtcataccattattatggttacccatgacccgaatattgcggcaacggctagtcgcgtgatagaaattaaagatggtcaaattattcgtgatgaacgccaacaaccgtattcggaagaattaaaattagctaaacgagaacataaatcacctcgcttctttgatcaattgatcgaatcgttcaaaatggcaactagtgcaattaaggcacataaacttcgggcgcttctcaccatgcttgggattgttattggaataacttctgtgatttctgttgtggcgctcggacaaggttcgcaagaacgcattctatctaacattaatagccttggtacgaataccatgacgattatgaacggaacgggcttcggtgatagacgagcaaatttgactaaaaatcttactatcagtgatgcaactatgcttaataaacaagcttatattgacagcacaacgccctcaagcagcttaaatgcgactgtgatttctggtaatacaaacgtcaccgccacggttaatggtgttggcgagcaatatctgaatgttagaggtttgaaaatgatctccggacgcttctttaacgccgaagacgttgcgctttccgcccaagtcgttgttattgatgccaataccaaaaaggatcttggcttagccgaaccggttgaaggtaaagtgattcttgtcggtaaaaaaccattaaaaatcattgggttagctgctgaatccaacaatatgaatcaaaccagtttaaaaatgtggatgccttatacgacactgatgcaacgtatttccggtgaaaaacatattgattcattaaccgtaaaagtcaaagataatattgaaagccaaacggcagaaaaaagtattactgaactattaatggctaagcacggtaaaaaagacttttttgtgatgaatagcgataccattaagcaaaccattaccagtaccacaaatacgatgaaattattaatctcgtctattgcgatgatttcgttgattgttggtggtatcggcgtaatgaatattatgctcgtatctgtcacagaacgaaccaaagaaattggtgtacgcatggcaattggtgcaaaacaacgtaacattttgcagcaatttctcattgaagcgattctcatctgcttacttggtgggattatcggcatcttatttgcgattaccatcattgtgacattcaatacgctaggctccaatttccaaatggtgctttctcctgcatcggttgtattggcagtattctgctctaccttaatcggcgtggtattcggctatatgccagcaaaaaatgcttcgaaactcaacccgattaccgccttggcacaagagtaaatgaacttactgcaagcggttaaatttgtcgatgaatttgcaaatttttcagataatttaaccgcttgttttatcttaaaaaggaagaataaatgggactatctaatctcgaactcgaacaaattattgatgaaaaattaaacagtaaagcgattggcgattacgcgccaaacggtttacaagtagaaggtaaagcacacattcagcgtattgtgactggtgtgaccgcaactctgccgctaattgaaaaagcgattgaaaaaaaagccgatgcgattttggttcatcatggttatttttggaaaagcgaatcgccttgtattcgtggtatgaaaggtaaacgcatcaaacaattactcgtcaatgatattaatttgtttggctatcatttgccgttggatattcattcagaattaggcaataacgcacaattggcggcgaaattaggtgtgactaatctacaaggattagaagatcgcccgaattcaattccagtatatggagaatttgaaacgccgatttctgcaaaagcgttagcggaacgtattgaacaagcacttaaccgtaaaccaattttatgtgatgaatttattgctgactatccgcataaattaattcgcaaagtcggtatttgtaccggtggtggacaaggttatatcgatttagcagcaagtaaaggttgtgatgcatttatttccggtgaaatctcagaacaaactactcattctgctcgtgaacaaggtatttattacttcgcttgcggacaccatgcaacagaacgagacggggtaaaagcactcggcgaatggctcgcacgagaatatggtttagacgtggaatttattgatatcgataatcctgcttaactaattaataaacgaaaaagtcgtatcggaaaagatacgacttttttgtcactagcacttagtcttcagataaacgagaaatatcgtgataagaagccagcttacgaattgtacgagaacgtccacggattaataacgtttcggtaaacatcatactacccttgcgttgtacgccttttaataaatctccggtggtaatgccggttgctgcaaacagcacgttatcatcacgcactaagtcatccagttttaacactttattgaccggtacattcatttgcgcacagcgagaaagctctttttctgcagcagcaagattttctggcgaattaccttttacttggttacgaggaataaggcgaccttgaatatctccgcctaaagctcgaactgcagccgccgcaaccactccttccggcgcaccaccaataccataaactaaatctaaatcactatccggcaaacagcactgtaccgcagctgcaacatcaccatcagggattgccatcactcttacacctaagttctgtaccactttaatgatttcatcatggcgaggtttagctaaaatggcaacggtcatttgcgtgagtaattttccctttttagacgcaactcggcgaatattttgctcaagcggaagatctaaatcgatcattccttttgcttcgctatctaccactaatttttccatatacatatctggcgctttaaggaaagtatctttgccaccggcagctaaaacggctaatgctcccgcctgtcccatcgcggtcattcgagtaccgtcaatcggatcaaccgcaattgccacttcgtcatcttcaggctgagaacgcccaactttttcaccgatataaagcattggcgcttcatcaatttcaccttcgccaatcacgatttcaccacgcatatccattttattcatgactaaacgcatcgcttttaccgctgcatcgtctgcggcatttttatcacctcgcccaatccagtcataagctgcaagtgcagcggcttccgttacacgggaaaattcgaaagaaatagcacgtctcatttaacatcctttatataatatgaccaatatttgctatattttatcagctggcaatcgatttcgttactaaaaaatcagcaaatgaagaaaaattccaaaatgcatgaacttttcaatgaaatcaacgcctaactgaggtataattcttacacttacatatctgtttttaagagggaacccaattatgtcattatcaattcttgaccaacttgaagaaaaaattaaacaagcagtagaaacaattcaattacttcaattagaagtggaagaattaaaagaaaaaaacaacactgtagagcaagaaaaagaaacattacgccaagaatttgaacaattaaaatctgagcaacaaagcttccaagatcgtttacgttcacttttaggtcaaatcgacaacgtataattttccttttttgtagaacggctaatgcgtattagccgttttttatttgtgtaagattatggcaaaactctatttttattactcttcaatgaatgcgggaaagtcaaccaccctgcttcaatcctcttataactaccaagaacgaggcatgaatactctggtttatactgctgcgattgatgatcgttatggtattggcaaagtgagttctcgtattggtatttcacaagaagcgcaattatttcaatcggaatcaaatttattcgatgaaattcagcttgcccatcaagaaaaaacgttacactgtatcttaattgacgaagctcaatttcttacaaaaacgcaggtatatcaattaacggatgtagttgataaactgaaaattccagtgctatgctatggtctacgtactgatttccaaggtgagctctttgagggaagccagtatttattagcctgggcagatgaattacaagaacttaaaacgatctgtgattgcggaaaaaaagcccactttgttattcgtatgaatgagaacggcgaagccgtcgctgatggagatcaaattcaaatcggtggtaacgataaatacctctctgtttgtcgctatcactacaaacaaaagctaaataaactatagcgttacaagcggtcatttttgctaaaaaatatgtaaaaatgaccgcttattcgttacagttttctaactggtatcatcattaagaagctgacaatacataagataagtgataaataccatgtactttgatagccaaaatagctagccgccataccggcaacaggcccagcaatcacccaacttgcaccacttgtattattaaataatgtcgtcgcactacccattttatacggcattaagtcctgaaaatacaacattccaattgaagctaaaatgccaataaacaagccgttaaacacttgtaaagcaagtaattggctttccgtttgagccatagataaaccgatgtaataacaaataccggcaagaatagcgataattagtaacattttcttactgataaatcttgtgcaatatcccgcaagaagcattaccggaatttcaatcgccgctgcggtactcatcatcacacctgcaacttgttccgataaatgtaggttctgtttcaaatgtaacggcaagttaataaacatcatactgttgcaagtccacatcaataagcatgctaaggctaaaaatgttgtagatttgcgattactttcaataccattttctcgtaatgtctcatccgtttcccttggcttaacgtgacgttgtaccgaagatggcaacattaacaccacaataagaatagaaacggcaaaaatcaaagcagcaacaatatacataaaggtaaaaccgaaattacccgataaataataagctaccggagggccgataatccaagcgagtgaaagttgtgctcgtaaaatcgtattgaacatcgtcccgtctttttgtttgctttcggtatattctcgagaaagcgcaaagacttgtgaagtagcggacgaacctaatccgataatcagggtaccgacaatcagtaaagtataataatctcggttaaatgcaaaaagtaagcaaccgctcagttgcataacacaactaagtgtaacgatccatttacggtttgtataaagatccgagtaatgggctacaatctgactcaacaccatcgccatcaaggagttaaccgaataaaatataccaatcataaatgggtcgctagttacttcattatgcaggaaaacactgagtgcaggcaccctcaatgcccctgcaagacctgtcataaagataacaatcaggaaagcaaaagaagctaatcttaacaagcctctttggataacaagcggtcttaaattgtcagaattttgcatttgtaggatctcacaaaaagaaaaggcacgtcattataacgtgcctttcttaatttctttgtatttttctacaaaaagattatttgatctacatcctaacgtttatgcggtaatttttcccaagttacttcattacgtaaataaaccggttcaatttgtaatgccgattgtgtattcccttgagcaagttcgaattctgcaagtgtgagcattgattttgctgaaggtaatgtaatatcacttactaaaagtgataattgtgcatcagaaaattgcgaatatgccacccaaccggtacctaccaccacagtattatctttcggctgtatttggctaatagcatgctccggagaacagacttgctcagcaacaattgcttgccagcactgccctactctctcatattgcgcaaaataaacttcattcatacgggcatcaatcagtgcaacaacatttgttgctcctgttttctcgtaagctgcttgtgccattgttaagagatttgagaccggcacaactggtaaatttgctcccattgccagcccctgagcaataccaacacctactcgaacaccggtaaagcttcccggccctcgaccaaatgctaatgcatcgacttgtttaagagaaagtcctgcctttgccaataattcatctaccatgggcaggattcgctgcgtatgcgttctaggacttaattcatctaatgaagagatttgtccattatgtaataacgccacagagcaagcttcagtggccgtatcaatagcaagaattgttttgttcattaatttattatcctaaaaacgacagaaaacacggaaacaagcggttaactttacaaaaaagtttgcaaaaaccaattatttccgtgtttctgatattaattttagtgattaagcatgcttagctcggcgctgttcaaccgcttccgctaatgcaaataacgctttttcactgtcttcccagccaatacatgcatctgtcacgctttgaccgtacactaaattatctaaattaccatcacccagttcttggcgaccctcaactaaatggctttcaatcatcacgccagaaatcaattctgaaccattcgcaatttgctggcatacatcggcacaaacatccatttgacgtttaaattgcttttggctatttgcatggctaaagtcaatcattacgtgcggacggcgaccggatttctcaatatccgcacacacttttgcaacagactccgcatcatagtttgtgccattatcgccaccacgtaaaatgatatggcaatcagggttacctgccgtagagacaatcgcagaatgaccaaatttggtaaccgataagaaatggtgtggtgcttctgcagcaccaattgcatctaaagcaatttttacgccgccgtttgttgcatttttaaagccaaccgcacaagataaacctgaagctaattcacggtgtacttgagattcggtcgtacgagcaccaattgcaccccagctcataaaatcagccatatactggggcgtgatcatatctaaaaattcacctgctgccggtacggttaagtcattgatatcagacaatactttacgcgcaatacgtaaaccatcatttagcgcataagtttcgtttaggtatggatcattgattagtcctttccaaccgacagtggtacgaggtttctcaaaatacactcgcatcactacttcaagattttgattaattttaggatcagcacgaagggctttaatacgctgtgcatattctaaggctgctttaggatcgtgaattgaacatgggccaatcactaccaataagcgatcgtccgcaccatgaataattttatggatagcttggcgagcattttccaccgtttcagcagcgacttcacttgccggaaaacgttctaataacgcaaccggtggcaaaagttcttcaattttagtaatacgtaggtcatcattcttgtaagacattgtgtgctctcttattgtttgttttaaacagttattagaaaaggtgtagacctaacttaataaaattataaaatgatgtcaaatggtttttgaactatttaactagtacaaaaatattttgctgatttaacgaacagaaaatgtatcacaaacagctggattaccggattgtaatcccttacggaaccaagccaaacgctcagcagaagagccgtgtgtaaagctatcaggcacaacataaccttgagcttgtttttgcaaacggtcatcaccaacagcctgtgaagcaataaatgcctcttctacatcaccggcttctaattttccttctttttgaatttggtaaccccaaacaccggcaaaacagtctgcttgaagctctacgtttactgatattttattcgctgtcgcttggttacgagcgttacgttgtgctctttgagtctgctcactgatgcctaataagttttgaacatgatgaccaacttcgtgtgcaatgacataagcaaaagcaaaatcacctgatgccctgagctgtgacttcatatcatcatagaacgataaatcgagataaactttttgatctgccggacaataaaatggtcccatagccgattgccccgtgccgcaagcggtatgcgtaacgcctgggtaaagcactaatttgggttcacgataagtcaaaccgttttgtttaaaataattaccccatatacgttccgtagtgtacagtactttgcgagcaatcgtattaagttccgcttcttctgcagaaataatcggtgccgtttgttgctgctgataagaagattgtgaatcgttatatcccatcaaaccggttaaatccacgccataataagccccaattaatacgatgataaagcctaaaatcccacctttagctcgtccaccggaagaacgacgaccataaccggagtgtccgcgtctatcttctacgttcgaactctctctttcattatctaaacgcattttgctttccttgaaactaaaataataaatcaaccctaattttatacgaatatccagagatatcctacaagtaattcctatgctaaatccaaataacaaaaagcgattaaattcaaagccaaacttgcaaagttttgccaaaatttaaccgcttgtttaaagaataaaacgttacattgtcgctttatcttgctaaaatttcacgttttccgttttttccttgctctgaaagaataccttgtgcttccatttgatcaacaatgcgtgccgcacggttgaaacctaatgagaagcggcgttggagaccacttattgaagtcactccactttcaatcacaaattcaacaacttcatcaaatagtggatcgaggtcaccgactccaccaatacgctccgtaccttcggattcttcaacggaagcaacaatactttctaaatattgcggctttcctcgtgcacgccagttatctgccacacgttgcacatcttcatcgctcataaacgcaccgtggatacgaataatatccggactgcctgcaccagaatacagcatatcaccacgccctaataatgcttccgccccgcccgcatctaaaatagtacgagagtcaatttgacttgctacggtaaacgcaatacggcttgggatattcgctttaattacaccggtaattacatcggttgaaggacgctgcgttgcaagaattaagtggataccgactgctcgagccttttgcgcaatacgcataatatattcttcaacctctttaccggcagacatcattaaatctgcaaattcatccacaatcagtacaatatagctgagtttctctagagccggcggtaattgatccattgaatcgcccggacgccaagttggatcaggaatcgggtaattcatcgcggctgcctgatcaattttatcgttatagccttcaatattacgcacacttaagtggcttactaataaataacggcgctccatttcttccaccgcccaacgtaaagcatttgccgctttcttcatatcggtcacgaccggtgttaataaatgcggaatatcgttatagatggatagttcaaccactttcgggtcaatcataataaaacgcacttgttccggtgaaagcttaaacaataagctcaaaatcatcgtgttaacaccaaccgatttaccaccgccggtttgccctgctaccagtaagtgcggcattttcgccatatcaaccacaatcggttcgccactaatatctttacctagcgccattggtaaggttgctttgctgtgtttaaaggcatcactatttaacacatcacgaagccaaaccgtttcacgctgtttgttaggcgtctcaatccccatataaggcttacccggcaccacttcggtgatacgaattgctttaaacattaattcgcgggataaatcgctcgctaaaccgactacttttgcggctttaacaccggcagccggtttgatttcatagcgagtaacaaccggaccaaccaatacgtcttcaaccgttgctttcacaccataatttgctaatgcactttctaaacgatgggaagtttcaacaatctcttgctcggtaatttgctgtgtttgacgtggcgactcatctaacaaatcaatcgttggtaatggcgttgtcggtttttctgttgtatggttacgttgtagcaatgggtgtattaatgtatcgccataaccttttggataattaggcgttgatactgattccacttccgacgacatattagctactttcacacttggcataacgacgggctccggctcactcttgacaatttgttcaaatgtttgctctaaaccttgcgctttagcacgttgttccatttgcgctaaacgagcctgctccgcttgttcaaattcttttgctaacaatgcttcataatcttcttcaagctcttctttctgtgttgattcttcaagcaccggttgtaaacgtaccaccggtttcgcttcttgaacaaatgccggcataggcggattcatatcttgatattcaaccgttgcatctgcctcatcattattctctactacttcaaattcatcttgctgttcaagcgcttgcttgaattcatcagttggcgaaatcacttcagactgaggtactgccgcttctactaacggatttaaacgaattttcggtaattcaatttctgcattaggctcagcaaattcttgggtggcaatcggctgactagcaatttccattccttgaatattaatttttggtaactcaagttcagtttctacgttaaacatattttgatctgctaattcagaatccatcttattgtctgcaaattcaggttgtactttcaaaccggtaatattcggacgactaaatactgaaacatccgtcagctgctgagtctcagaatcatcttgagcctcttctgctgtattttcatcaataacaagcggttgaatttcttctgaattttgcaaatgagcttcatttgcttccgtatctgctgctaccgacgtctctttaggctgatcttttgccacaatccaatcatagaattgggcaaatagtggtaggagtgattgacctgaacaaaaatagaaaccaataccggtaaagatcatcgctacaaataatgcaccgaattgaccgatcgtgcttgccagtaaggattggaacattccgccgataaaaccaccggataaataataggcattatttgacaacaccacgctagcaagcccagccaaaccaatcagtaataaaataaaactactgaaacgcaagcaaaaatgtttccaagtccattcattcgctaaacggaaagccaatgaatataccgatacgccgcataaggtcaatggcacaataaatgcaactttacctaagaaagcatacagtaaatccatcgtccaagcaccgaatacccccgttttattcaataccctatgctccgtgacactacttgccgtgctccaagcattatctagcggactataacttgcccatgccacgatcaaataaaagccaaataaccctgccaaaattaatgcaaggttaatcatattttccttaccctttaatcgtggtttgaatcgttcgatcacactcactccttattttaataagagataattagtttgttttacttcttccattaccacgtatgtacgagtgtcattcacaccgggtaaacgaagtaaagtcgtgcctaataatttacgataagctgccatatccgctacacgtgttttgagcaaataatcaaaatcaccggaaactaaatggcactcttgaatttcatccagttgttgcactgcacgattgaattcctcaaatacatccggttttccgcgtactaaggtgatttctacaatcaccagtaatggtgcttcgagtaattccggattcagcaacgcacgatatcccataatcacattttgcttctctaaacgttttacacgctccaaacaaggtgtcggcgataaaccaactcgtttagaaagctcaatattagaaattttaccgttacgttgtagctcatttaaaatttttaaatcgatcgcatctaatgctttaggtagttttttatgttccattttttaccctttatagttttttgtgctaatgagccattgtacagggtttaagcgcattggtctaatcgagtttgcaaaaaataagggaaattttaccgcttgttacggtaacctttccctttcacatttaagatctaattttagagaacttgtacgagttgcataccaaactcttttcgccaacctttgagcaattccggcaatttatccggattttgccctcgaataaaccaactaaataattgatttaactgacgcttgcttgctaataattcaggtgcaagatcaagcggtcgaatttctgccaatttttgctgtaataattttaagctgtgtttataacctggttcatcgacaagacgggatattgtcggcggataatcttcttccctaaccgccttcccttgctcaactaatagtaataactttttaccatgtatacgaacttcattcgggtgcataaattccaataattgagaagtatgtttaggctgtagcttggctatttcaaataaattctgctcttttacaacaaagttaagcgctaaatcacgtttttccgcctcttccatacgccatttggctaaaacttgtaatacagctaattgtgctggagttaaacgccatgcattagaaatatctttgtatgcttttgaactattcggtaagttttgacgtttttccaagagagtttggcactcttcttctacggcattctgccaacgcgtaacatcaagatctacaactaggcgttgataaaccggtaataaataccatacatctgctgctgcatattgtaattgctcttcacttaaaggacgggctaaccaatctgtacgagatgcacctttatccagttcaatctgtaaataatgcgctactaatttagcaaatcccatcgaaacaccgattccggcaaagcctgccataatttgtgtatccaccagaggtgttggtaattgtttaaagcggtgttggaaaacctcgagatcttcactgcaagcgtgtaaaacttttactacttgttgattagctaataacgcaataaaaggcgaaaactcatcaattgtggttggatcaataagactcacctgttcgccatcaaataattgaatcaaacctaatttaggataataagtacgagtacgaataaattctgtatccaatgcaactgccggcttttgacttgcatttcgacaaacttcggctaatttttgattggtatcaacccaaatatagtgaatgttctgattcatttgtatgctctttttagttaattttttcaaaaaataaattaattatgtgagttagctcacataattacaataaagtggttgtacttcaaatgtattgaagcaaaaataattatcttatggagtgtttgcttttgtaaattttaatagctgtgcttctttttataagtatgaagtactgtttaacctaaggattatactatgatttctgataataaaacccaacatcttggtacaatttatcgactagtggaacaatttgaacttatttcgcgaacagatcttgctaaactttctggcttagctcccgcttctatcactaacctcaccaaatctctgattgataataaattcattttggaacgtacagtacaaaataatacctctcgtggcagacctgcggtcggattggccgtatctaattttttctggcaattactttattttacgatttctccgaataacgtagaaatttcattgtgcgaattaaatggcaaaccaattcagaccaaacattaccctctttcatctaacgactatccgcaactcgattcttacttacaaacttgcttaaatgacctcttttggcattcaccaatggaagctaaccgaatattagcggcttctattagcgtagttggacaaattagtgctgatcacagcaaaattatccgtttaggtgataccgctattgaaagttcctttgtagaaacattaaaagcacaatttgattgtccaattttattaaatgaacattttcaattatggcttctcacagaatcaacacttggcagtttaattaataatgataatgtgattttcctccaattagatgaggcggtaaatttaagtgtcttattgcgtggtaatctattgcatcaacaatcaaaaatgaatgtagataaaatgctgatgcctaaatttagtccattaagcgatattgctgcaccgaatgattgcgatgaaattcaacgctatcagctaaataaccaagtcactttcccagcgatcgtacgcttagttgatcattatctaccgaatagctttactcagagccatgaaaaaattcagtatttatgtgagcaagttgagcaaagaaatgaaacagcattaatgattttagaacatatcagtgataatttagcttatgttttaatgaatctgatcaatattttttccacggaaaaaattatgttgaactcgccgctactgcgcattaaacatattctattcgaacagattcaacaaaaattacaaaaagagttacttcttggaaatctccatgtagatctagtaaccagccagtttgaatgggatagccctcttattgcttgttccgcaataaaacaagggatttatgagggaaatttgatcaaggacatcattcagctttaaaacttcagttaaaatataggcgattttgtaacttttttgttatttttagataatagagaaataaaatatgccttcgttatttattaccggcacggataccaatgtgggaaaaaccattgttactcgtgctattttacaaacattagctgctaaccaatttatggctgtcggttataaaccgattgcttgtggcggtgatgactctcttccgacagaacctaatcaggcagactatgctagcgaagataatctggatgtattgacaattctagatagttgtcctacgcccgttgcttatcgagaaattaacagttatacctttattcactccagtacaccagtatttgctgcattagatgccgttcaccatatccaagaagaaaaattaaaccaagatttaacccgtttacagcaaaattatccgaatgttgtggttgaaggtacttatggttggctaactccgatcaataaagatttaagttttgctgactgggtgaagaacaatcaaatgccagttgtattagtggtaggaattaaagaaggttgcgttaatcatgcgctattaactgcacaggcgattaagcaaaaaggggttaagttagttgggtggattgcaaatcgtattaacccggggctacgtcactatgccgagctcattgaactgctgagtcaggaaattgatgcgccactattgggccaaattccttatattggctatccaaataagaaagatttgacaccatatattcaaaatcccgagccattattacaatattttcaaaaataaaaatgccaaaggcctccttttaggaggctttttattgtttgctattgcttgagctaaattggtaaaaaagataagaaattcaaccgcttatacaaatttagagataaaaaggtataaaaaaagcccctcaactaggggctactcggaaagcaaatttatgaaatcggttgttgaacacaacactttttgttaagtacgtataggatacgtcaatttattaaatttttcaaattttattccaataaatttgtaacttttttctaaaaatgtgatctctgtcatatttttaaattataaacggcgagcttgccagaaagttctcgaccaatatggtgagtttatatctgagtaaataactccccccttggtcgaagcatgtaagaactgtccgttttttacatatacgccaacatgtttaccattaggacctcgtcctgttttgaagaatactaaatcaccagttctaagctcatcacgatcaattcgagttccctcttttgcttgctctgaggttgttctcggtaaatcgattccaaataaatcacggaaagttacctgcataaagccggagcaatcaatacctgctttgctattcccacctaaacggtaacgtgtacctttccattcatgttgttgttcacttaagctactgatcgccataatcggatcagataatgtactgtgatgagtgcggaaaattcctgctcttgccttaattggtcctgatgtattatcactacttgaacatgctgttaatagcgctgcacaagctaaaatagcaaacgaagaaaatcgttttttgttgaatttaatcatatattcactgcctataaaaaaacatcctacaggctttatttcgcctgtagaatgctataacttttttatgccttcacttttacattttcgactctgtctctaagcttctgaccgggcttgaataccactactcggcgagctgtcacggcaacagtttctccggttttaggatttcgccctgggcgagcattcttctcacgtaacgagaaattaccgaaaccggatagtttaacctcttcgcctttctctagagaactacgaatttcttcgaaaaattgctctacaaagagcttagcgatacgtttatcaaagccacatttttcaacgaggctttctgcgagttcaattttagtgagtgccataaaaataatccttaaatctaatctcttagatatgcttggaaacgttgtgctaattcagctaagactgcttgagttacagctgaaatttcttcttcttcaagcgttttttcagtgtcttgaaccgttaagctaattgctaaacttttcttaccagcttctaaatttgtgccacggtaaacgtcaaataagtttactgcaactaattttgagccacctgcattgcgacatgcatctaatacatcaccagctgctacattctcatctaccacaactgcaatatcacgattattcgcagggaatttagaaatttcttttgccgcaggaattggacggtttgcaatcgcttccccgagaatctcaaataccactggtttacctttaataccaagtttttgcacgatagacggatgcacagaaccaatgaagccgatttctttaccatctaacataattgccgcagattgtcccggatgtaatgcagggaattgttttgccacaaattttaaatcatgacgagctgacgttagtgataatacacgctccatatcgcctttcaagtcgaagaaatctaccacttcgcctttactttcccaatgtaccggacgtttatcaccgacaattgctgcaccgaatacgaattcttgacgaactcctgattctgctgttgcatctggaataaagcgtaaaccgccttcaaaaatacgaacgcgtgtttgctgacggctttggttgtaaacaatcgtatctaataaaccggttaaaagcgataaacgcattgctgacatttcgcttgaaatcgggttaggtagaattaacgcttcttgattcggatgcaataatgattgttttttcggatcaacgaagctatatgtcaccacttcttggtaatcgctatccactaatgcagtacggatacggcttgcttctaataatttctccggtgtgcctttcattgttaagtgtgcaagcggagaattatttggaatactgttatagccatagatacgagcaacttcttcgataagatcttcttcgatctcaatgtcgaaacgccaacttggcgctacagcagtccaactatcatttgtgaaggttacgtttaaacctaaacgagttaaaatatcagttaccgtttcatcttcaatgtggtgaccgattacagcatctaatttgctacgacgtaaggtaaccgtattacgttttggtaagtgttgttcacttactgcttctacgatttcacccgcttcaccgccacaaatttcaagtaataatgcagttgcacgttccatcgcatcacgtgctaattgtgggtcaacaccacgttcaaaacggtgtgatgcatcggtatgtaagccatattgacgtgcacggccggtaatcgctaatggtgcaaagaatgccgattctaatactacgtcagtcgtattttcatttacaccgcttgcttcaccaccaaaaatacccgccattgctaatgcaactttgctatcggcaatgactaaagtatttggctgtaattttgcggttgtaccgtctaataaaactaattcttcaccctcttttgccatacgtacttggatagcaccttcaattttagacgcatcaaaagcgtgcatcggttgaccaagttctaacaggcttaagttagtaatatcgacaatcggatcgattgaacgaataccacaacggcgtaatttctcttgcaaccataatggtgaagctgcttttacgtttacatttttcacaacacgagcaaggtaacgcgggcaagcttccggcgcttgtaattctacagccactttgtccgcaatcgttgcaggtacggccgaaatcaccggcgattttacttccgctcggttaattacgcccacttcacgtgcgatacctgcaatgcttaagcagtccgcacggtttggggttaaactgatttcaattgccacatcatttaaatctaaatattcacggaaatctttaccaattggcgcatctgccggtaattcgataataccgctatgatcttctttgatacctaattcagaatatgaacaaagcataccttcagacggctgaccgcgtaatttggttttcttaattttaaaatcgcccggtaataccgcaccttccgttgcacacgccacttttaagccctgacggcagttcggtgcgccacatacgatatctaataagcgatcaccgcctacattcactttagtgacacgtaatttatccgcatccgggtgttgagcacattcaaccacttcacccacaactacaccggtaaatgcgccggcaaccggttcaacatcatcgacttctaaacctaacatggtgatttggtcgcataattgctctgttgatactgcaggattgacccactcacgcaaccaagattcattaaatttcattttatatcctctattttcttacacggaatttgcaaaattccacttaattttgaccgcttgtcattcccgtgtattcagtgaatctaactattatttaaattgttttaagaaacgtaagtcattttcaaagaacgaacgtaaatccgttacgttgtatcgtaacatcgttaaacgctcaactcccatacctaccgcaaaaccactgtattcttccggatcgatacctacgttacgtaatacatttggatgcaccataccgcaacctaatacttctaaccatttaccgttttgacgcattacgtccacttcagccgaaggctctgtgaatgggaagaatgacggacggaaacgcacttgtaaatcttcttcgaaaaacgcttttaagaaatcgtgaatcaaaccttttaactcagtaaagtttgcttttttgtccacataaagcaattcgatttggtggaacatcggtgtgtgagtttggtcgtagtcgttacgatatacacggcccggtgccacgatacggattggcggctgcatattttccatggtacgaatttgtacgcctgacgtttgcgtacgtaataaacgttgcgcatcgaaccagaacgtatcgtgatccgcacgtgccgggtggtgagcaggaatatttaacgcatcaaagttatagtaatccgtttcgatttccggaccgcttgccacggtaaaacctaattcagagaaaaattttacgacacgttcaatcgtaattgagactggatgtaaaccacctaattcggttttacgacccggtaatgatacgtcaatgctttccgccgcgagttttgcgtttaacgcttcttgttccgacgcttcttttttcgcatttaaaatatcaagaattgtttgcttcgcttcattgattttcgcaccgattgccggacgctcttccgccgaaacattgcgtaattcttgcattaacgcagtaaaatgaccttttttaccgaaatattcaacacgaaactcttctaacgcatctaaaccttgatctaaggcatctaaagcatttctcgctttctctgttaattcttttaggtgttgcattacctatcctctaaatatattgatgaaaaattattgtgatgataatactttgcctgaagaaagtaaatgtaaagttaagctaaagtgttgatttttaaggtttcacaaaaacaattaatttgaatgatttatctatacaagcggtttatttttggagtttttttgcaaaaattagaaataaaacaaagtttggtgatttgcttttatgaagcattagcttaatagttgataaaagcgtattatcacagcgtttactacaactatgaatgaggaaattatgtcacatattgccaaacaagacgttctagacgcatttagcttccgcgctgcttgtcgtagctatgacccggctaaaaaaatcagccgtgaagatatggaatatattttagagctcggtagattatcaccaagttctgtaggttccgaaccttggaaattcattgtgctgcaaaatgcggttatccgtgaaaaaattgcgccagtttcttggggaatcaaacacccaatgcacgaaatgagccatttagtcgtgatcttagctaagaaaaatgcgcgatacgattcggatttcttccaccagggcttatcaaaacgtggcttaacaccggaacaaatggaaaccaccattgctcgttataaatcgttccaaaccgatgatattaaagtgttagaaagtgatcgtaccttattcgactggtgctcgaaacaaacttatattgcactcgcaaatatgatgaccggcgcagcaatgattgggattgactcttgcccgattgaaggctttaactatgatgcggtaaacgaaatcttagcgaaagaaggcttatttgacgctaacgaatacggtgtttcttgtatggtgaccttcggttatcgtgcgaaaccgattaccaaaaaataccgtaagccggctgaagatgtgatcagttgggtggaataaatcttgctatccatatcaataacaaaggggcttaagcccctttttctattttcgataacaagcggtcaaatttcataaaaattttacccaaaatcaccgcttgttatgcccgattaagccacttgttacttaatgtgcctgccaccattgaaccatttacatttaatgcggtgcgtcccatatcaattaacggctcaactgaaattaataagccaaccaattcaatcggtaaatttaaggtggaaagcacgacaatcgctgcaaaagttgctccgccgcctacaccggcaatgccgaatgaagaaatcgctaccactagaattaacgtgacaacgtaactgagactaaacggatctatacctacagttggtgcgaccatcaccgctaacattgcaggataaatcccagcacagccattttgcccaatagtggcaccgaaggtcgccgagaaattagcaataacattattattacccaatttatcggtttgcgtctcaatatttagcggtaaagtcgcagcacttgagcgagaggtaaaagcaaagctaagagtcggtaacactttcttgtagtaatccagcggattcacttttgccacgaaaagtagaatgccatgtactaaaaacatcaagccgattgctaagtaagacgccacaataaagctacccaaattaacaatatcttcccattttgaagtagttgccatttttagcatgagtgcaaatacgccgtaaggggttaagcgaatcacaaaacggactaaacgcataatcagtttatttaaggtatccaccccagttgcaatacgttcacctaatgcggcatcttctttggcaaggcttaatgccgccacacctaaaaatgcagagaaaattaccgtgctaataattgaagtcgggtttgcaccggttaattctaagaatggattttttggaataaaagagactaacattgccggtacagataaatttgacacttgctctgcacgccccgccactttgccctgcgcagctaattctctctcaccagctactaatccttccgctgataaatcaaataaatacaccattgcaataccgattgcagccgcaattgcggtggtaatcaataaaaccgatagtacactgaagctgattttacccaatgatcccgcttgttttagacgggtaatcgcagacaaaatcgaaataaacactaacggcattacaatcatttgcaataaacgtacataaccgttaccgactaaattcacccactctaacgttgcgtcaatttctgacttttggtaaaaattttgcaaaattgcaccacttaccaccccaagtaataagccgacaaaaacagtttgtcctaatttttgcgtgtttttatacagtaaaaacagtaggaatagtagcgctgtaaacacagctaaattaaggataatcatccgaatctccaacacaataaaaaataaaagcgagaatataactctcgctctatattttcaatataactttctcattttatagtactaaaagttatattattgtacttcccagcttaaattagagattaaacgacatttatcacacttaaagtggaatacttgatgcaacggttgtgctaatttccattctccttggcatttaggacatttacgctgatgttctgcagctaaatcattacctaaacgatataaataatagaaagtcggcacaccgcttagtgcttcaagttgatgacataacgttattcctgtttgtgaaagttcgctatcgacttcactaatttgcgctaaagcctgctgttctagtacaccgccattcatttgtaactgatcacaagcttgccaattttcttgccatttaatcaactgttcgccaagttgttgctgttgctcggttgctttatagagtggaatcgcacaaaaatcctcaccaccataaaccggtgaacagctatctaagtgggtagtataaagaatttggaacgcctgttgttcaagttcgctggtttgttctgcttgataatctcgaccaacaatctcaaacgattcgaattctacgccattttcttccgcttgtaatagtgcctcattaacttctgcactattccattccggcattagactggtttgctccggggttgaaactcgtacttgaaaatgcgccagcggattttggtggtaagtcaccgcaaattctctgccgataatctgtccgttaaaacgccattgattgacaacttggttaattaacgtgacaggatcgctttcaaaatcttgatagctaaaattagcgataacttggtacataatcttttacttgtcctaatttaagttcttgctgaacaattgaggttggctcttgatgaataataatttccgaacgaggaaaaatcgctagaattttctgttccagtgaatcggtaatatcatgcgcttcccgtaaagtcaggttatcttctagctctaaatgaagttgaataaaacgcacagcccccacttggcgagtaagcaaatcatgcataccgataattcgctcatgatgtgcggcaagttctaaaatttgatcgatttcttcctgtggtaatgcttgatctagtagtacttgtaccgcttcccaaaacattttaaaagcattaataccgatataaagtgcaatcccaattgcaaaaatcgcatcggcataaacaaagccatacagacttagcagcatagcgactagaatcgcggcattcattaacaaatccgtttgataatgcagagaatctgccgcaattgccggacttttagttaaagccacaacgcgtttttgataccacactaaagcgccggtcacaataatcgaaatcaggctgacagctatccctatttccgatccttccataaaatgcggatgcatcaatttatgcacaccttgtagcactaagaacaccgccgagccaccgataaacgcactttgagcaatcgcagcaagcgattccgctttgccatgcccgaatgtatgattttcatctgccggtagcagtgcaaaacgtagcactaagatattggtgatcgaggccaataagtccacaacagaatcggtcactgccgctaaaatcgaaattgagccggttttccaccatgcaaacgctttaatgactatcagcaagcaagctaccaaaatcgcaaaatttgctgctcttttcaccaatttaatatattgttgctccatactccccccaagtatgtactatttatccttacttacaagtaattagccatggcattgccgccagctgctgtgctaattggactaatgaggcttgataagcggtcgaattttgccatttttttgcaaccatagcgcgtttgtccgaatattgaatttgcccatagccacactgcaaatctttgcctcgagagacttcaagtaatacgtcattaaaacgttctgtcggcggataaatcacttcactgcgcaattcttgctgctcaatactcactttagattgcgtattattttgttgcgcaaaagcagcctgtcgaagcactactcgttgttgcaacgttttaccctgcgaattctgatctagaaaaaataaaatcccattattccaatgttcaggatcttgctttccatcagccggtaaatagagcaattgtcgcatttcatcaatacgattatccgttaccttcacataagatttaccttgaaaatccactttttccggtaaatcaaattgcttttgggttaggctacaagcggtcaaaaataacgaaaatcctgcaagaaaaagccaacgcattatgcctgctccttgcgtttaaagacgagttccgttgcgctggaagcctcttcatcaaaccaatagccaccataattaaaagctttcagttgttctacgctagtcggttgcgtttctaaaataaagcgtaccatcataccgcgcgcttttttcgcataaaaactgatttgcttaaacttgccgttcttttcatctaagaataccggcttaataatggttgcctgtaactgttttgcttttactgcaccgtaatattcgtccgaagcaaggttcactaagatattatcgccttgttcatcaatcgcagtctgtaaatgttgggtaataatctcgccccaaaacgcataaagatctttgccttgtggattagctaacttcgtccccatttctaagcggtatggctgcattaaatcaagcggttttaatagcccatataagccggataacattcgcaaatgtgtttgtgcatattctacttgcgcttgagtaagagtttccgcatccagtcctgtataaacatcacctttaaatgcaaataaagccgctttagcattttgttcgttatgttccagttgccattctgtaaaacgggctacattcaggctagcgagtttatcgctgatcgacattaatgagcctaattctgccagtgaaaattgtttgcagatatcgacaagttgttgactataagcggttaatttcggttgagaatttgcaaatgggaaattaggtgcgggcgtttcaaaatctaatgtttttgcaggagaaatgatggctaacataaaaaataccttgattaaaaatttggttcattttagcacttgtcaggcgataaaaacagaaaaggcaggaataatcctgccttctgctgataatactttcgtatatctgtaatactcgaaattaacgttttgagtattgtggacgacgacgtgccttgtgtaaacccacttttttacgttcaacgcgacgtgcgtcacgagtaacgaagccagctgcacgtaatgcagggcgtaaagtttcgtcgtattccattaatgcacgtgtgataccgtgacggatcgcacctgcttgaccagaaataccaccacctttaacagtgatgtataaatctaatttatctaataactcaactaattctaatggttgacgaactaccatgcgtgaagtttcacgaccgaagtaaacgtctaaagaacgttggttgatggtaatgttaccactgcccggtttgataaatacacgagctgaagagcttttgcggcgacctgtgccgtagttttgatttgctgctgtcattttcgatgctccgtgattagatgtctaaaacttgtggttgttgtgcagcgtggttgtgttcgttacctgcgtaaacttttaatttacggaacatttcacggcctaaaggaccttttggtaacatacctttaactgcgatctcgatcactgcttctggacgacgtgcaatcatttctttgaaagttgcatctttgatgccacctacgtagccagtgtgccagtagtagattttgtcagtttcttttttgccagttactgctactttctctgcgttgataacgatgatgtaatcacctgtatctacgtgtggagtatattcagctttatgtttaccgcgtaaacggcgtgctaattcagtagctaaacgacctaaagttttacctgtcgcatctactacgtaccagtcacgttttactgtttctggttttgctacaaaagttttcattaattaaataccaatatttttagttataacccaattcacttataaataagcgaattacctatatgacggtagaatccgaccccttcgagtcaaaatctgaccaaacttgttcggcgggaaagtccaaacaaaacagggtgcgaggattatacagatattttatctaaaaagctaagtttttttgcattaaatctgaaaaatgtcggaaagctcaaattttcaaaatttaatcgcttaaagcccttctcttgcctagcggatcgtgatacaaaaagctgacttttcactagcaagaggaatcgattatgatgggacaatggacaccagaagtttggtctgcaattggcgttgcctttgtgattggcatcattgcaggatgcgtgattgtacgtgcttttaagggcaatgtgcagcaacatattcaactcgaaaatgagctaaaagacaccaaagagaaagtggaagaacaaaagcagcaacttgagcaacattttgaacaatccgctgctttactctcaacccttgctgaagattacaaaaaattgtatcagcacttagcgaaaggttcggaaaaactattacctgaagcagaacaaatcgcttttttcaaacaatctcaacttccgctcaaacatgaaaatagtgaagaccaaccgagagattattcggaaggctcatcaggcttattaaaatcgtaaaatttcatcaaaaaaagaccgcttatttggcataaccaataagcggtctttttatgttatgaatcggacaattcctctaataaacatgttttcagtaatttctgctgttctttgcttaatgcctgattttgcgaggtgcagacgacaaagaaatcctctacccgttcaccgatagtcgtaatttttgcattgaccaagacgagttctaattgcccgaaaatatgacttacctgagcaagtaatccttctctgtctaaggtaaataactcgaatgaagtttggtttgggtgttcatccgagagaaatttaactttggttgtgcgtttaaaagattgatgtttcaccggttttctcaataatttaaacgttacgctttccgcatcggtcagtactcgctgcaaagattgacgaacttgttcacaacgagaagggtcaagctctgcaccgcttaattccgtgacgatgaagctatcgaataccaagccattattactcgtgataatttgtgcatcgtgaatactgatctttttctgactcaacgcttgagcaatacgcgcaaataattgcggttggtcattacagtgcacaaaaatttcggtcgcccctcgtgcatattcgttactcactaataccattggtaacgttttatgtttgagatagtctaatgcgtgccaaaccagctgctttggcgtattacgtaaaaagtaaccatcaggacaaggcgcccaaaagtcttgcaagcgtgttcgttctagaggtgataaggcaaacttcataagttctaacgcatctaaacgattttgctggctaacacgttgataatccagtcgtttttctaattcctcgatagtaaattgataaagttgcgtaaacaaagaacgcttccaatcattccataaactttcattagttgcgcaaatatccgaaatagttaggcacatcaaatcggttaaagcggtcgaattttccactatttttgcaaaacttttcactaccgcaggatcatgaatatcacggcgttgtgcagttaatgacatggttaaatgctctctcactagccatgtgatttgttgcgcttcagcttcggaaaaaccgtgtaataccgcaaactgataagcatcgaccgctccgacttgagcgtggtcaccttctcggcctttcgcaatatcatggaataatgccgcaagatacaaaataggtttatgtgtacaagcccggaaatatttacagcataaaggatgtaattcttcagcatcatcagttaaaaaactttccaatttctgcataacacgaatcgtatgctcatcaaccgtatagatgtggaacagatcaaactgcattagccctttaatgccgtcccactgtggcaaataggcggataacacgcccaattggtgcattggtataatcgcacgttccaccaccttcggctgagaaaataacgagataaaacgggctctagcttcagcatccatagataacggctgttgctgtttttttaatgccaatcgtaaattacgtagtgtgatagcgttagctttagcttccgaatactgcgttaaatgataaaaaagatctaaaattgataccggatcttgcgtaaaacaacggcgatgacgacaaacaatctctgttccttgtaaatagtagttctgatcaagcggtcgtttttcggcaacattttgctggccgagaataatttgctcgaagttatccagtagcaattgacttagttgcgaaatggattgagtagcttggaaaaacgctttcatcattgcttcaaccggctgattcccttcgcctttatagcccaattgttcgcttagctgcaattggcgatcaaaacgtaggcggttgtcataacgcttaagctgcaggtgtaaggcaaaacgcatctggaaaagtacggtttgcgcttcattcagctcactaaattcttcaggaaaaagaatccctttattcaataaactctcaaacgtataagtaccgaagtgtcttaatgagatccaagcaatcaaatgcagatctcgcaacccgcccggactatgttttagatccggctcaaggttatagctggtattatgataacgcgcatagcgctcgtttcgttcttgtattttagcgctaaagaagtggtcaatcggccagaaatcttctgcatataagctttcgaataaagcctgccatagcgctttattaccgattaaataacgcccttcatacatattggtcgccaccgataattcgcttttgccgatctcaatacattcttcgagcgtacgaatactggcgccgacttgtaatttactgtcccatagtaaattaaataagtcattcagctttgaatgtgtttcatcatctaatgtttgcgctgtaattaccaaaatatctacatcggataaaggaaacatttctcgtctgccataacccccaactgcgataagtgttaaatcgtggcatgctgtaaagccgaattgttgccataagttcagtaatagctgatcataaaaatcgctacgttgacgtaacaacgtaacgacttctgtagtagcaaaatcgtttttttgttgtaagttaaattcggtgagttgatttttcaacattgtgtttgtcatctttttatctctaaaatataacgtgcttcaatagcacatctattctcaacaaaataacatcagcaagattaaagataaataaaaaagcggttagaatctgcaaattttttgcaatttctaaccgcttgtttttaattagccggcaacttgtggtaagtaacctagctgaataaagaacggaataatcataataatgacaccggcgattaacgcaatcacaagtgctgcattgccgccaatgactcgataagctaaattaggatgtagcttacgagctttccatgctaaaccgattggtaataacattccgtagaatgcaaatagcaagcctgcataacctaatgcggcaataaatccgtttggatagaacagcgcaaacaataccggcggaataaaggttgctaaggtcaaccataaacgattcgccggtaaattcacacgttttaataaatcaccaacacactcgaaaatacccattgccacacctaagaatgaggtaatcaatgcaagtgctgagaataaacgcaccatttcacctaaaatcgtgctgccggtaatttggctggttgctttaactaaaccgtttagtgttgggtcttgttttaagatctcaacgaattccgcttgggttaatacaccgtgcgttgcaagttgccataataaatacgctactaacggaattgcagtaccgatataaatcgcaatgcggattttgcgaatatccgcatctaaataggtattgatactcgccataatcacgtggaaaccgaatgaggtaaagaaaatcggaatggctgatactacaaataagttatcaagcggaacggcagttaaattctccaattttgcttttggtagcatcattagtaatacaaagacaaacgcaacaattttcccgataaataataagcgagttaaaccatccacgcctttaataccaattaccacgaatgaaccaagtaaaacggtaaagagtaaaataccgacttgagttgtagtatgcgcatcgccaatttgaggtaataagccagaaagcagcgagccgccgccagtaatataagcggctaataatgcatataataaaattagtaaacttgctgtcgctaataccctccccgtgataccaaaatattgttccgctaaacttgccacaccaatatcttgcttcggtgcggtttggtaaacctccataaacagcaaaccggtataagctaataacgcccataagcaaatgagtaacgcgactgttgcgccaaatcccattcccgctgaagtaagcggcatcgctagcattcctgcaccaattgttgtgccggcaatcatcaaggcactgcctaaaattttatttttcatttatataataaccaattagattgtatttacagttaacttaaaacaagcggtcaaaatttgtaattttttagcaaaacttggccgctttcactcatcattagccaattactctcggtaaataaccggcttcaataataaatggcacattaatgataaatattgctaataataatgcaatcaataatgccacattgccaccaaatactttgtatttagcatccggatacaattttcggaatttccataccatcgcaatcggtaaaactaacgcatagaaagcaaacatttgtcctgcgtaccccagtgcggcaataaaaccttccggatagaaaaaggcgaatagcattggtggaataaaggttaatgcgccaagagaaatgcgaggtgtgttgatatgtactcgtttaaataaatcctctaaacactcaaataaacccaatgccacacctaagaatgatgtaattaaagctaatgctgagaataatttcactgcgccgccaattaccgagctaccggtaatttgctgaatcgcttccgctaagccatttaaagtcggatctttctcaattaactgtaaaaatgcggtttgatttaacaaaccgtgtgttgcaagttgccataacacataagcaattaatgggatcgccgtaccgactaaaattgaaatacgtaacgcttttacattaccgcctaaatatttatttaagctaggaattgaaccgtggaaaccgaaagccgtaaagaagaccggtgttgcagaaattaataatgcattatcaatcggcatctcaagcaaattgcttaccgagatattcggtaataacagcgctaatactaataaaaatgcaccgattttcgttaagaataaaatacggttaatcacatctacacttgtagtgccaataacaacaaaagcaccaaatacaagggtaaaaataacacccgcaattcttttggttgtttcagcatcattgatggttggcatgataccagccaataatgaactaccaccagaaacataagcggaaagaatcgcatataaaaaaatcactaatacagcagtagaaacgatacggccgaaatttccataatatttttcggctaaagtgccaatgcccgcatcactttccacgttttgataaagttcaacaaacagcaaagcactaaaagaaagtaataaccaaagtgcgataagcaatgcaaccgtccagccgaaaccaattcctgctgaagtgagaggcattgccagcattcctgcaccaattgtcgtccccgcaacaattaatgtactgccaaaagttttgttttgcatatctaacctctaaaattgttattaggtgggctattctacaagaacaaaaaacaaatgtaacgaaaaactttcactgtaaaccatattttacaccattaaaaatcaatgagttagctccattttagggcttgtaagtttccaaaaaaattcaaccgcttgtaaaatcaacaaattattgtaataaaaaagccgagaaacatttgcttctcggcttgtattgatagctaataattaagcgtctgcttgtttatctgcaacttctgcatccgtattcggcgcatctgtcggctgctgttcatcagacttcgatgccgtgctggaatcatttgacgaactatgatcgttcttatcattccaaccagccggttcaccaaccggacgacgattcattaaatcatcaatttgtttgcgatctaaggtttcatattttaacaatgcgtctttcatcgcatgtaaaatatccatattgtcttctaaggttttcttcgcacgctcgtagttacgatcaatgattttacgcatctcttggtcaatcagtttttgtgactcttccgatacgcctttgattgcccccataccgtcttcattttgatagaacaacggacctaactctttagagaagccccattgggttaccattgcacgagcaatttgcgttgcacggtgaatatccgaagacgcaccggtagtaattttatcttcaccaaaaatgagtccttcggcaattcgtcctgcaaataaggttgaaagctgactttccaatttagtaaaggtttcgcttacacggtcaccttccggtaagaactgcgcaaagccaagcgcttgaccgcgaggcacaatggttactttattgagcggatcgtgctcaggcattaaataaccgacaataacgtgaccggcttcgtgataagcggtattcatcaattctttttcggtcatcgtatttgaacgacgttccggtcccatattgattttatcgcgtgctttttcaaagtcatccatagttacgacacgttggtttttacgtgcggcaaataatgcggcttcattaactaagtttgctaattgtgcacctgaataacccggtgtaccacgtgcaaccaccattggatcaacatccggtgcaagtggcacttttttcatatgcacttttaagatttgctcacgacctttcacattcggtaaatctaccgttacttgacggtcaaaacgtcccggacgagttaacgcatcatcaagcacatccgcacggttcgttgcagcgataataataacgccttctgagccttcaaaaccgtccatctcaactaacatctggttaagggtttgttcacgctcatcatgaccaccgctaaaaccagcaccgccacgtttacgaccgactgcatcaatttcatcgatgaaaatgatacaaggtgcatttttcttcgcttgttcaaaaagatcacgtacacgagaggcacctacaccgacaaacatttcaacgaaatcagaacccgccatagtaaagaacggtacacccgcttcgccagcaattgctttcgctaataatgttttacccgtacctggaggccccaccatcaagataccttttggaatacgtccacctagtttttggaatttactcggatcttttaagaagtccactacttcaccgacttcttccttagcttcatcacagcctgcaacatcggtaaaacgagttttaacttgctcggcagtcagcatttttgctttgcttttaccaaagctcattgcgccacgaccgccaccgccttgcatttggcgcatatagaacacccaaaagccaattagcattaacatcgggaaccatgaaataaaaatctgcgataacaaaccacggcgttcttccggttgaccggtaaccgttgcgtttgtttttgctagatccgccaataagtattcatcatacatcggcatcacggtttgatattgcgtaccatcatttttagtaacagagatggtttcatcattacgtttgaaatccacttctttcagattattcgatttgatatcgtttaagaacgttgaataagcaaccgtattattgttaccaaagtttgagttaaagccttcaaaagccgtcatgagcacaatcgccacaactacccaaaggacaatatttttaaccatatcgctcaaggttaatttcctcttttagaataaaaaaaacttgttatgtcgctagataataagcggtctgattttgcaaattttttgcaatttttaaccgcttattaacctttataacctgttgctacaatataaacttctcttgaacgatctcgagaagcttcaggtttacgcactttcacggtgctaaacattgcacgaatatctcttaaataatcatcaaagccttcaccttggaacactttaacgacaaaactacctttaggtgcaagtacctgacgacacatatctaaagccagttctactaaatacattgctcgcggaatatcaactgacggcataccactgaaattcggcgccatgtccgacattaccacatccaccatatcatcaccgacacgttctaacagtgcattcagtaccgattcttctcggaaatcgccctgtaaaaaatccacaccgacaatcggattcatatctaaaatatcacaggcaataatacgacctttactgccgatttgcgttaccgcatattgtgaccaaccgcccggtgccgcccctaaatccactacggtcatccccggtttgaataagcgatcggtttgttgaatttcatctagtttaaaataagctcgtgagcgtaatttttgtttatgtgctttttgtacgaactgatctttaaaatgttctgccagccaacgcgatgaactcgcacttctttttctgcccattaaaataaatctctttcctgccttttaaaaaatctagtttaccataataagggcaatttggcgctattcaagagcgaaaagagaagtaaagttaaaattttgtaataagcggtcgatttttgtcattttttacaaaaaacaatcaaccgcaaccgtttgcgcaaaattcaattttacaactttgtaaaacacctgtataattcgcccgcaataatttctagacagcaattttattttatcttttaaggaactattgcaaatggcattacgtatcaaacaagaagcccttacctttgatgatgttttactcgtcccagcacattctaccgtgcttccaaataccgcagatctttcaactcaacttaccaaaacgattcgtttgaatatcccaatgctttcagctgcaatggataccgttactgaaaccaaattagcgatttctttagcgcaagaaggtggtattggctttattcacaaaaatatgtccatcgaacgccaagcagatcgtgtacgtaaagtgaaaaaatttgaaagtggtatcgtttctgagcccgttactgtatcaccggatcttacccttgccgaacttgccgaattagtgaagaaaaatggttttgccggctaccctgttgtcgatggtgaagataacttagtcggtatcattactggtcgtgatactcgttttgtgaaagacttaagcaagcctgtttctaaattaatgacacctaaagagcgtcttgtgactgtaaaagaaaatgcaactcgtgacgagatcttagaattaatgcacgatcgccgtgttgaaaaagtccttgtggttgatgataacttcaaactaaaaggcatgatcaccgttaaagacttccaaaaagcggaacaaaaaccgaatgcgtgtaaagatgaattcggtcgtttacgtgttggtgcggctgttggtgctggcccaggcaatgaagaacgtattgatgcgttagtaaaagcgggtgtggacgtgttattaatcgactcttcacacggtcactctgaaggcgtattacaacgtgtacgtgaaacacgtgcaaaatatcctaatttaccaatcgttgccggtaatattgcaactgctgaaggtgcaatcgcattagcggatgccggtgcaagtgcagtgaaagtaggtattggtccaggttcaatctgtactacacgtatcgtaaccggtgtaggtgtaccacaaattactgcaatcgcagaagcagcagcagcattagaaggccgtggaattccggtcattgccgacggtggtatccgctactctggcgacatctcaaaagcaatcgcagcgggtgcaagctgtgtaatggtaggttctatgtttgctggtaccgaagaggcaccgggtgaaatcgaactttaccaaggtcgtgcatttaaatcttaccgtggtatgggttcattaggtgcgatgagcaaaggttcttcagaccgttatttccaatcggataacgccgcagacaaattagtaccagaaggtattgaaggtcgtatcccttacaaaggtttcttaaaagaaatcatccaccaacaaatgggtggcttacgttcttgtatgggcttaacaggatcagcgactatcgaagatttacgtaccaaagcacaattcgtacgtattagcggtgcaggtatcaaagaaagccacgttcacgatgtaacgattactaaagaagcacctaactatcgtatgggttaattcttaggttatcttgtgcagcacagtacccacggcttatgccgtgggttacgcataattcagcttctctagagctgggccttacaaataaacaagagctacagcgtagctcaactatgcgtaacctagggcggctcgccctaggtttttatgaaaaagagaacaaaatgaacaacattcacaatcataaaattttaattttggacttcggttcacaatacacgcaattaatcgcacgtcgtgtgcgtgagattggggtttactgcgagctttgggcgtgggacgttaccgaagaacaaatccgtgaatttaacccgaccgggattattctttcaggtggtcctgaaagtaccactgaagaaaatagccctcgtgcgccggaatacgtatttaacgcaggcgtgccagtacttggtatttgctacggtatgcaaaccatggcgatgcaattaggcggtttaactgaaacttctgatcatcgtgaattcggctatgcttcagttgatttacaagcgaccgatgcgttatttgcaaaattaaacgataatttgaccgcttccgagccgaaattagatgtttggatgagccacggcgataaagtaactcgtttaccgcaaggtttccaaatcactggtgtcacacctacttgcccgattgctgcaatgtcagacgaaagccgccgtttttacggtgtacaattccacccggaagtaacccataccaaaagcggtttagagttattaaccaacttcgtagtaggtatttgtggctgtgaatgtaaatggacagcagaaaacattatcgaagacgctgtggctcgcattaaagagcaagtgggcgatgatgaagttattttaggcttatcaggtggcgtggattcatcagtaactgcacttcttctacatcgtgcaatcggcaaaaacttacactgcgtattcgtggataacggtttacttcgtttaaatgaaggcgatcaagtgatggaaatgttcggcgataaattcggtttaaacatcattcgagtaaatgctgaggatcgtttcttagatgcattaaaaggcattgatgagccggaagcaaaacgtaaaaccattggtaaagtgtttgtcgatgtattcgatgatgaatcgaaaaaactgacctcagtgaaatggttagcacaaggtactatttaccctgacgtgatcgaatcggcagcaagcaaaaccggtaaagcacacgtaattaaatctcaccacaacgtaggcggcttaccagattatatgaaactcggtttagtggaaccgttacgagaattattcaaagatgaagtgcgtaaaatcggtttagcacttggtttaccggcagaaatgttaaatcgccacccattcccaggcccaggcttaggcgtgcgagtattaggtgaaatcaagaaagaatactgtgatttactgcgtaaagcagatgcaatctttatcgaagagctatacaaagcagattggtattacaaagtaagccaagcgttcaccgtattccttccggtgaaatcggtgggtgtaatgggcgatggacgtaaatacgactgggttgtttcactccgtgcagtggaaactatcgactttatgaccgcacattgggcgcatttaccatacgatttacttggtaaaatctcaaaccgtattatcaatgaagtaaacggcatttcccgcgtggtatatgacgtttcaggcaaaccacctgcaacgattgagtgggagtaagatttaaaggcactatttatagtgccttttttatatcaatgtagagaatatgtaatgactacagaaatactcaatgaattatcgcccctttcaagttcagaaaagaatcccgaaccttggcatgttttgataaaagcagttaatactacggatattattggtacagttttacgcctacacttagttctagagaaaactattgaaacatatgtttgcataatcacaaatcaaaagaacttatttggattctcatcagtggataatgaaaaatttattattgagtgttcaaccaagctaaaaatggctaaggctataggactcccgagtaaattatataaagcctcatcaaaaattaataaaattagaaatgaaatagctcatataaccgatgtaactatatcagaatcggatcttaaaagcgcactcgcgcatctaacacaatatttagctgaacaagacaaagatatattaaagtatggattagaattacgagaatttgatgggactattctttataataaaacatttggagataaagacatatcaagcaaagataaatttatactaattgtaagtaccatagttaatgaaatccatcatctgatgataactcaaagtcattaatataaagatcgtaattgacactaatgctatactcccctttttagatagccaattccttatctaattacttaataaaaagtgggtttgcctaggtaaagacttataacccactttatgataacttttactaggttaactatttcttcctagcaaaattctcatcattctgacaatatactaaacaatcacgaattaacccactgattctcaatatattttcaggtctatctataataatattacttcctgtaatatctaatcctgctctctgaatctctgcccggtgaatatctaaaagctctaatggcacattaatgcaaggatgctgtttattatcaaaataacgtaatatccagcgattagactttccttgaaataaaatactaaaatagctttcagtatctttagccactaattctacagattctccgagtattaatacaacatagtcaaataactgtctttctgtatacgttgttataattttattgttttctgaatctactatcggagccttctcatcaatttgaggttcttgtgcctctgtatcttctacttcattctgagcctgtcttgataacccagacacaaccattgcgctaacagctttttcaaccgcttgcttaacgatgggagtaattgcgtcaataaaacgctgattaagctgccttcctacattagaacgtcctgctacatatcgaacaaattcagagtcaacctcttttaagctttcacttattgtcttagtgaatgccgataaatatacactctcttctgctaatgttctcaacgcttctggctgaaaacggtcatgacaaaattggcttaactgattaatctttgagtcatctacattttcgaaattaatccgcaaaaatggcgattcatccataatatttttatcttttagatccgtaaaaaatcgccattctcgcccattagtcacagcagcaacagttacctcgggtgttgcattaaaatatctcgctaattgtggaacatgattagataaattttcattatatgatttagcttcaatgaacattaccggaacatcatggcaaaataaagcataatcaacacgttccccatttttcacaccaggaaagtctgccccatactcagctcgaactttcgttgggtcataagggttaaaccccaaaatatctagcaatggtaaaattaatgcttgcttggtcgtttcttccgtactgcaatgtgaaccgaccttaataacatgctgaatatgtgataatactttttctttaaatatactttgattcattattttatcctcataggtaagaaaactataatctatccgattcggtatttatatactgtgatagcaatcacaaaatcatgaaataaaataataaaaagtcatttatatattaataactaagacctgagctagctttcacgcacactttttctccccaactcataatactcttttattgaggtgccatagccatctttagttattgtgccattttgggcaaatttgattgcgttgccgacgcctttgagatgtgcggcgaatagaagtcctgctttatgtgcggcactgccttgataaacgccttttgtttccattgtgcgagcattgcggttcattagtttaataacagcatcatcttgaatcatttttgaattcaaaaaggcaaacttcccgccggctaatacccaattctctgcgtttgccagaaaagctctgtgctgaacagcatttgcaccactggcaatacccggttttgttttaattgctgctgcatatttatctttttgaatcaaaccaacatctactaacgccgcagcaccgaattgataagcacctaaatagccatagctattttctgccgtataatctcccccgctctcacgcttggctagtgcttgtaataacattttggtttgattcaaagtgagtccttgtaccgtattcccttttccaattgattttaaagctaaatcagcaatttgttttgccattttaattaaactcatttttaccacctttttgagattaataatgctttttggcaatcaatctataattgggttcagtttttgtcttttccttaaataattgacacaaaaaaagcgaaccattcggttcgctcttaaacatattatctactaattaattattagcaatcttgcttgccatattgctcttggcgtaataattcacgtacgctttcatcgaattggcttaatactttatctgcatctgccgcatctttaccttttgcatctaagtagaacttaattttcggttctgtaccagacggacgagtaattaaacggctaccgttttctaatacgaatacaagaatgtcgctttgacgatctgttttcgtatggtcaattaattgagccacgttgaaaccaccgattgcacttggtgggttgttgcgtaatgccgtcattaatttaccgatttcagataaatcgcttacacgaattgaaatttgaccgcttacataagcgccgaattcattattgaaatcgttgattgcgtcttgtaacgttttaccttgtgctttcaagttacggataaagtctaagaacacaatagccgctgaaataccgtctttatcacgtactttatcagggtcaactaaatagcctaacgcctcttcgaaaccgaataataaaccatctactttaccgatatatttaaaaccggttaaggtttcttctgattgtaaaccgtattttttcgcaatctcagccaatgcaggtgaagatactaatgaacaagctaatacgccttgtttaccttgtgcgtgatactgcttagctaaataccaacctaataagcagcctacaacgttaccgtgtaaacctttccagttgccttgcgcatccggcattgccaccgctaaacggtctgcgtctgggtcgttcgcaatgataaattccgcatttttctctttcgctaatttaattgctaagtctaatgcacctttttcttccggatttgggaaattcacggttgggaacgaaccgtccggttgaatttgttctgccactaaatgcggttgtggtaagccggctttttctaacgttttgcttaacacttcataaccgacaccgtgcattgcggtataaacatagttaatctctgctgccagctctttcgctaatgcagctgtttttgcgatatatgcttctacgatttcatcatctaataccgtaaagtcttggctacgtggtagatccgcaatattacctgccgcaactttatcaattaatgctgcaatatctttatccgctggtgaaacaatttgaccaccgccgtttgctttacctaaatacactttataaccgttatcttccggtgggttgtgacttgctgtcaccataacgcccgctgtagtatcaaaatatttaattgcatatgcaagtacaggcgttggcaatttacgaggtaataagtaagctttgatacctgcacccgccataatttccgcggtgtcacgtgcaaacacatctgagtttttacggccgtcataaccaataacgattgaaggttctttatcatagcctttcaagtaatccgctaaaccgccggcagcttgagccactaatactcggttcatccccatagaacctgcttgtaaacgaccacgtaaacctgccgtaccaaactgtaaacggccgtcaaaacgtgctgttaactctgctaacgctttttcgtcacctgcttgtgcagcttcaatcagttgagctaattcagcacgagtttcttgatctgggtcttgtgctaaccagttttgtgcaatagtaaaaattgtactcatagcaattccttaaactaaaaaataatgaatgaaaacatgtatagcctatctgaaaacagcgtaaataaaaatgatttatttcatctttttagcaagtttgtgatctatttctcaaataaaaaccaagcaaacggttgcgactatctaaatgaaaaataagcatttttcgtattaatcagattttatacagtcgaagggggaatctgcttattatgccatttttttacacgaaaagacattcgctatcgccctaaacaagcggttaaatttcagctagatttttcaaatttttcacaaaaaacaaccgcttattctctgatacgaatcctgattgtaaactttttaaaattaatagataaatttttcggataaggtcagaatgcgcacttttctagttattttgaaattttctttcagtttaagatgttaacgactatgtttacttttatccaaaaagcagtcaataaatcgctgcgtaaaatcattaatacaaaaaatcgccaagctttacaaaatcactcgatgtcagtagtttctattaattgcaacggtgcatttatcttgcatgaattaggtgaacaattccgttcgccgtttgttaatttatacctttcaccgaccgattttttaaaatatttaaaaaatatgtcgcattatatgcaagcagaactcactttcttggctacggaaaaaaattatccggtgggtaagctagatgatcttacgatccattttatgcactaccattcagagcaagaagcggcaagcaaatgggaagaacgaaccaaacgcattaatttggataatttgtttgtaatgatgaccgaccgtgatggctgcacttaccaagatttacaagagtttgaccgcttaccattcgaaaataaagtggtatttactcacaagccttacccggaattaaaatcagctttatatgtgaaagggtttgaagataaaacacaagtcggtgatttgtttgagttttctggttggaacggcaagaaatattacgatcagctgaattatgtgaattggtttaacgggaaagggggctagtttatgtttaaggtttatggcttgaccgtagataatcagacacgctgtcagcattatcattccgtactggatattatcgctattaaattcaaatgttgtgataagttttacccgtgttatcaatgccaccaagcctgtgagactcacgctattgaacgttggcaagcaactgaatttgataagcaagcaattttatgcggcaattgtcaacaaacgctgaccattcagcaatatatgcaggttacacattgcccttattgccaagcacaattcaatagtggttgtcagaagcattattcgatctattttgaagtatgagtttaaagctcgaaatagttcgcacataaatagaaacaagcggtcgaatttgcagaaaattttgcaaatccgaccgcttgttacatatgtattgagtaactaagaactattttttcttagttgggcgctgccagccttggatatgacgttgcggtacacgactaatcactagctcattttccgccacatctttggtgatagttgcacccgcaccgatagttgcaccgtctgcgatagtaaccggtgcgactaattggctatctgagccaacaaacacattgttgccgataaccgttttgaatttgtttgcaccatcgtagttacaagtgattacacctgcaccgatattacaattgctacctacttccgcatcaccgacataggttaaatggtttacttttgaacctttacctacttgagcatttttaatctcaacgaagttaccaacgtgagtttcttccgcaagatttgcgcccggacgtaaacgagagaacggaccgatttgcgccgctttacccactactgcatcttcaagcacagaatatggtttgatttctacatcatcaccaatttcgcaatttttaagtacacaacctgcaccgatacgaacacgattacctagttttacttcaccttcgataattacgtttacatcaatttcaacatctttaccgtgtgttaagctaccacgaatatcaaaacgagccggatcaattaaacgcacaccggctaatagtaatttttctgcttgtgttttttggtagaagcgctctaacgcggcaagttgtaaacggttattcgccccttcaacttccataaattcacttgcttgtaccgcttgaactttatagccatcttggtttgccattgcgattacatctgtaatatagtattcgccttgtgcattgttgttatttaaattacctagccattttttgaagcttgcgccgcttgcaaccattacacccgtattcacttcacggatttttaattgttcctcattcgcatctttttgctctacgatcgcaactacagatccgttttcacgaataatacgtccataacctgtcgggttatccaactcaacggttaacagcgcaataccattttctggttttgctgcaattagacgttctaaagtttctttagtgattaacggcgcatcaccgtaaagcattaagatattctcatcatccgcaaagaatggcgctgcctgttgcattgcatgacctgtacctaattgctctgcttgtaatacccagtttaccggctcagaacttaagcgttgttgtaataattcaccaccgtggccataaattaaatgaatttgttttgcatcgatttgcttcgctgtatcaataacatgtttaaccattggctttcctgcaacggtgtgaagcactttgggtaaatcagaatacatacgagtacctttacccgcagctaaaattactacgcttaattgagtcattgtgtaatcccttaatgaattaaataaatactataatattgtaatagaaaaatgtaataaacagaatgggcgatattaattagagctcattttgcttagtttacttttattggatacgaattcatccaattagttcgaatctctttgcaatattttatcaattataatatataaataaaaagctccgaccaatggacggagctcctaattaattacacatttgcgtgttcaattttttctacttctttagcatacttttcttcatcaaactcgcgtagcggtttgtgtgattcgcctaagaatgtataaattaccggcagaacgaataaggtaaataatgtaccgatactcaaaccggcaacaattaccatacccatactaaaacgagcaatcgcacctgcacctaccgcaaataataatggaatcaaacctgctaccattgctgcggttgtcatcataataggacgtaaacgaatcgtcgctgagtgaacaattgcatcaaagcgagataaaccattgtttaactgctcttcttttgcaacttcacacattaagataccgtgcttcgtaattaaaccgactaatgtcactaagccaacttgtgaataaatattcaaagttgcgccggcaacacctgcaatgccaagcaaattaagtactagcaatgcaccacttaatgctaatggtacagaaactagaattaccatcggatcacgccaagattcaaactgaatcgcaagtacgaggtaaataataattaccgctaaggcaaaggtcatcgccattgcattaccttcttgaacatactgacgagcttcagatttaaagtcgtattgatatcctttaggtaagctgcgatccaactcatctttcgcccaatttaccgcatcaccaatcgagcttgatactacgcccgaaatggttgctgaatttaattggttcatacgaggtaatgctgatggttctgtcgaaagctcaagtgtcacaaatgagcttaatggaaccgattcaccacttgctgttgtaacatagtaatttactaaatcttgtggatttagacgatctttacggatagcttgcgatacaatcggatacgcacgagaatcaatatccacacgtgtaataatcgcaccagataagtacgcacctaacgtaccactcacttgttgcatcgttacgccataagttcccattttctcacgatcaaatttccatttcatcgttaccgtatcaaatttcaaatcaagactcgagaaaaagaattgacctgaagcttgcgcttttttcaggaactgagttgccacatcagctaacttagtatagttatctgcggtagtaatcactaatgagaacggtaaaccgttttcaccggttgaaatttctgggaatgaaatcgcattaatatccatcccgacaacatttttagcaattgcagaaacgtctgctgaaattggtgcacgttcacgttcacgatcattccaatcctttaatgagataattgataatgcactatttgcaccattaaacccggatacagtcatcattgatgctacttccggtattttacctacctcttcattaaacttctctgtcgcagcttgcgtataatctaagttagtgtttgacggaccattaccgataccaaccacgaagccacggtcttctgtcggtgcaacttcacttgaaagtgatgttaataatgtcggtaatacagcaaaaattcccaatgcaaaaatcaatacaaaccaacgcatcgccatcacacctctcagcatattggtgtagcagctggtcattttgtctaacatcgcattgatacattttgagaaacgactttcgtgatcttcattgtgctcttttaatactcggctagacatcatcggtgataacgtcaatgcagcaatacctgaaataaataccgcaccagctaaggttaatgcgaactccttaaataaagagcctgttacaccatccattaacgccattggagaatatactgccccaagtgtaatcgtcatcgaaataactggaatagcaatctctcgcgtaccaataatagccgcatcaaacggcgatttgccttctttaacatgacgttctacgttttcaagaacaacgatcgcatcatccaccactaacccgattgcaagcactagagcaagtaatgttaataggttaatagagaaaccaaacatttgaagcataaataataccccgatcaatgagatcggaatggtgataattggcacaatcatcgcacgtaatgaacctaagaataggataattaccactaatacgatgacagttgcttcaccaatggtcttaattacttcattaatcgaactattaatagcaatggttttatcatataaaatttgaccgctcattgatgacggtaagtttttggtaattaattcaaataccggataaatgtcttttgctacagtcaatgagtttgctgtcgttgcagcactcaccgctaatacaaccgcttccttaccgtctgcaactactcgagatgcgtcttggtatttatctaactcaacctttgcaatatctttaagtttaacaatacgaccgtccgatgttgttgaaatcgtaacgttttctaattcttcaactgacggcgtacttgattccaccttgtttttataaacagtatagtaaccgttcgcattccccgcggcagtatttaagttattcgcgcttagtgctgataatacagccgcaccggaaaggttattgccagccattttttcaggatctaaccaaatacgtaaaccgaaagttgccgcaccaaaaatatctacgcttgaaacaccgtttactgtaaagaattgtggttttaccacacggttaatgtagtcggtaatttgtgaaggatttaattcatccgatacaaaacgaatatacattaacgcatcatttgaacctgatgatacgctaatagacgggtcatcgatcccacttggtaaatttgcacgaattgcattcaccttcgcagaaatatccgctaacgccatttgcgggttagtatttaacttcatcttaatcgtggtagttgatgtactcggactacttgaagaagttacatagtcgatattatccgcttgcgctaccgcctcttcgatttgagaagttaccaacgcttgcatcaagcttgcatccgcacctgaatagttaacgttaacagttacgatcgaaatcgtcatttcaggatattcacgaacttgcaatttattaatagattgcaaacctaaaatagtaatcagcaaactaatacaaacggcaagtaccggacgtttaataaaaatatcagtaaatttcattgattacctcaattaaagtctactttctttagcaggttgagtaacacctaccgcctcttgttcagaaacaatcacaagtgcgttattacttaaacgttggaagcctcctgtcacaattaaatcgccggctttcactcctttagctaattgtgcataaataccgctacggtctaatgtttttacttcaacctgttttgcgcgatacattctattcacatctaatttcggattttgctctgccatttttgcaactaattgcttatcttcgtcagaaagcggttgtaacacataaagtgtttcaccatacattgtgtatgtcactgcaatttgtggtacaacaatttgctgtttctcggtcggtaatgccacattcagacgagcaaacatacctgataaaagaagattttggttctctgtaatcaccgcttctacattaattaagccggttgtatgatctactgctggatcgattgctgcgatatttgctgggaatgtttgacccggtaacgcatcaatgactgccgttactttttggcctacactaattttttgcacatcagtttgcggtaaagtaaagcgaactttcatgacactttgatcttcaacacgcacgatctctgtacccgctggaatgtattgccctacgtttacattaacgataccggcaataccgctaaacggtgcgtaaattttacggcgaccgatagaggctttaagtgactcaatattcgcaagtaagtggttataagttgattgcgcattatctaattcagctttcgatgcactatttgatgcgactaaattacggaaacgatcgtaatttgcttttgcatttggtaattgcgcttgcgatgcgcgtaaagtcgcttcttcaacggcactatcaaactctaccaataaatcgcctttatttacacgctgacccgagcgcacatgtactcgagttactgtaccagttgcttctgcacttagcatagcaccttgatttggacgaatgtatcccacagcagcaatgctcggtgtccactcttgtggctctactttcatcgcagtaatttcacttacggtttccggcatattcgctgccgcttcagcttttttccccgcaataaatttttgcattccagcaacaccaccaaaggcaaccagcactactgctaaggttgtcacaattaaaaactttctgccacgagagggcttttggttttctactgtcatatattctccatagacaaattaactaaatttagaaagtaatagctttccaagtacgtgaaataatttcctcgaaatattcttccggaacaacgtctttcttgacctgttgtaaatacgcaatgtctgttgccgttcccatactcaggtaatacaacacctcgttaggtaaatcgacaattacaccttgctttttaccttcgtcaacaaatcggttccaaataaattctggatcattaattgttctataaacaatttcgctgaaaccaagcatcgcttggtattgggacaggtgaatagcaatcatggggttgtcagacaagaactgccactttctaacccacatttgacgatattgcttgaagagagattcgttcggatcaaaatcaatgttgatatagcagctatagcgttcataaatatgattggctagctgacttaaaagttgatcttttgtactaaaatataaataaagtgtaccggctgccacgccaatttcttttgctatcttgcgcattgataaattctgtaagccttcctttgctacaagtaactccgttgccgataagatatggttgatcatatcattcggatcagttcgtctggacataaaacctcccatgtttaaatccaatgaacagtcgttcattttatatttattcattataatttaaaagaaaaatatctcggccgataaaaagccgagaaaaattaactgagcattttatcactaactcctttgtatagtgatttttttactctaatttgcaaaaatatggaaaatcccaccgcttattactctcattccgactaattttatgctactatttgccaaatttttttaacctatctttttaatatggcaactcaatcaaaatatcaaagtaaacaattcgatgcattatccagtgatttaattgcaacactggaaaaacataaagctcctgttgatctttcattaatggcattaggtaatttaattaccaatatcttacgtgaaaacgttcaaaccgaagcacaacgtcatgctttagcagatgctttctcaaatgcattaaaaaattctttaaaaacgaaataagtatgtttacacgccttcgctcattattaccgaccaattctcgtcaatatcgagaagaaacctcacaacgcattacgtggggtcattggtttaccctttttaatgtagtgttggcgttacttatttcttcccgctacgcttttaatgccgattggcctaatacactgtcaggtaaactttacttttttaccagtctgttcgggcatttcagttttattgtatttgcctgctacttactgctactctttccattaagtttcgtcatcaaaaatgaccgtactttccgaggtatttcagttattttagcaactatcgggcaaacctttcttttagtcgataccgaagtatttaagcgattctatctgcatttatcaccgcttgtttgggacttattagttaatcccgaacaaggtgaacttactcgtcaatggcaattactctttgtaccaatgccacttattttgttagcggaaatgctctattcacgttggtgttggcaaaaattacgtagttttaatcgccaaaaatggggtaaatatgttgcttattttttcttaagctgttttaccgcgacacatttaatttacgcttgggcggatatgacgttataccgtccgattaccgcacaaaaggcaaactatccgttatcacatccgatgaccgctcgtaccttcttacaaaagcatgggctgattgatcgtgctgagttacagcaagaaattgaagaaaatggtcgtttagacagtttctatttaaattacccgaaacaccaactgacctttactaaaaagcctcattcaaatattttactaatcaatttatcaggattacgtaataacgctatcaatagcgaaaacacgccaacacttgctgacgttagtcgtaaatcattacgttttatgcagcattacagcagtggtgactctcactctgccggtgtattaggcatcttttatagcttaagtggtaaatatctggattcggtattaggtaataaagaagcctctccgttgatgctagctcttcgccaatccggttatcagctcggcttattctcgcataatggctttgcggatccggtatatcaccaagcagcttttgccggtattttattgcctgaatccaaaaataacctagacgcaatctcacaatggaaacaatggctaacagagcgatctttaaatgagccgtttttcagttatttagatttaagtttaccgcaggcaaacgcttacgatcagcaaacccgattgctcgattggcaatttagtgagatttggtcacaattagaaaagaacgctttattagcaaataccatggtaattattacctctgatcaagctaatccaactgatgaaatgagctttactcagcaggatatgcaagtgccgttaattatctattggcaaggtgaagtgaaagaatacgattcgctctcaagccatttagatattatgccgacactgttaacccagttctttggggtacggaatcctcttagcgactattctcaagggatcaatttaaccgccccaaataatcgtctatgggtattagcgtctaaccataattggaatgttgcgattatgccgaatggtgaacaataccatattgatcgcaaaggtcattttgagaaatttaatgctcaaggcgaaaaagagaaaagcgatcgtccgcctttagcgctcttcttacaaatgattcagcaaagtaaccaatttgtcgagaaataaggattagaaatataacaagcggtcaaatttagcgaattttttactaaatttaaccgcttgtattctctataagcatttatgtgttaagcatataaaaacttaacatactattctgccgtttcatcataatatacttcacccatcatcagcggtttagcagtacgtaccagcgctgctcgagtgaatttataatcaccatctacgttctcgcaaaccatgtcaacgctgataaaaccggaaggatgttcaatcgttactacgctaccggtatctttataaagcggatgcgcaatcgtaccttcaatattacacgctgcagaaacacaaattgaaccggttaccgcatggcttgcatggcatttgtccggcacgaagtagcgagacgtaatatttcctttgcccaccggtgccgataaaatccccattttcggaatcactttttcagatacatcgcctaatcccatcatttcacctgctttacgacgaattggctcaatgacttcgaataacgcacgattctcatctagttccgctttggtttctttaccggttaaaccaagatcttgtgcattaaacagcaccatcggcatcgctacatcaatacaagtcacattatagccattgatattatcttgtttattgccggtcggaaaaactttaccggttttggccccttcaatctgactaaaattgagatttaccggcgatcccgttcccggaacaccggaaacttccgcattacccgtatattttaattgcttatttggtgactcggcagaaacttcgataatactgttggtattaacgttatttactacgacacttgtgataccatcttgtaattcaatcaagcccttttcactcgcaaaacagataataccggataaaatattaccgcatgaaggtgccgtatctaccactttttgaccgatacccacctgtgcaaataagtaatctaaatcaaccccttctttttcagattttgaaacgatcgccactttactggttacacttgtcgcaccgcccaagccgttaatttgagtcggatcgcccgatcccataattgccattaagaatttatcacgttcagctacatctgccggtaaatcatcttttaagaaatacacgccttttgatgtaccgccacgaatgatcatacaagggacttttttcattttttccacctttgcaaaaaagttatgaaatttgaccgcttgcgcaatctgctaagcggtcaaatttgcgaattattttactagcctaaaatacccatactttggagcattgaccaccaaccaaaaccaactgttacttggataaataatgtcaccaacgcacatactccaccggcaatccaaaatgacttcacatcgtgatagcctaagccgtagataactgcagccggtgccgatgcatagtgcgttaccatgctgccatagctattagagaataataaaccgaacgctaaaaatactggatcagctcccgctgccatacctactgcacaaaataccggcaccattgatgcaacataagccgcccctgaagcaaatacataccgaacaagcacactcagcgtaagtagtaaaatagtaattaccattggactacctaaatcagccggtactaaattgctcattgtatttgatagccaaacaaaaaatttcgcttgtgtaagtacagctgcaatacctaataaaccaccgtaccaagtcaatgtcgtccaaccgcctttgtttttaagcacatcgtcccaagacaacaccgatgtaatcacaatcgcagccattgcggcaattgccacggtaaattcagaaagatttaattgttttgagaacacccagcctaatactgcactgataaatacgccggctaatactttttctttcgccgtcattggtcccatcgcttctaaaccttcacgagcaatcgttttgttatcaacatttttaagttccggtttgtaaagcacataagtgacaaaaggtaacagtaataaagtgagtaagcccggcactgatgcggctaagaaccattgcgtccaacttacatcaatatttaaaatcggacgcatcaactcaagcgctactgcatttggtgccattgccgttaagaaaataaaacctgtggttttaaccaccatataagtattaagcagcaaataatgccccgctttacgaggtgaagtttcaggttctgagcctaaagaaacggcgatagattgcataattggagctaggataccgccaccacgtgccgttgttgatggcattgccggtgaaattaataagtctagcatcgcatttacatagcctaaacgtaacgttgtgctaccaaatgcgccaatcattttataagcaatacggcgacctaaaccggtttgcacaaatgctgcgctcatagaaaacgcagcaaacactaaccaagttgtacccgatttataaccatctaatactgaaccttgttttactgcgacttttgtaccgtcagctaacacttcagcgggcgtattaccaataataatagcggaaatcgcaacggcagctaacagaagagggggagccgggaaaggtttaagaatgagagcaagaatagtaccgatataaacacctaaaatgtgccagccaagcacagataagccttcaggcgtagggaaaatataagtaactattgggcatgcaagaataattacatagtgcagaagttttttcaggttcataagaaatacctcattgtaagtataaattcgtatagtcatatatataactagttgtatttatacttgcaagtaccgatctcgcaaaaatttgagataaatcataaaaaagggcaaagattactctttgcccattattgttctattatttgcactttttttgcaaaatttgaccgcttgtttaaagtctttcttaggtaataatcgtctcgtagtagaaatcttccgctaaaccataagattctcgatactcaataatgctcccgtccaatcctttcgctgcacgacacactttaatcacggttttatcttgcccgtccgttagataagtatcgctatggcttaataaaatcgtcatttgctcctttgccgagacgactaattgtccacatttcttaaaataaaacggataaagcagattctcaaattgctccggttttactgaaagtaattcactaaatttttccggagacagccaaatcttatcgctcacaatcactttattatcgacggaacggattcgctcaaggtagataagctctcgctccaccggctcgcccaataactgattaatctttgggtttgctttcacacttttaatgcatttaacttcaccgattggtgtttccggcttcccttctttggcattacgtagatagaatcgcacaatcgacgattcaacaaatgcaggatgttttaagaaagttcccttaccttgatgcttaatcagcaccccttcttccaccaagccctcaaccgctttacgcacagttccgatggacacttcataagttgccgctaattcctgttcactaggaattgctttctcaaaactccaattattttcagctaaaaatctttgcaattcgtatttaatttgtagataacggggaattttatttaaatcgacatatttttgatcatagttaaacatttatatttttctcttaaaatcaattgactcactaccgaaaaataagtagtgtttcgacatatagtcatctatatgtttataggtttcttctacttctaatttattgtggggtgacaatcatgtctaattttcttcaaacatattatgaacacgttgccgaacgtgcggcaatagggattgtaccaaaagcattggatgctcaacaaaccgtacagttaatcgaattgttacaatcaccgattgccggcaaagaagccgaacttcttgagttatttgaaacacgcattcctgccggcgtggacgatgccgccaaagttaaagctgaatttctgacaggcattgctaatggtagcataactagtccattaatttctcctgaacatgcagtaaaattattgggtacaatgagtggtggctataatgtcacaccgcttgttgatttgttagaccatgcgcaattggcaccgcttgctgctcaagccctttctcataccctgcttattttcgatagtttcaaagacattgctgctaaagctaaacaaggtaatcctcacgctcaacaagtacttcaatcttgggctgatgccgaatggttcacttctcgcccaacacttgcggaaaaaatcacactgacagtatttaaagtacttggtgaaaccaacacggacgacctttctccggcgcaagatgcttggtgtcgttccgatatcccgttgcatgccaatgcgatgctaaaaatgaaacgtgaaggcattgaaccggatcaagaaggtgcggtcggcccgttaaaacaattagccgcgttaaaagaaaaaggctttccacttgtgtatgtcggtgatgttgtcggtaccggttcatcacgtaaatcggcagctaactcagtgttatggcacatgggtaccgatattccgtatattccgaataaacgtaccggtggttttgtcctaggaggtaaaattgcaccgattttctttaatacggcagaagactccggtgcattaccgattgaattagatgtgactaaactaaatatgggcgatgtaatcgacctttacccatacgctggtaaagtatgcaagcataattcagatgaagtgattactactttctcatacaaaaccaatgtgttgttggatgaagttcgtgcaggcggtcgaattccattaattatcggccgtagcttaaccgctaaagcacgtgcagaacttgacttaccggaaagtgatgtatttgccaaacttgctgaagtcgctgactctggcaaaggttatactctagcgcagaaaatggtaggtaaagcttgcggcgtaaaaggggtacgtgcagggcaatattgtgagcctgcaatgacttccgtaggttcgcaagatacaaccggtacaatgactcgtgacgaattaaaagatcttgcgtgcttaagattctctgcaccgcttgtcatgcaatcattctgccataccgcgccgtatccgaaaccaagtgatgtggttactcatcaaacattaccggaatttatcacgagccgtggcggtatcgcattacgtccgggggacggtgttatccactcttggttaaaccgtatgttaatgccgtttacggtcggtaccggtggtgactcgcatactcgtttcccaatcgggatttctttccctgctggttccggtttggtggcttttgctgccgcgacaggtatgatgccacttgatatgccggaatccgtgttagtccgctttactggcacgatgcaaaaaggtattacattacgcgacttagtccatgcaattccttattatgctatccaaaaaggtttactcaccgtggaaaaagcgaataagaaaaatgttttctccggtagaatccttgaaattgaaggattagaacacctcaccgcagaacaagcatttgaactttccgacgcaaccgcagaacgctcagcagctgcttgtacaattaagttaagccaagcatcaattgaagaatacttacgttcaaatgtcgtcttgctcaaaactatgattgccgacggttacagtgatgcccaagctcttgaaaatcgtattaaagcgatggaagcgtggttagcaaatcctgaaatgctcgaagcagatagcgatgcggaatatgcggaaatcatcgaaatcaatttagatgaaatcaaagagccgattttatgtgtaccgaacgatcctgatgacgcacgcttattatctgaagtacaaggtaataagattgatgaagtgtttatcggttcttgtatgaccaatatcggtcacttccgtgctgctggtaaattactcagccaagtaagtggagagatcaacacccgtttatggcttgctccaccaaccaaaatggatgcagctcgcttatccgaagaaggttactacaatatttacggacgttccggcgctcgtaccgaaatgccgggttgctcgctctgcatgggtaaccaagctcgtgtacgtccaaattcttcggtggtttcaacttcaacccgtaacttccctaaccgtttaggacaaggtgcaaatgtttatcttgcgtctgcggaactggcttctgtcgcagcgatcttagggcgtttaccatcaccacaagaatatttggaagcggttgcaacacttgatgaacaacataatgaagtttatcgctacctcaattttgatcagctaccaaattatgtgcaaaaagcggaaagtgtaattttccaaaccgctctctaagcgaaaacaaaaaagtgggcgattagcccactttttatttgccttttaaaactgttatttcactactcgatagcgtagtgaaataaacacaaaccacaagattgcaatccctgctaatccgctaccaattaatccgatataaggtaagccaatatgttggatcacttggctaccgattaatgctccgccaccaattccaacattataaatgcctgaataaattgctgttgccacatcagtcgcatctggtgcgagatccaacacttgcatttgcaatgcgatactcatggcggtaataccaatcccccaaataaacacaatgccgaacattgccgcaatatgatcgctcaatggtaataaacacaattgcattagcataatgagtgccatattagcgatgataaattttttcggcgctttcggatataaacgcccgaataagaaacttgccactacaccggctaaaccgaacactaataaaattgccgtactggtttgttcactcatttggctgatcttcaccataaacggttcaatataactatagccggtaaaatgcccggagatcacgaccaccgtgagcaagtaaataccgattagcatcggacgcttgattaaaatcggtaaactggctaatgaccccgaatttttgcttggtaaatgtggtagtaacttccacataatcaacataataccaagtgcaataatgccgatcagcgcaaaggtttcacgccaaccgaatgcttgtccaatcattcgacctaacggtagaccaagaatcatcgctaatgagctacctaacgctaatagccctagcgcctgttgtttcttatctttcggtgcaactcgaatcaccagcgaagcggttattgaccaaaagatagcgtgagtaagtgcaatcccaattcgagataccaataacattgcaaaactggtggcgaaataagaaatcgcatgacacacaataaataccgcaaacaatacgagcaacaaacgctttcgttctacttttgcagtaagtagcataaaaggtaacgaagcgagaaacaccacccacgcataggcggtaatcattaagccggttgttgccgtttccatctcaaaactcgctgcgatgtccgaaagtaaggctactggaataaattccgtggtattaaaaataaatgcggacagtgaaaatgcaaacacacgtaaaaatgaaagtctgcgctgttcttttctggttatcattttatcttcctaaaaaattaagcggtcagattttgcaatttttttgcaatttctgaccgcttgtaagtttacgctttagtgttgcccaaaccctttcaatccgaccacgtgtacatactcttggttattggtaattttacgcaccaatttataagtcgtaccacgttccgggctgatattttccggtgcggcaatcaataactgcatatctaaacgttcgcacaattcaaacaaggtattgattgaagttgcatccaaacgtgccgcttcatcaaggaataataagcggctcggtaaaatatctttcgcacgcatacggcgagactcttcttcccagctttgtaccaccattaacaggattgacataccggtaccgatcgcttcaccggttgaaagtgcactactttccgcacgcatccaaccgtctgcgccacggaaggtttccacttcaagatctaaatagttacggtaatctaataactcttcaccgatcgtttgtggcgtacgttgtcccatatcaatatgcggattcacacgtttatacaacattgccaacgcttctgagaaactgagtttttggctgtcgaataagtctttatgctcttctctaccattgctcaatgcgttaagtaggattgcgtgcgtatcacgaatattcacgactaagcgaacgcctttcacctgaccgaaggcaatattttgtagcccttggttaagctgcaagatacggttttgctcacgttgaatcgttttacgcaagatattggcgaccgattccgcactgattgctaattttttctcacggctggttaattcgttggttaaacgagataactcaatttccatttgttcaatcgcatcaatcggatcatcggttttgataatatcctgacgaatacgctcacgtaagtgctgataaaccgcaataaagaatgcgactttattttccggcttacggctatcttccgaagctcgtaggctgtcacggagatattcgttatccgccacagcggtacgtaaagcacctaacgctttatcggaaatcgaacgtaattcttccgccgattgataagctaactcacggcgatttaagcgtttttctacatcgctgttacgtgaaagtttaagtaccaaacaccagctgactttcgcttgcaccactaactcacgttgtgtgtggtaatcacgttccgctttgcgtagcgtacgggttaaattatcaatttccgcttcaatcgtacctaattgtttatctaaataacctttgcgtgaacgctgttggcttaaacgttgttgtaattcgtcacgacgagctcttgcacgttcttccgcaccgacatcaccccgtacgcctaagtcatcgatttcacgaatcaattcttgcaacatctgcattttcgcatcacacgaactgcgtaacccagttaacacttggttgtattgagtaaattgtgcttgtgcttgacgtaattgatcacgggcttgctcacgttcacgttgtgcgctctctaaacgagctcgtaattgttcggttaatgcagatccttccgaaccgatcgcttcttcgtagctgaaatgcactcggcgttgaatcacatcagacagtgcaaaaactttttgttgtacttgtttttgttctgctttagcttgttggtaatcttgctccaactgttcaaacttcgccggatcgctcttcaagctcgccgcaatcggttctaattgagttaagtaattaccgaattggcgaacgaactgttcatcttcttccgcttcatctaattgcgcacggcattcttccgcacgatccgctaaggtttcgtcttctaacaagctcacaagcggtagaattttattcaacatttgcaattttgcttttgccgaatctaattgggtgcgtaattgctgttcattgcctgccgcttggttaagttcacgttcgatttcagtacgttccgccgcaatttcttgcatttgctcttccggattcggctggaaggctaaacttaaatgcgtaccgacaaattggcttaaatgctgatgtaaacgctgacatttttgcacgtcaaaggcacgttccgcatgtcgttcgctcacttcatcacgttctgcttttaacgtttctagatgtttctcacgtgctgcacgtccgaataacggcacttccgggaacttagaataacgccattgacgatcagatactttgaccaccacaccttcggctaattcttctgcagtaaataccgcatcatcaaatgctgacgggtcaccttcaatcaaataaaggtctgtcgggcaatcctctaatttttctaattgtgctttaacgctttctaaatcacgcaccacaatagcgtgacgagcttcaccgtaaagtgctgagaaatacggtgcatcatcaattgaaacatcatcatataattcagaaagcaacacgccgccaaaacgttccgccaattgatttaagcggacatcatccgaaccgtccggctgacttaaacgagtaatctgtgcgtctaacgcggcttctcggcgtgctaattcatcacgagctaaggttgcttcacgctctttagtcagcatattttgcataaactgcattactgactggctggcttcaaatttttcaccacattgctcttctaaacgtgctaatgcggattgcgccgtatgccatgccggtgcggttttcgctagttggttatattgctgattaagctgctcacgttgctgacgctgagtcgaacgcacttcaacaaattccgctaattctgcttccacatcttcaaggcgagcctgttgctgttcgaaatagctttctaattcttccgctgtctcaaattgcgtttgggctttttgattaaactcggctaataagcgttccgcattttgttgttgatgtaaacgctgttccaaatctgcaagtttttggcgtaaagcgaccgcttgtgttgcctgcattttttgatcggtaaacgctgttagcaaacctctcgcttcattccacgcttcagagcggtcaatttcaccggaaattttgcaaactaattcataagctttttcgaactgcgttttcgccatatctgaaacggataaacgctgctccagttcaaagacttgatcggttaaatcgtccgcctgtgcggcaaactccgcatgataatcttctacattatggagatctaaatgcggtaagccacaaagttgtttcgctttttctaatgcagcaatcgcctgttgatattgcaacgcacgtgtttgctgagcatctaacgcttgctgataatccgccatttgtgagcgtaactcttccacttgatcatcggcatcatccgctcttgcttgtgcagtttctacttgttcggaaacttcttccaacgcaatttgttgctcttctagcttttcattgagttccgcaacttcatcttgataacgttcgattttttcttggtgacgaagcgcattcatcaccaaatttaagtgatcgttcgctgaattgtattccgcttctaagccactttcgttttctgaaatatccgctacttcacggctaaattcgattaaacgttgctgttctaactcaagtttagatttcgattcataccacgctcggcgttgctctagagcaatttgtacgttaccacggcgctcatttgcattgcgcatataatcagccgacacgtagttagttgattcggtgatcaggtgtttaaacatatcacgatcagattgcgtgaccttaatcgcttctaacgtcatacggttttcacgtaatgccgattccatatcttggaatgcttgacgaacgccggtgttttccggtaataaatagtcacgtaacgatttggtaatcacgcttgaaataccaccgtaaagcgatgcttcgattaatttatagaatttgctgcgatccgctgaagaacgtaaacgtttaggaatcacgcctaaatcgaacataaaactgtggtaatcagtaatcgagtgatattgtttaaatactacttccgaaccatcaaatttatcttttaaatccgctaacggtaacacgcgcgctttttcgccgacttgttcggttaagacgctgataattgaattgctcatcggcacgttttgtaacgagaacgaacgaatatctacttttttgtcacgtcctgctacttgttgtaaacgcacaccggtaatcacacgctgtccacgtgagttcaatgactctaacaccgcataacacacaccggcttttaatttaccgtataaacctttatcacgagagctcgaggttgaaccggcttctgtcgtattacggaagtttaatagggtaagatcggggatcaaagcagtcacaaaacccgccattgtggtggatttacccgcaccgttaccgcccgaaagcgtggtaaccagctcgtctaaatcgaaggtacgtgcaaaaaaaccgttccagttaattaacgtaagcgaacggaatttaccacggctcacggtatgctgaggattggcaagcggtgcgattggtgcagaattttgcaacgcagtggtttgatcttcaaataattcgtttatatctgtcatttgctttatctcgttaactgttattctgtttcatcttctaattcgtcagttgcagaattttctgcaaattcgaccgcttgttccgctaaaattgccggtgttgtcgcttcaccatcacgaattaagcgtaattgtgcttctcgtggatcatctcccactcgaacatccgctccgaagcggaacactgattccgagatgacaaattttttgctgttttgctctccgatacgggtaataataccgatacgtgctaaacggcgtagcgcaccaccaactttctctgctaattttgctttatctaagtcagaaccggtcgaacgtgggttcaccgccttaagtaatttgctttcatcagcgagattcattagctcttcatacacatcgtcttggctgaaaatgccttgttgggctaaacgctccggactgaggtaaagatagcaaagcactttacccactaacatttccatttccgacattgccgaacgggcgatcaaggttgatgctttcggacgtaagtagaaaaagccttccggcgcacgaattaattccacgtgataacggcggtaaaaactttctaactcggtttggaagtccattaagaatgcgtgttcgtccagctgttccgtattaatatggcgaccggcacgaagttggctgtctagctctgggaaaatcgggttagcaattgccactgccaattttggagaaataacgtcttgaatttgctctgtcatattttactctcgtagggcaggcattcctgcctaccattaaactttctgtttttccaatggtgggcaaaatgcccaccctactatttgttatattggtcgattacgttcgcctgaacttccgcacccttatcattaattgcttgccactctgggtaaaccgcttggctatcgaggcttgccataccgagttttaccgcttgatccacaataattcgtgccacatcaaaatgacgagattgcggataaagtgccagttgctctcgtaataccgcaccgagatcgattggtttaccttctgctctaaacggtgctaaatgcgcttgcattacgctgataatttgttcttgaacatccgaaagcgattcatattccaactcactcggtaattcaccgaccgcttccgcctcattcagcatcgtttcatcatcacgcaaatctaataacgattccgctttcgcagtataaagtagccaaggcgcattgaaataatcttgaatagattggcgtaaacgctgaccgaacacacgatttttatccatatcaattgctgtacgaataaacttgtgtacatgacgatcataaccgatccacaggtcaatcgcttgttgtccccagctaatgatgcggtctaatttgttttgcagattgacaatcagttgatcgacaaaatccaaatcatctcgcccgatcaagcagctttgaatacgtagtaattgtgcctgtaacttatcacctgccgcattaagcgtatcttgtaactcacgtaaattacccgaagtttcatctagtaattgttcacaactaagaatcgcttcatgccagttttggcttaacagttcggcaattcgctcacgaatttgatgttggttttcatccatcatacgctgagaaagatcgatgctgtcgaaaatttccgcgaccgaatatttaagcggtgcaaacacgttattacgccaaaaacgctcgtcaccgccctcttccgccgccgatgaagcacgttgaatctcgtccgctacaatcgaaagttggatcgataaacgtaaagtcgaaaattcgcgctggcgcacataataatccgctacaccaacacctaacggtgttactcggtagattgctaagccttcggtaaattcgctagagaaacggttaagaaaacgctgtttaactaaatcgttaatcgcattattggcacgctgtgtaagggtggcttccgattggtcgaatgcttccgaaacataacggaaaagatcaacaagatcgctttctaaaagttctccgtccgtttgttcgttattataaatggaaatcgccaagagaaaggcaaggcgatcagaagataacgaaagtgaaaattctcgctctttcgtccagttgatcagttctgggattgtctgtgccaattcgttttgcatacagatttgtcgtttgttgatgaaaaatggcttttattgtacaggaatgtgaatcaaataggaacgaaatcaaaaaaagaagcggtcaaattccgcaaagtttttacgaaatttgaccgcttgtctggtaaggaaataattagtctacaatttccacagtcgaagtcgcgctgaggcctcgtacaagttgagatccttttcttgcacgttcaccacgataattatcaatatcgctcggcttaagggtgattttgcgtttgccggaaacaaacactaacgactgtgtcggtttaaccagtaataaacgggcaagcaattcattaccttcttttgccgcctgtgcggaaatattgataatcttattccctttacctttcgaaagctgtggtaattcggtgatcgggaatactaacattcgtccgacactactcattgcaacaagcgaaagttctgcttcattatcaattaattgcggtggcaacactttggcattttcggttaaagaaatgaccgctttacccgctttattacgagaaaccaaatcttcaaagctacaaataaagccatagccggaatccgatgccatcagaactttagtgtccgagttcgccattaatacttgctgaacggttgcgccttccggtaaagtgatcttaccggtgagcggttcgccttgagagcgtgctgatggtaacgaagtcggatcaagcgcataagctcgccccgtgctatcaaggaacacgaccggctgattacttctgccatgcgcatgtgcaagataaccgtcaccggcacgataacttaagccttgcacgtcaatatcatgccctttcgcacaacgcacccagcctttttccgatagaatcaccgtaacatcttcagtcggggttaagtcactttcagaaatcgcttttgcttcggcccgttcaacgagtggtgaacgacgtgggctagcaaacgcttttgcctccgcctgaatttcttttttgatcagcgtatttaaacggcgttccgaaccaagcgttaattgcaattcatcacgctctttttcaagctgtgatttttctgcctgtaattcatgttcttctagttttgctaaatgacgtaaacgtaaatttaaaatcgcttcagcttgtacttcacttaaattaaagcgagccattaatgccgttttcggttcatcttcattacgaataatttcaatcacttcatcaatattgaggaaagcgatcatcaaaccgtctaaaatatgcaaacggtttaaaattttatctaaacggtaacttaaacggcgagttaccgtagtacggcgaaatgctaaccattcggttaaaattgtttgcagattttttaccgccggtttaccgtccagcccgatcatattcatattgactcgatagcttttctcaagatcggttgtggcaaataaatgatccattaacgcttcaaaatcaatacgatttgaacgaggtacaatcacgatacgaatcggattttcgtgatctgattcatcacgaatatcatccaccatcggcaattttttattacgcatttgcgttgcgatttgctcaatgatttttgacggcgaggcttggtgcggcagtgccgaaatcacaatttctccgtcttcttttttccataccgcacgcattttgattgagcctttgccttgctcatacattttggcaatatcggccttaggggtaataatttccgcttcggtcggataatccgggccttgtactaccgtcattaactcggcaaggcttgctttcggattttccaataacatcacgcttgcttcggctaattcgttgatattgtgcggcggaatatcggttgccataccgactgcaatacccatagtgccatttagcaaaatatgcggtaagcgtgccggtaaatatttcggttcttcaagcgaaccgtcaaaattcggttggtaatcgaccgtgccttgccctaattcgccaagtaatacttctgccattttcgacagttttgattcggtataacgcattgcagcgaaagattttggatcgtcaggcgcaccccagtttccttgcccgtcaatgagcggatagcgataagagaacggctgtgccataagtaccattgcttcataacaagcactgtcaccatgcggatggaatttacctaacacgtccccgaccgtacgcgcagattttttatattttgccgaggcatttaagcccaattcggacatagcataaataatacggcgttgtaccggttttaacccatcaccgataaacggcaatgcgcgatccataataacgtacattgaatagttgaggtaagcgtcttcggtaaagcgcttaatcggcatctgttcaacgccttcgtaattaatttctgtactcatttttgcaaataatttagtaaaaaaggccgcttattctctatgatttatggatatctgtccacctcaaaaatgacaagcacttggattttgtaaaaatcgaactgccgctaaaataattaacgattttctataaatttttctgtataatgaattcgctttatttcttgattttagagaggcggctatcaaaaactatttgttggcacccagagagtttttgctagtcgcaatttaaagaaataaaacgaaacgattaaaagtaaattaaggaatttcaaaaatgaatccaattgttaagcaatttaaatacggtcaacataccgtaacattagaaacaggtgctatcgctcgccaagcaacggcggcagttatggcaagtatggacgatacaaccgtattcgttaccgtagtggctaaaaaagatgtaaaagaaggccaagatttcttcccattaaccgttaactatcaagaacgtacttatgcggctggtcgtatcccaggtggtttcttcaaacgtgaaggccgtccatctgaaggtgaaacattaatcgctcgtttaattgaccgtcctattcgcccacttttcccagaaggctttttcaacgaaatccaagtggttgcaaccgttgtttctgtaaaccctcaaattagcccggatttagtcgcaatgatcggtgcatcagctgcactttcattatcaggcgtacctttcaacggccctatcggtgcagcacgtgttggttttattaatgatcaattcgtacttaacccaactatttcagaacaaaaacaaagccgtttagatttagtggttgctggtacagataaagcggtattaatggttgaatctgaagcggacattctttctgaagaacaaatgctatctgcggtagtattcggtcatcaacaacaacaagttgtgattgaaaacatcaaagaattcgtaaaagaaacaggtaaaccgcgttgggactgggttgctccggaaccaaataccgcattaatcaatcaagttaaagcattagcggaagctcgtatcggtgatgcataccgtatcactgagaaacaagctcgttacgaacaaatcgatgcaattaaagcagatgttattgcacaattaactgcgcaagacgaaacaatttctgaaggtgcaatcgttgatattatcactgctttagaaagctctgtcgttcgtggtcgtatccttgcgggtgaaccgcgtattgacggtcgtacggtagacaccgttcgtgcattagatatttgcaccggcgttttacctcgtactcacggttctgcgatcttcacccgtggtgaaacgcaagcattagcggttgcaactttaggtactgagcgtgacgcacaaattattgacgaattaaccggtgagaaatcagatcgtttcttattccactataacttccctccatattctgtaggtgaaacaggtatgatcggttcaccaaaacgtcgtgaaatcggtcacggtcgtttagcaaaacgcggtgtgttagcggtaatgccgactgcggaagaattcccatatgtagtacgtgtggtttctgaaattaccgaatcaaacggttcttcttcaatggcttctgtatgtggtgcatctttagcattaatggatgccggcgtgccgattaaagcggcagttgcgggtatcgcaatgggcttagtaaaagaagaagaaaaattcgtcgtactttcagacatcttaggtgatgaagaccatttaggtgatatggactttaaagtagccggtacacgtgaaggtgtaacggctcttcaaatggacattaaaatcgaaggtattacaccagaaattatgcgtattgcattaaatcaagcgaaaggtgctcgtatgcacattcttggcgtaatggaacaagcaattccggctcctcgtgcagatatttctgattttgcgcctcgtatccacacgatgaaaattgatccgaagaaaatcaaagatgttatcggtaaaggtggtgcggtaattcgtgcattaacagaagaaaccggtacttcaattgatattgatgacgacggtacagtgaaaatagccgcaactgataataatgcagcgaaaattgtaatggctcgtattgaagatatcgttgcagaagttgaagtaaatgcaatctacaaaggtaaagttactcgtgttgtagacttcggtgcatttgtatctatcttaggcggtaaagaaggcttagttcacatttcacaaatcacaaatgaacgtgttgaacgtgttgccgactacttaagcgtaggtcaagaagtgactgtgaaagtggttgaaatcgatcgtcaaaaccgtattcgtttaacgatgaaagacatcaacaatgatgctgcaaccccagcagaagaaacagaagctcaacctcaagagcaacaagctgagatctaatagcactcacataatctaccctctttagcagagggtagatattttctcaaaggctgcttatctaatgttttcactgatatttaaagtgtttcatattcgcttcttaatgttcaatcttttcacattcttatttctgaccggttgcgtcaatcgcaatatttcagaaatggtttcgtcaaatcatttagcattagccgaattaaacccgcaattacgctttgaacaagaagtgatggttgtccgtttaacacaggtattacaagaagcaaaattaagccctgccgaacgtgcagatcttcattttgaacgaggtgtactctatgacagcttaggtttatggtcccttgctcgttatgattttgcccaagctatcggtcttagccaaaaaatggctgctgcctataattatatgggtttatatctgttacttgaagatgattacgacagcgctattgatgccttcaatgccgtattagaacttgatccaagctataattatacttacttaaatcgtggtttagctttttattatagtggtcgttattcggaagcagaacgtgatttattgcgtttttatgaagaagaaaagcaagatccatatcgtgcattatggttatatttcaatgagttagaactcaaacctaatgaagcaaaagcaaatctaattgctcgagccaaatcattatctccagatttttggggaacaaatgtggtacattatttcttaggggagttaactcttggacaacttcgtgatagaatagaaaaagaagcgcaaccaaatactgcttcttatgcggaaattctaaccgaaacgtatttttatctagcaaaacaacaactcaaactaaataaaacggatgaagccaccacgcttttccgtctctctcttgcaaatcaagtgtttaactttgttgagtatcgttttgccttatttgagctttctcagctacgtagtaatagcgcagcagctcaaattactcccgttgttgggaataattaggacgatttaagcggtctaaattttgcaaattttttgtaaaaacagaccgcttgtactctttgggacaaattgttaaaagcatctgatttgcttcattactttattttttctttcctaagctcaacaatttattatcaattgataatggataactaagataatttgttatgtattgcaatgcataacctaattatctttatcacgccattatttattacttatggttttttatgacaactaattctttaactttcgcagacttaggtcttccacaatcaattcttgacgcagtaaatgaaatcggctttgtaaacccatcgccaattcaacaagaaactatccctcatttattagctggccgtgacgtacttggtatggcgcaaaccggtagtggtaaaacagcggcattctctttaccgttacttgcacaaattgatccggcacaacgccacccgcaaatgttagtgatggcaccaactcgtgaattagcaatccaagtagcagatgcgtgcgaacaatttactaaaaatatgaaaggcgtgcgtgttgtaaccgtttacggtggtcaacgttatgacattcaattacgcgcattaaaacaaggttcacaagttgttgttggtactccgggtcgtattcttgatcatattcgtcgtggtacattagatctatctgcgcttcaatctatcgtattagatgaagcggatgaaatgcttcgtatgggctttattgacgacgttgaaaccgtgatggcggaattaccggaaaatcaccaaacagcattattctctgcaacgatgcctgaaccgattcgtcgtattacccgtcgctttatgaaagatccgcaagaagttaaaattcaagcgactcaacgttctgcaccagatatcacgcaaagctactggttagtaaatggcttccgtaaaaatgatgcgttactacgtttcttagaagtagaagaatttgatgcggcaattatctttactcgtaccaaaaccggcacaattgatattaccgaattatgtgaacgtaacggctaccgtgcggcggcattaaacggtgatatgacccagcaagcacgtgagcaaacgttagaaaaattaaaatcaggtcgtttagatatcttagtagcaaccgacgtggcagctcgtggtatcgatatcgaacgtatcagccttgtagtgaactttgatattccattagatgcggaatcttatgttcaccgtatcggtcgtaccggtcgtgcaggtcgttctggtcgtgcattattattcgtagaacctcgtgagcgccgtttacttcgtaatatcgaacatttaatgaaaaaaccgatcgatgaagttgcgattccaaatcatgagattctaatggaaaaacgtcgcgagaaattcaaagcacgtgtttcagcacagttagaacaccacgatttagagaaataccgtgaactacttgaagatttattcacagccgaccaagaccacgaggaattggcagcggcaatgatgatgatgcttcaagagaaacaaaaattaattcttccgccggatccggaaattcgtgcagcacgtagcgaacgtggtcgcagagaccgtgacgatcgtcgtggaggacgtgatgagcgccgtggcggccgtgaacaccgtgaaaataacggtgtggcaatggatttatatcgtatcgaattaggtcgtgaagacggtgtggaagtacgtcatatcgtaggcgctatcgctaacgaaggtgatattagcagccgttatatcggtcacattaaattacacgatacttactctacgattgagttaccacaaggtatgccgaaccacatcgtgcaacactttgcgcagaaagcacgtgtattaaacaaacagatgcaaatgtctttgttaggtcctgccggtggtgtaaacagccaaccgtttgaagaacgccgtggtggtggtcgtcgtagcgatagaaatgatcgcaatgaccgccgtggagatcgtggtggccgttctgaccgtcgtgaaggtggctttaacgaccgtaagaaaggcggttttaaagaaaaacgtttcaatgacagaggtcgtggtcgtcgtgactaattcacgttgttaactaaatgccccagttttggggcattttgctatccaatcaagcggttaaattttttctaatttttacgattatgtttatcaaacctcaaacgacccaatgttcactagccatctcagcacaagatattcactttatgcaatatgctttagcattagcagatcgtgcggaagcaataggtgaaattcctgttggcgcagttctgatcgatagcgatggaaacattattggtgaaggctggaaccaagtgattcaacttgccgatcctagtgcgcatgcagaaatgcttgcaatacgtcaagcaggtaaagtacaaaataactatcgcttattaggttgtactctatatgtcactttagaaccttgcactatgtgtgccggagctattttacatagtcgcttacatcgcttagtttttggtgcgagtgactataaaaccggtgctatcggttcgagatttcatctgtttgaagattacaaaatgaaccattttcttgaaattcgaggaggagtattagcggaagactgtagccaaaaaatcagccgattctttcaacgtcgtcgtcaagaacagaagcaacaaaaacaagcggtctaattttctgcattttttgcaaattccttgaataaggacacctatacggtgtccctagtgccaacaaaaacaccttatcctttaatctgttgtaacaacaatgccataatacggttatctgaagttaattccggatgaaatgcacaagccagtaaattaccttgcttggcaaatacaacatttccttgccattccgccaatacctctacctcatttccagcagcactaatataaggcgcacgaataaacactgccggaaaaggttcggtaaatcctttaatcattaattccgcttggaagctatcaacctgccgcccaaaagcattacgttgaacttgaatatccattttcgccaaatgaggttgctcatcgccttcaagtttattcgctaatagaatcaatccggcacaagtgcctaagataggtttatcaaatgattgtagcgcctgaaataaaccgcttgaatgaagtaatcgtccaattgcggtgctttcgccaccgggtaatataagtgcatcaacttgctgcaattcggctaacgtttttaccataatggcttttgcgcccagtgtctctatttgagcaatatgttccgaaaccgctccctgtagtgctaatacgcctacagtatattttgtataatctttcattaccaaccacgctcttgcatacgatcttgtgccgctaatttgctgatctccaagcctctcatcggttcacctaaatctgctgaaaggcgggcaattaagtcataatcttgataatgagtggtagcttctacaatcgcttttgcaaacttttccggattttcggatttaaaaatacctgatccgacaaatacgccgtctgcaccgagttccatcatcaaggcggcatctgccggtgtggcaattccgcctgccgcaaaattcaccaccggtaatttgcctagcgttttgatttgtagcaataattcaaacggtgcacctaattgtttagcttcagtcatcagttcatcatgactcatattaatcactttgcgtaattgcgcattaaccttgcgtaagtgacgtaccgcttccaccacatttcccgttcccggttcacccttagtacgcaacatcgaagcgccttctccaatacggcgcagtgcttcgcctaaatctcggcaaccgcacacaaaaggtacggtatattcgctttttaataagtgaaactcttcatctgccggcgttaatacctcactttcatcaatataatctacacccattgcttccagcactctcgcctcaacaatatgtccgatacgtgcttttgccattaccggaatggataccgcttccatcacttcacgcacaatcgtcggatttgccattcttgctaccccacccgctgcacgaatatcagaaggtacacgttccaacgccataacggcaaccgcaccggcagcttctgcgatacgagcttgttccgcattcactacatccataatgaccccgcctttttgcatttgtgccattccgcgtttaaccagatccgaacctaaaattttagccatattaatttcctttttattgatgtgaaaaacggtggctatttttagatcaatcagatatgattaaaagtatcaattttataaatattaatgaggtcagaagtgaaaaaattaagctatctactcaataagcagcaaactacaccgctttatttacaactttatcagcaaatcaagcggtctatttataaccaagaattacaacttggcgataaattgccgtctaaacgtcacctctgtgaatacttacaaattagccaaaatacggtggaaagcgcctatgcacagctgttagcagaaggttatatcgaatctaagcctcgcagcggtttttttgtctgttttcaagctgagcaagcttatccgagtgcaaatgtcgtaaaaaattttataaattcgaccacttctacagagtatgagatcgatttcaactcaaataaaatcgatagcctatcttttccattgaatcgttggaaaaagtgtgccaattggacaaataaagattttttaaatatgggtgacaagcaaggcgacctcaatttacgtcaacagatctcccaatatttattggcttcacgcggggtaaattgcgagccggaacaaatcgtgatcggtgcgggagtagaaagctgcttacagcaattgattttattatttcaacagctcaaccccgctatgaattgggcaatggaatcttacggttatcctacggtagaaaaactattgaatctctatcaaaagccaatttttaaaatgccgttcagctcggaaaattatcaactggatataccttttttggaacagaaccaaattaacgtagcgtatctgactccttcgcatttatatccgttcggtcatattctaaccgttggacaacgccaacaattactcgaatgggcaacagcacaagacggacgttatattattgaggatgactacgacagtgagttccgctacaccggcaaaccgattccgtcgttacaaagtttagaccgacaagataaagtgatctatctaggatcattttctaaactattaatgccctcactgcggattacgtttttagtgttacctcgcaatttattgagcaaatatcagcaatattgtgaattttttaatgcctctgtttctcgcttggaacagcaacgtttagccaaatttattcaatccggtgaatttgaaaaacatattaatcgaatgagaaaaatttaccgccgtaaaatggagttattatgtgatctactctcgccccatactaaacagattaaatattatggcgaacattccggcttctatttgctgatcgaattattaaacgaaacaagaacgttagatcaattagtcgaactggcaaaagcacagaaaattaaggtctatccgattcatcaccaacaacgcagattatttagtttaggcttcggtcatttgtcggaagaacaacttcggaagggattgggtaagttgctgcactgttgggatattgcttgctaacaagcggtcaaattttacaatttttttgcaaaaataaaggcacgtcaacacgtgcctttttcttcattcagcaaagattagaaatctaataattctttttcttttgccgctaatacttcatctacttttttcacataaccgtcagtgattttttggatttcatcttgtgctttacgctcttcgtcttcactgatttctttgtcttttaataacgctttgatttggtcatttgcatcacgacgtacgttacggattgcaattttaccttgttcgccttcgccttttacgattttgattaaatcacgacgacgctcttctgttaatggtggaagtggaacacggattgttgcaccggctgatgaagggtttaaacctaaatcagaggttaaaatggctttttctactgcgctaattaaagaacggtcaaatacgtttaccgctaatgtacgcgcatcttccgcaaccacgtttgctacttgacgaagtggtgttgcagaaccgtaatactctacttggataccgtctaaaaggcttggttgtgcacgaccggtacgaattttagaaatatggctttttaacgcttctaagctcttttccatacgatcttgcgcatcttttttaatttcgttgatcatttgttgttcctttcaatatttgagtcaataaacttgtcaattctacctaaatccctttcattttcatagccctaacaccaaatttctcgttttgttaaaacattttacagacgttaaaagcaaatagcaggcaataaaaaacggtctgctttctttatttgtaaatcattaaagaaaacagaccgcttgtagatcattcagataattaagaaatgatcgtaccttcggttgtaccggttaccacttgttttaaggcgcccggtttaaccatattgaatacacgaatcggcatactgtggtcacgtgctaacgtaaatgccgctaagtccattacttgtaactcttgatcgataacttccgcatagcttaattggttgtaaagtttcgcatcggcaaatttagccggatctttatcatatacaccgtcaactttagttgcttttaataccacgtccgcttcaatttcgataccacgtaaacacgctgcagagtctgtggtaaagaacgggctacctgtaccggcagagaaaatcaccacacgtttttcacgtaacattttgattgcttcagaccagttataagtatcgcaaatgccgtttaattggaatgcagacattaattttgcgtttacatccgcacggtgtaacgcatcacgcattgctaaaccgttcattacagtcgcaagcatacccatatggtcacccacaacacggttcatacccgcttttgctaatttcgcaccacggaacaagttaccgccaccaagcacaacgccaacttctacgcccatttctactaattcttttatttctaacgccatacgatccaaaattgatggatcgatgccgaagccttcatcaccttgtagcgcttcgccacttaactttaataaaatacggttgtagattggtttactcattttaattgcctcttatgctgtatggactaaaaacaaaattacgctattatagactatcctgtttaatcaggaaatagcaaccgattatatttacttcttggaatagcaaatgacacagaaattaacaaaacaacaagtcatctatacttttattgcgctgcttttagcaattttcgccggctactttatgctaaaaggttccggtttcttccctacacctaatcttattgaaatactatgcgccgtcattttaattattgcgctcggaagttctaagatttcgtactacgcattattattaccgattactatcggctatatgctatatacgccaatcggcttatctttcggtgcgccatcttatcaatatattgcttcattatttgcaaccgatttactggaaggacgagaatttctcactcagttaccgattagcaattatttgattgctatcggaatcttactcgcgatcatttttttccgaaaaattaccaaacagcatcagattaatttcttgaacaatcgtacatttattattagctcattagtggtttcacttttcagccttgcgcccttcaaattctttcacgaattttttagtgaaagtatgaaggtaaaacaggaattagaagcgctaaataacagtactgcgattccttccgaatggggcaattccacactttctagcgattcaaaatatgatgattacgtgttagttatcggtgaaagcgcccgtaaagattatcatcatgcttacggctatccggttgaaaatacgccgtttatgagcaacgcgaaaggcacgctaattgatggattcaccgccggtggaaccaataccatttcatcattaaaattattgctcactaagccgaatactcaaacttgggaaggcaattaccgcttaaatttagtcgagctagtcaaatccgccgggattaaaacttactggatttccaaccaaggctatttaggacgttttgatacgccgatttcttcattggcaaacaaaagcgatgagaagatctttctcaaatcaggtgattcatttagccaaaatatcagtgatttcgcattactgccgaaattcagccaagtaatttcgcaagcgacccaaggcaagcgctttattgcggtgcatttatatggttcacatccgattacctgtgatcgcctaaccgattacccgaagatctttgatgatgccaaaattgcgcaaaaatatcacaacgtaaactgttatctttcttcgatgaagaaaaccgatgaattactggaaaaactgtataacgagttaaaccaaaataaagcgaaaaccggcagaagtttctccatggtttacttttccgaccacggtttaattcatagtgaagacgaaaaaggcatccatattttaaataccgcacaaggcaaactacactttgatgtgccgttatttaaaatttcaagcgatgataccgaacgccacgtttataaagtgtttaaatccggtttaaactttactgacggtatcggtaaatggataggcattagtaatgaaaaattaaatccgcaagcggatttgtttagcaatcaaagtgataaagacgattacggactgaagcaagtaattgaaaagattccggcaaaagccgatcctgcgattgtaattccagccaaatagttagctgataacaagcggtcatttttagcaagaaatttgcaaaaatttcagcaaatatgaccgcttaaccaattggtagatagaaacaaaaaagcaggccaaagcctgctttttctattttcataccgaaaattaaactttttgcattgcagcaacttctgcagcgaagtcagtttcaactttctcgataccttcaccaacttctaaacggatgaagttagatacagaagtgtttactgattttaagtatgcaccaactgtttgtgaaggatccattacgaatgcttgaccagttaatgaaacttcaccagtgaatttagccatacggccttcaaccattttctcagcgatttcttttggtttaccagagttcatcgcgatttcgatttggatttcacgttctttagcaactacgtctgcagaaacgtcttctgggtttacgaattctggtttagatgctgcaacgtgcattgcaactttcttcaattcttcttctgaaccttcaccagcaactaatacaccgattttcgcaccgtgtaagtattgtgcaattacgttaccgtctaagtattgaacacgacggatgttcatgttttcaccgattttagcaactaatgcaacacgtttttcttcgaattgtgccgctaatgcttcaattgtgatgcctttgtttgctgctgcgaaatcaacaacttcgtttgctaattctaagaaaccagcgtcttttgctacgaagtcagtttggcagttcatttcaactaacacaccgaaaccgttagcaacgcgagctaagataacaccttcagctgccacgttacctgcttttttagccgctttagcttggcctgatttacgcatgttgtcgattgctaattcgatatcaccgtttgcttcaactaacgcttttttacattccatcatacctgcgccagtacgttcacgaagttcttttacgagtgatgctgtgatttcagccattttgtattcctctaaggttgaattagataagaaaagcagggggataaaaaatcgcccctgctccaaagtgatttaagggctatgccttaataacgattattcagctgtcgcttctaactcagcttcaacgtttgaaccacgaccttctttaactgctgctgatgctgcgtctaagtaaagttggattgcacgtgttgcgtcatcgttaccagggatgatgtagttaacaccgtctggcgtagagtttgtatcaacgatagcaaataccggaatacctaagttgtttgcttctttgattgcgatatgttcgtggtcagcaccgattacgaagattgcatccggaagaccagccatatctttgataccgcctaagcttaactctaatttttctaactcacgagtacgcattaacgcttcttttttagtgattttgtcaaaagtaccgtcttgagtttgagcttctaaatcttttaaacgtttgattgattgacgtactgttttccagttagtcaacataccacctaaccaacggtggtttacgtagaattgttggcaatctactgctgctgctttaactgcttcagacgctgcacgttttgtaccaacgaataaaattttaccgttgttgcttgaaatgcgagttaattccgctaaagcttcgttgaataaaggtaaagttttttctaagttgattacgtgaacaccgttacgcgcaccgaaaatgaatggtttcatttttgggttccagtaacgagtttggtgaccatagtgaacgcccgcattaagcatatcgcgcatagaaacttgtgccataagaattttccttaaatgttgtttgctttgtcacttatgaaagacaaagcggggtttagcctccacatatcctaataaatcaaccacttacgtagcaccccgaccattagcttgtgatatgtgtgtgttttagtgttaaaaaataaatgtaaatgtttttcgcctaaaattcttcagacaaaaaacggggcgaattatgccaaaaaacggacaaaattaccagcagttttttgcaaaaataccggcaaatttaaccgcttgtattagccgcaattcatacactcacaacgttccctttcagtcaaattaatttgcttgttatggaattgctgcaaagtacaacgatgccctacgctaatgataatgctgttcggcaatcggctacgaattgtttgatacaaaatcgcttcggtcggttcatctaacgccgatgtcgtttcatcgaggaagatcaactccggtttcgccaataaaatgcgcacaaaagcaactcgctgcaattcacccggtgaaagcgttgcttgccaatcggtatcgaaatccagcgaatccacatatttgctcaaacagcattgctgcattgctgcttttaactgttcgtccgtcacgactaaattcgggtaacaaattgcttcacgtaaactgccttgcggtacataagggcgctgcggtaaaaacaacggttgttctaaacaagcacgctctgccacgccgaaagtttcaaacggataaatccccgccaatgctttcaataaagtagtttttccactgccggaagcgccttgaatcagtaacgaatcgccggtgtgtaattcgatattgatatttttcagcaaaatttgaccgcttgcgtctttgaccccaaaatctttcagcacaaagcctcttgaacacgggtaaggcgcatttaccggcatttggtcgagcttatccaaggtaatgaagaagccgtataaacgattcaaacgggcttggtataaggtaaattcttcataaaacaagcggaaaaaagacaatgcgcgcattaagcgattaaatgattgtaccgtttggtgcatatcgcctaatgtcgcttggccggcaaaaaaacggggcgcttgtaacatcaagggtaaaatcatcgcaacttgtgttacgccggtattaaagccgtccagccctaacattttgcgcacaattttccagcgattggcaatgatataatcgaatttagcggttaaattatgctgctctcgtgattcacccgaatagaaagcgatactttcggcattgtctcgcacacgaatcagcgaataacgataatccccttgtagcttttctttattaaaatttaaacgaatcagcggtcgcccaatccaaatcgataaagcggttgcaaaaatgatgaacagataaataaagaacacaacgcctttcggaatatctacaccaaatagtgtcagcagtcccgataagccccataagataatggtaaactcaatcgttgccacaatcgaattaatcacaccccgagtgacttccaccgtccccgtcacaaaagcagtcgcatcttgttcgatacgttggtcgatattatccggcaacgttttctcatactgtagcagatagtaatttttattttgcaaccaacgatttaacatctcactgttaagcttttccaaccacttaatttcaaacgattgggtaagaaaataattgataatcaagtgaacaatcttcacgatcaccaataacgcattaatccccgcaaaaaaccaaaacgcctcaaccgctttatcctgtagcgatttgtataagccattatagaaaaaagtattgagtacgctaatccgcacttcaagtaggatcaaaaagatcaacaataaaagtaagccgagcgttttccctttatggcttttctgccaacaaggtcgggtaatatgccaaaagcgctgcccgagctcggtttgcttgagtagccaacccgttgctaaaagccccgcagacacgcagcaaagtgccgttatcagccacaaaaaactattatttaattctgtttgccagttcatttaaaaatgtattgaaaaaataacaacttacgtttccgaataaaaaaagcggtcgaaattggcaaattttttgcaaaatccgaccgcttgccaaatggagatttagaatgaatattccatatttgcccaataagtacgaggcatacctaacacggcaaaactgcgatcatattgaccacgttgtacctgccagtaacgcttgttaaaggcattttccaccccaccacgtaaggtcagcgtctgtttatccgctactttcactacatatttcgccccgaaatctaccgtagtataagacggcaaacgataattcgctgcagtatcttggtaagattttccatagtattgtagtgcggcattcagcgttaagttagccacaaacggcgtatcccattccacattcgcctttgccatccagcgagggctggtgacttgtacaccgtcggtaatcacatcggcataagttgggaaatcaaagactttcgcttggttataagttagccctaatgaaggacgtaacgtgttatttaacaaacttgcataggtattaaattcaatcccacgattacgttctttgccatgctctttacccgcaagtgctttcaatgcggccttattaccacgaataatccccgggcgacgaatttcatacgcacttagcgtggtcgttagccagttatcccaatttttacgcatccccacttcgatttgtttgctaacacgagggctattcatttcgccggtttcaacatcaatattacccggttctaaatcttccaaatagttactgtaaagcactaaatccggattcggcacataagcaagggtgaccatcgggctaaagcgatctgctttcacttccgtaccggcttttttatcttgttgcttaatccactggaaacgaccgcctaaagttaggcgaacagtattttccacaaagcctaatgtatctgcgaatgcaaggctattagcgctcaattttgaatctgtgccctgcgtattggcagttaaatcaaagttttttaacggcgcaaaacttggtgcatagattgtaccgcctttaatttttccgttagttttactgctttggtcatgatctcgctggcgtaccaccgaatcaaaagctaaattccaattatgcgaaatcgctcccgtttcaaaatcaccctgtaacttcaaattaccactagtggtacgagaacggaaatcaatgccacgaataccactaacttcaaactcaccattctgcttaagtgaagtgatttgtccgaatgcacccgaataacgagattccatatgacctaaaccgcccgataacatcattccgtaaggcaaatcatattcgaacgtccccattacggtttcgtcttcggtggtctgcccgatccaatgcggattcaagttggttttaccatttggcgcagcaggaacggtataagcaagattttgcaagtcctgtaaacgggcacgtccgccatcggtatctcgcttgctgtacatataatccaaaccgacacgcaacgcatcgccacgataatccgcaccgatcgctaattctttattcatttcatcataatcattacgtgcagtattgccgtcacggtatttaccacttacacgtacgccccattcgttattcgcaccgaaacggcgaccgaaatcgaacgattcttgtaaacgattattgctataccaaccgaagccgattttattaatctcttcatcggttgcacgtttggtttcgatattcattgacgcaccggcagaaccttccggatccataccggtagttgccgtggaagcacctttaatcaattgtgccgaagccaccgcagcggtcggagaattatacgtcgaatataaacccgccaaaccgtttacactcacttggcgcatatctaattgcaagttacgcacatacacaccggataacgtattggtttcaccaccgaaattcattacagaagcatctgttttcgcaattgcatccaccacattacgaggcgctttatcttcaaacgctttctcatcataattgaccaccgaaatcggtgaagtaaaggcggtttgtctgcccagcagactcaaattcacaatttctttttgtttatcgcctgccgcttttgctttttcaaattgcgcactaacgttcacctgttccagcgttgccgcttcatctgcgattgcgattgaaggtaaaacaaataatgcactatagatcacactgtatttgaatttcataccaatacttccataaaataatcaatgaaaaatacctaaatcaataggtttaaattattgaaaataattctcaatcagaatttaagatcatacctatctttccaatagaaatcatcctgagttcttattatttatttttatttacaaagtaattatcaaaaaacaacaagcggtcgtttttagcacaaattttgcaaaaatttgaaccaaaacaaccgcttgcaaaaaatctataagagttaaaactgccgtttatctttcattaaccaaccaaataaaccgataattaacaccatcaccataatcaacgttgagccgtatgccaccgccaatccgtatgcaccgtcttcaactctattcagaatataagaggtcgccactcgggtacttggtgaaactaaaaatacgatcgcactaattgtggtcatcgaacgcacaaaactggtcaccaatgccgataagaatgctggttttaacaatggcaaggttacaaatagtaaagttttcaacgaactcactcttaatgaaaacgaggcttcatccaatgatttatctaattgttgcaatgccgccatacaggctcgcataccaatcggcatattgcgtgtcaccatcgacaaaacgataatcgctgccgtaccggtgagataaagcggcgaatgattaaacgccaccacataagacacgccggcaaccgtccccggcacggcaaaacaaagtaaggtaacaaattccaaactttgcttgccgacaaagttacggcgagtaagcagataagcaattaataaccccaatatcgcactaatcggagcggcaatcagtgagtacaataccgtttgaatcaatgacgggaaaccgccctgatctaagccttgcccaaataacttgcgataattttctaaggtaaagctatgatccacgccccaatttacggtaaagctgccgtaaaaaatcgagccgtacagtaaaacggtaaaaccgccccaagcggcgagtatgcaaaaaattaggctttttagatcgcttggtaacggctggaatgtacctctatacccctttccggataccgtgacataagatcctttaccaatccaccaatactgaattagaaaaaacaacaatgaaaaaccgagtaaaattgcgcctaaaccgcttgccgcagcataatctaattgcgtgccaacaaggtaaaaataaatttggctcgccaacacatcaaaattaccgcccaacacaaacggcgtactaaaatcggcaagcgattgcacggtaattaccaaaaacgaattagctaatgccggtttaagcaacggtaataatacaaagcggaaagtttgccaactgtttgctcgtaacgtataactcgcctcttctagcaccacgttagatgactttaatgctccctctaaaatcataaacgccatcggtgtaagtgctaaggtgtgtgaaagcgcaatccctgtaaagccatacagccaatttgcacgaaagccgaaatattccaccaaaaagtcggtaatatagccggaacgcccgagcattaacgtaatgcctaaactcaccacaaaaggcggcgtcaccattggcaaaaccgaaaaacatttactgagcaagcgagtgcgtttgcttgctattcgcgtggtataaagtgcaaaacataagccgagaacggtggataacacacccacggttgccgatacgcttaatgagttccaaataattcttaaaatgtagctttgttctaggatcgcaaacgcattgccctcgctgaacatcgtgctaaaaattgtggtgatcggatataaaataaaaaacgctatcgtcaataccaccactaacaagctcacgatcaaaaagcgatcggcttgtaacacttttaaatttgccaacgcattgctactaattgccaataaagctaaagcaagaaaaataatcgcatagccgaaacgatagttgagataaacggcggaagataacagaaaaaatgtgagtaacaacgccaaacccaattcaattcggctgcgtaagatgcgatcttttatgaaacgaaacgctggaaaaatcagtaaactgccaaaccaaagccaactgatattaatgttactccagcccattgccgccgtgaattcgcttttggttgcaccgaataagccgtaatctaatgcctgtgaaggcaaacaaacaaaggcaaacagtgctaataagatccaaaaataagaatgagaaaaacgttgtaacataaaagatttgtgctattcaaaaaaataaaccacggcatagcgtggtttataagcggttaaatttagccgaaattttgcaaatgtttttgtaaaaattaaggaaaattcgaccgcttgttatcaaagaaaattatttcgctaatttaatttcagtaagccatttatcaatcaaacgcttaccttcttcactcgaaccgaatttatcaaaatcgaactccaataagtccagctttttcgggtcaaccgagcttggcgaagccttcgcattcacattggtcggaatctgatacacgccatgctctcgccacggcaactcttgcgcttcggcactgagtacgtaatccataaataacttggcattctctaaattgcgcgcatttttaataatacttgcaccgcctaacgcatagccgactttaccttgcggaatcaccgtttcaaccggcgcacctttttctttttccgtagcataagcgtgcacaaagccaatacttgccgtactttcacctcgagaaagatttgccgtgactaaattgcttttcacatattgcgatacgttttcatttaattttttaaggtattcgaacgctttctcttcgcccaatttttgaataagcgttgccataatcgtgtaagtcgtacctgaagatctcggatcgggcaattgaatttcgcctttaaattgcggattcaacaaatcttcccagttttgtggtgctttctcccctaatttctgtaacttatcactatttaccccaaaacctagcactaacatatagataatcgaggttttatcgccacgtttttccattagtgatttaaattgcggcaaaatctccgcttgttttggcgaacgataactttctaataagcctagttctccggcctggaaatgcggttcaatcgtaccgccgacccaaatatctgcttgcggattgtctttttccgctttaattttaccgaaaatcgtaccggtaccgccgtgaataaactgggtttccacttgatattgcttcgcaaacttttgggttaaattttcgcacacctcattttgcaccgtacaatacacagtcaagcgcccctccgcctgagccgtgttcgcacttaataatgctgatgttgtacttgcgattaaagccaacgtttttagttttgctttcattatacttatcctttttatttgcagaaaatagtgcgtcattctcaagataaacaggcatgatttaaagggtcagaaatcaacattttaacagtgtcagatttacaaataacgctaataaaataacaagcggtcgtttttgcaaaaaatttcacaaaaacgaccgcttgtaatcagcaatctagataaaacaattacttagtaattgcgcctaagatgccacgcatgatttgtttagaaacttggttggtcagctttttcgctatcgacttcgtcacttcactcaccacttgctcagcaatggtttgatcttttttctttttcgtaccgaaaatcgaagcaatcataccaccgaagaaattgttttcttcttccgctttttccgcttcggcttgttgttgagcggcttgggcttgagcaacttgcgcattcaataattcgtacgccgattcattatcaacatattcactgtaataagcatacagatcatcttgttttactaacgcatcacgctctgctgcggctaacggggttaattggcttttcggcggatgaatatacgccacttccaccggtgtcggcatacctttttcatcgagcaccgaaatcagcgcttcacccacacccagttgggtaatcgcttcaaccacgtccacgcctttattagcacggaaggtttctgccgctgattttaccgctttttgatcacgtggggtaaaggcacgtaaagcgtgctgcacacggttacctagctgacctaataccgagtccggtaaatctaacgggttctgcgtcacaaaatacacgccaacccctttcgaacgaattaaacgcaccacttgttcgattttgtccaccaatacttttggcgcaccgtcaaacaataaatgcgcttcatcaaagaacagcacaaatttcggtttttccggatcaccgacttccggtagagtctcgaacaattccgccataaaccacaataaaaacgcaccgtacatacgaggcgaattaattaacttctctgaattgagtacgttaatcacgcctttgccatcacgggtttgcatccaatcttgtaaatttaatgccggttcaccgaataaattcgttgccccttcgttttcaagagccaataacgcacgttgaatcgcaccgacactcgccgccgaaacattgccgtattccacttggaattctttagcgttttccgctacaaatttaagtaacgcacgtaagtcttttaagtcgatgagcaataaaccacgatcgtccgctactcggaaaaccaaatttaataagccttcttgcgtttcgtttaaatttaataaacgagaaagcaacattgggcccatttccgaaatggtggtgcgcagcggaatccccgattcaccgaatacatcccaataagaaaccggataaccgcttaaatagctttccccgcctaattggaattgctcgacacgttctgcaatttttccggataaactgcccgcttgtgcaagccctgaaaggtcaccttttacatcaaccaagaaaaccggtacaccgtcatcactgaaagcttctgcgaatttacgtaatgtcaccgttttacccgtaccggttgcaccggcgattaaaccgtgacggtttgccatttttgaatttaatgaaataatttgccctgttttcgtttgggcgagtgcgtattgtgccatattgaatactcttaaataatgacgtttatcataagttgaaccgcgccattttatgcttttttcaccccaactttaaagcctttttcccaattttgttggaactgattggcgttggatagcgttcctttacaataattcacacgttgctgatacatcgcctctttttgggtggtaaatgaatagccgacacgatagccgtccaaataccaatcatctgcatccttgcactgtgttgtattaattcttccatgcgtaaccgtttgtttttccaaattttttggttgctttggtcgttgagcataggttagcgctttcggctccggatagccttttgtcacttgtacaccctgacgtttttctgcttcaaacagcttgcctaaattacttagatcttccagtaccgtttctgtatccacagaaccgcaagcgctgagtaaaaaaggaatagtggtaaataatgttaattttagttttttcatttctactccaaaacgtctatcaagcatttgatagaccccttaaacaccacaaaagtggtatgacctcaataaaaagcgcacaaatttacaataaattctgagatttgtaaaagtaatttttaggtatcgcaagcggttaaatttcaggatttttttgcaaaaaagaagcctccgcaataagcaacttgcggaggcttcttgatatagtatagaaagattaacgacgtttagctgccgaatgtcttgggcctcgagccactcgagccggcttcggcaacgctaataacgcactggcgtcatattggctcaccggaatcgcatggccgatatattcttcaattgccggtaaattcacagcgtaacgctcacaggcaaagctaatcgaatgaccgctctctccggcacgtccggtacgcccgatacgatgcacatagtcttcacgatcatccggcaaatcatagttaaagacatgggtcacttccggaatatgcaaaccacgggcagcaacatcggttaccactaaaatatctaactgacctttggtaaagctatctaacagtgccaaacgttttttctgtgcaatatcaccggttaacagcccaacacggtgaccatccgccactaaataactccaaatttcttcacatttatgtttagtgttggcaaaaatcatacaacgatccggccactcttcttctaataaggtgagcaataacgccattttgtcttcattagaagggtaaaataattcttctttaatgcgatgtccggtacgttgcaacggctcaatttcaatatattgcgcatcattcatatcttcatacgccaactctcgcacacgtggcgaaagtgttgcagaaaataacatggtcaagcgttgcgccggtttcgggcatttacgcattaaataacgaatatctttaataaagccgagatcgaacatacgatccgcctcgtccaacaccaccacttgcactttatctaaattgatcacgccttgtttaacataatcaattacacgtccggtggtgccgactaaaatatctacaccttgttcaatcgcttgcacttgcttgtcataaccgtctccaccgtaagccaacgcaagttttaaatcggaatgtttcaccaatagctcggcatccgaaccaatttgcaccgcaagctcacgagtgggcgctaagattaaagctcgaggctgattagttgctgtttgaatatcgttagttaataaatgatggaaagttgcaaccaaaaacgccatggttttacccgtaccggtttgcgcctgtccggcaatatcattgccggctaaagtaatcggcaacgttttcgcctgaataggcgtacagaattcaaatcctttactgtcgagtgccgcaattacattttcatgaatcggaaaatcaataaaacgctgttcggtgagatgtttggacatcgcaaatctccttttgatggttcaatttaaagccgtagcacaggctataagcatatcacagaagcgaaatattgagtagaaggtgattatttcgccagtcagattgcgttactccgccctccctctaattagctgctcgcaaattagcctaacacctccttaatgttaatttacatttcattacataaaattaaattactcaattgttaaatttacctttggaaataaaatgcacagcaaagatcaatttttgatcaatcaaaccattttattttttgcacacaactgattagaccagtttaaattaaaaccaaaaagcacatgctttaatcaccttattttaacatttaagcaactttttatttaaataacattagcaaaaaagtggttatcttcttggaatttgctgaattttgcacacaaaacctagcaaaagtcataaatatcatttttcataacaaaatataaacaattttttatcatacttttcaaatataaagtttacttaatattacatagattgagcttaatatttacaatttacaaaactgaatttattatgcaccccgccaacgcataacggatttcatgtattggcaaaattcatttcattttttaatttttgataataaggagtttattaaaaatgttatcaactttaaccacaaaagcttatatcgctgtaactgaaggtatccgcaactttaaacaaaaccaacaaggtgtaaccgctatcgaatacggtttaattgctgtggctttagcaattttaattattactgtgttctataatgatggtggttttatccaaagtttaaaagctaaatttgctgatcttacaaaatcaattgatagtgttaacgggaaattaagtattaaccaatcaaaataaaattcttataccttttaattgggtataaaaatacgaaagtctctcagccataaacatgaaaaaacttctacagttttctcgcctgcaacaaggtgttaccaccattgaatacggcttaatcgctgtcgcaatggcggtttttgttgtggcaattttatatggtgaggcaagtttcacggatgaaaccttaaaaaaatataaccagctttccgagttggttagaacggcgcttttgagtacgtcttaaaggcgccggtaaagggcataaacgataaggatatcacttatgacactctttataacctcccttcttgccataatcatttgtttactgataaccctttgctggacggacttacgttatcggcttatcagtaatcgaatcattatggcattattgttggtcactattccctttagctatttagtgcatggcacactgttttggctacctgcattgctctgtttagccatcggtttcatactctttatgttcaacattatcggcgccggcgatgtgaagttgcttgcggtgttgatgttggcaattccatcacattttgcagtttttttcctttttttaaccgcttgtgcgggtttgttgctcattattatcggctggttgttttatcgacagtccattcgggaaaaaggattaccttatggtatcgcaatcagtgttggctttcttaccaccttactactttttaactattagaatttaaacctaaggaaataactaatgaactatagagtgctatttatcatctcgaccttcattctcgttatcggctttggtggactatttatgctgccgaatgcagaagataacgttcctcaaaacgaaacggctgcagcaagtacggaaacaaccacgcagcctgaagtggcaactaaagtgattactaccgccacccttaatcgagacttaaccaaagggacgttaattcaagcggaagattataccctttcggaattaactgtaccggaaaccagtccgttactcagtaacgatttaaaaagcttacttgaagcagcaaccgtaccaacgctacaaggttttgttgctactgaaaatattaaagccggttctttactgcaaccggaattgctgattacaccggacgatcctcgttttattctgtttagcattaatccgcaacaagaagttgcctatcgagtgtatatccaaagtgccgaacaatatattttagattcggtacgtagcggcgatagcgtttcggtatttagccaacaaaccgatcttgctcaccgagaaagagaccaaggctctttagtaaaacttgccgataaccttaccgtgttacaggtaaaaactttcacagcggaagaaaacaaaaatgcaagtgaacagaaaaaagatttcttaggctacatcagcttaaaagtagatgcagcgatgctgaaatcattttattcacttgataagcaagccaaattaattgtgttaccaactgatgctgcaaccaaagctattaatcatcgaggtatgtttattcgccaattacgaggaaaaaataatgcgaactaatttctttccgaaaacattaatctgctctgtgctgctaggcttatttgcattttcacatactgcagcggcaaaaaccttcactcttgaacaagggcaaagccagttaattaaaaccgatgccaaaattgatacggtatttgtttcttcgccggatattgccgattatgaaattttagatgacaacacctttatgttatacgccaaagcggaaggtcgtgccgaaatcgtcgcatttgatgtggacggtacgccattaaccgaagatttcattaacgtgaataatgcgatcaataacattgcagcaacaaatgaacaaatccaaacacgttttccgaacagtaacctttcggtaaaaaaaatcgggaaagcttatgtgattgagggaaaagcaaaaaacgccgccgagagcgaagagatcaaccggattgtcggtgaatcgctcggagctggtaaaaaagtcgttgaagcgaaagtcgaaggttcagaagatgccattcctttcttagataagtaccaatacgaaggcattattaataacgctaacgaagaagacgcaacgcagatcaatgtgaaactaaccgttgcggaagtgaataaaaccttctcagacgaaattgggattaactggaacaatctaagcggtaactttttccgcaatttaggtagtgcggcaatcaatggcggttttggtaaaagcggcggtcaattagcattggtaaattcgaataatttaaatgtgttattaagcgccttagacaaccaaaacaacggcaaaattttagctgaaccgaatatatcaatgctttccggcgaaaccgcagatattttggtcggtggtgaagtacctttcgtacaacgaaacagagacggtgaattgaacgtactttataaagagttcggtattaaacttgccgtgggcgctaaagtgcaaaaaagcgatcgtatccgcttattgttatcacaatcggttagcaccattgccggtaactacgaaatcgatgataaccatatcccgatttttaatactcgtcgctcaaaatcaacctttgaagttggtaatggtgagagctttattatcagcggcttactcaataaacaagatatcgaaggtattaagaaggttccattcttaggcgatgtaccgattttaggcgcattcttccgtagtgcgaattcatcacgtgagagtaaagaattagtggttgtggcaacggttaatctagttaaaccggttgatggctcacaaatactttatccgacatttgaaaataccggcacgatggaacgtttctttaacagtacatcactgaaaaatgtttatcacaaaacattaacgtctaacttcttaaaaaatggtgggtttatccaatgaaaaaattaatcacaatttgtgcaggtttaggtctgacactaaccacctatgcaatggctagcactgaattacctaaaacaattcgtccggtacagccgactcatagcgaattggtttcaaataaatccttagtagtaaaacgctttatattagccgaaccatcggatgtggcatttgaaaacttagtttcagatgtaagacgccattcatccagtgataaaaatagtcaagcgatccacattatttcgtatgacaactcagcaaaaacattagctaaaaatattagcaagcgtttaaaagcgttacacgttaaaccggctatccacgtagaacattataaaacgaaaaatagcctttatccgctttatgtagagatccgtcaaattgctaagcgtacttcgctatgcaaagtggaaacggctgaagatcatatcgggttcgattcatatcacgattgtgctctcaaacataataaccaagtgcagctgaaatattaggactcattcgggattgttgcttttatattgtgtacgaggaggtctttatctagccaatataaaagacattttagcgtaaatggcaatccccatttaaataataactaaaaggatttaattatgttattgctcgatcaagaaggtcatggcggcgaaggtgttgatagcatccgcaaaattgccattatctctgaaaaaaatggcattaataatcatattgcccaacttcttcgttctcgtggattagaaaatattgaattaattcacgctaacttttttaacgccgaaaatctcgcattttctgcagaagaaactgtaggtgtcattgttgatattcaagatgaaaccaaactcgccaacattaccggtcgcattcacagcgttatcccacaaaatgtatggtgttgtgtggttggggaaagcgactccatttcacttttacaaaagctattagaacaaggcgtactgtatttcaacagtgaaacgcaattaacccaaatggttgctcgtatcttgggtggaatgaatattccattagtgcgccatactatcaagatttccgtattaggttgtaaaggcggtattggggcaagttttattagctctcatattgcgcaaaccattgctaccgagaaaaaagtgccggtgttgctggcacaaggctcaaacggttcgcaagatttagatttgctatttgataagaagctgcaaagtgacgtagcggaatatactgcaaatttagatttatatcgtggcgtaccatccagacttgctagcgaaacgctgaataaatacaacttcatcgtttatgaccaaccgatctttaacgtaaataaagaagactacccaagcatattacaacacagcaatacttttgtattggtcgtggaacgtaagattagctctctacgtgtagcgaaacagttcttaggcgaatgcgagcgaatgaaagccaataccggcagattaattcgtacctttgtctgtatttctgaccataagcaagaaacagcaaaactgatggcaaccgctgatattgaacgtttattgaaatgtgaagtagatggtgtgattccctataacaaacaatctaccaataaagataccgtactgacatcaactttaagccgccaaggcaaaaaagaaatagcaacgctggcgatgaaggtcattggcatactctctcgccaagcagctcaacgtaataaaaaagtaggtctgtccttattccaaaaactctttaaataacgattattatgctaacaaaagaacaacaaatattcttccgcacagaattactcagtaatttggacgtggaaaaactcgatgaaatccaaaacgagcgtaataaattaattgaagaacttactcagtctctttatcgcattgctagcagtaatgcgatttatctgacacctgccgatgctacttatatggcaggcttagtcgcagatgaaattgacgggtatggcccgatacgtgagttaatggaagatgaaaccgtcaatgatattttagttaacggcccggataatatctggattgaacgtgcaggtattcttgagaaaaccaaccgaacctttatcaataacgaacaattaaccgatattgcaaagcgccttgtcgctcgagtcggtcgccgtattgatgaaggcatgccgttagttgactctcgtttacctgacggtagccgtttaaacgtagttattcaaccgatcgcattggacggaacttctatctcgattcgtaaattctctaaatcgaaaaaatcattacaagatttggttaatttcggttcaatgacgttggatatggcaaatttcctaattattgccgcacgctcacgtgtgaatatcattgtttcaggcggtacggggtcgggtaaaaccaccttacttaatgcgctctccaactatatttcaccaaccgaacgtgtactaacgttggaagatacggcggaattgcgtttagaacagccgcatgtagttcgactggaaactcgtttagccggtgtagaaaaaaccggtgaaatttcgatgcaagacttagtaatcaatgcgttacgtatgcgtccggaacgaatcatcgtcggtgagtgtcgtggtgcggaagcattccaaatgttacaagcgatgaacaccggccatgacggttcaatgtcaaccttgcacgccaatagcccaagagatgcgaccgctcgtttggaaagtatggtgatgatgtcgaatgcttccctaccgcttgaggcgattcgccgtaatatttcttctgcggtaaatattattattcaagcgtctcgtttgaatgacggctctcgtaaagttaccaatattactgaaattttaggcatggaaaacgggcaaatcgtcttacaagatattttctcatttgagccgagtaaatatcgtgatgaaaataacaaaattatcggtaagtttatcaatcacggcttactcacacgctcggtggtttatcaaaacgcccaaatgtttaatttaagtaatgagctacaaaacatctttaaggagaaataatgatactactctattattttgtccttgcctttggtgcgttattgttgctgtttaccgcttctgcttggtttaaaacgactaagaaaattaatgctcgtgaaactaactttagcgagaaccttgataaaaccgccaaaaaactgcaaaagatggctcatttatggttctattactttacatccggcgataaaaataatcttgtccgaaatatcattatccactttttgatctttaccggcttgtattatctcaatgcccaatttattcgctttaataaccaactctttatggtggtggaattaattggctttatcgttgctgtatggaaattaggtcaacgccgcaataaaaagctatttaatgaaaaatttcctgaagtgattcaggtgcttaactctgcaacctcttccggtattagtctgttacaagcattagagcgctgtggtaaagatattactggccctattggagaagagttcagcataatctacaaacgtttagctcgaggggaagatgcaatggcggtatttcatgacagttactctcgctatccttataaagagttttacttctttatcagcattatccgtaccaatctctctcgaggtgggcaaatgcgtgaagtaatttctcgcttaggacgtgcaattgcagattcaaacaaaatggaacaaaagaagaaagcaatgacttcagaggctcgaatgtctgccgcaattgttgcctgctttcctgttgcgttcttcctatttatgaaagtaaccacaccggaaaactttgatttcgtagtaaatgatccaaatggccgaattatcctttattacgtggtgggaagtgaattactcgggatgtttattatctggtggctaatgaggaaatcgacctaatgaatcctattttattcttccttggcattattttttctggcgtatttattttaattgtggcgttttctcataaaaagaaaatcgatcgtaacaaagaaatcttagaaggcattcgtccgaaagacaatgttgaagataacagccagaaaggaaaaaacaaacaacaaattgaactggaattattactcgttaataaaaatccattgcttaagtttcttggtttagttgataagaatattaaagtgaaaatgttggttatcgccctgcttactttgattaactaccttatcagtgaagaccaaaccacctttttactaggttgtgccgtagtggtggtattagcaattatgctaccaagtatcacaatcggcataattctgaaaagtaagattaagcgcattatgaacgatatccccggttttatcgatctagttgcggttaatgttcagaccggtattagtatcgaagcggcatttaaacaagtggcaatcgacttcgaacatttaaatgcagacttaacctacgtgattctacgcatcatgcgtaaagctgaactcactagcttaagtgccgcattacaagatatggcaatttcgttaccaaccaaagaaattcgaatgttttgtacggtaatgcagcagagcctaaatttcggttcttcactttatgaacatttaacacaactgtctgccgatattcgtgaaatgcaattacttgtaatggaagaaaagctcggaacactttctgccaagatgagtattccgctcattctattcattatgttccctattattattttaattgttgcacctggtgctatgagggttttaccacatgtcttctaaattatttaaaacaatttttgtttcaaccgtattattgtctttatctgcttgttcaagtcttacaacttcaacttctgcgacacagagtgtagatcaacaagaaagactttaccaagatactaaaaactatagtgcattaatttcgttataccgtgaacaacttaaattaaatcaagatccacaactgcaatacaaactggcgaaaagctactacttagccggcgatagtaagtcttcactactttacttagaaccactgcgctttactcaactctcatttaatgacgatgtagaattattgtatatccgcaatcaaattcaagtaggtgattacaatgaagcttatttaacggcaagtgatctgattgctttatcacccaaaaatagcgaggcatacaacttgcgaggcattagttctgcacaattaggcaaattagctgatgctgaaaaagatctgaataaatctcgagagttatttattcacgacacgattgctatcaacaatttagcgatgctaagcattttaaataatgactataaaaatgcagtaaacctattactaccacaatatttaaacggctcaaccgattctcgtttaattcataaccttgtctttgcgttagttaaggcgggggatactgaatatgcgttagatattattcgtaaagaaaaactaaatacttcaccggaagatttagtcaatgcattaaagaaaactgaaaaattaccgatggtaggtcgcaaatgatgaaaaatacgctttaccgttttctccataatgtaaaaggcgtagcaactattgagttcagtctcacgattggactctttattctcgtcctttttatgatcgcagaagggtgtcggatcgcccttctctcgtcttatttagatttatcggtttctgaggcatctcgcaccaccagaaaacaagaaattggcagtaattataaagaactattcgaacaaagtctgaaacgtaaagacagcatttggacatttctaaatcaagattctattacggaagttaatgtgcaatatgccaacagcttggatgatttaatcgctcaaaaattccaatctgctgccagcggtgtagcttttgcacaatactcattccaatatagatacaaaccgttgttcttctgggtgccaagcgctgcagtcgaaccgttatttaatcgctctatcgtggtactacaagaatatgaaaaagataaagcaatttctcactaatcctcgaggctcagttactgttgagtttatatttattttcttcctgttttccgtactactgattttcttaattgatgtcaccattttgcaatcaaccactgggaaactacaacgtacttcttattcattactgaatatcaccaaagaacgtactgccgtatataaaggcaatgaaactatcactcaagaggaagcagataaacttaaacaacttgcgatttcattaatgggagaagaaaaggactccaacaatattgcagtaacaattgagtactataaatttgatagtgttaagcctcaacaagccgtttccgatattttagcaaccagaccgaacaaaaaagagactgtgacaaaattctcttccggtaataacgtatgtgaagcaagtggaacccaagatgttacaaatgccgcaccacttactcaaaacttccgaggttcgctacgctatgcatcaatttatcgtataacggtttgccgcaaaatgacgaacttatttaaaggtcttacgcctgcaaaagaagaccaagtatctggttggataagagctaccgctatgggtgtaagccgctaaccactctctttctaaggatggaacttttatgaaaataacatcatttaatcagattaaacgctttattcaggatgaatccggcgtctatgcggtaatcggcggattattagctttgccgattgtcgcgcttatgtttgtctcgcttgaaagcgccggcattatccaagataaagctcgtttatccgacagcctcgaacaagccgtgttatcgcttagtgcggaaaacaatagtggcagaaagtctaatgactataaattatctaatactgatgccgaaaatggtcactttaaccctaactcaaaaattggtgaacgtgaccttgaaatttcgaaaagttttgtgacaacttatctgccgcaaacagatccaaacaaaattaaacttcagcctgtttgtacaacaactgataaaaaaaatagacaaggacataccgcatcaactgaaaccatttgtaccgtagctggcacaattgaacataagtcatggttcccacttaaagtcggtagcacggaagttatcccaacagaagttaatattgcaagtaactcaaaagccattaagaaaaatactattagtatcccaattgatttaatggtggcggcggatttatcggggtcgatgcgttatgatttagaaaatagatatgaaccaaaagatggaacaagcaaaattgatattttaaaagctgtattaaccgaattatcttctaactctttgtttagccaagagtcaaatgataataatcgtattgctgtatcgccatttgcattaggtgcagaatattcaactacggaatgtacacttccctttgctttgaaaaataataacagaactattaattacacaaagagtttgggcataccaacaacagaaaatgtacaagatattatcaagaattatctaaccaaatctggttcttcaaattcacaattgtctagagctatctttacacaaagcctagtaacacagattgatgtcactaatacactttcttcaataggttctctagacaaagttggcttaaaatttcctaaaaatgcctattgtttaggagataagaatagaaatcaacaccagtggtttacacgagaagaacaggataaattttctacatttgttaatagcttagaagccattggtagtacatttgcaggatcagggttattagctgccgctgataaaatgttaaaagaaacaagccgtactcaaaaattaggcgaagaaaccaaaagagttctattagttctttccgatggtaatgatgaattaagagcagatgacactggagtaccatttacaaactacagtagattaactgaagaccttattttaggctatcaagaagaaatttttacatctccatctgaacaaaaatctttccatgatattacttactatggaagaagaatttattcagggaaatctgacattattttaggtaatagaagaacaccattatcgaaagacttacaaatgtgtaatattattcgtgataaactaaacaaactgaatgacgacaagaatacatcgattgtttttgtagaattcggctataaatcaaaatctgctgatgcttggaaacactgcgtaggtgatggaaactactactctgctaaagataaagaatcactacttaattcatttaagcaagcgattggtcatactgatgatgtaggtcatagtattaactaagcctaggttgagctaggacaaaaaacaagcggtgtaatttgtaaaaagttttgcaaattacaccgcttttatttggtaggtagttaacttaagcgctttttagcttgttcggcagaatactttggaacagttctcggctcttaagcggttgtgaacctaagtaaggtttgagcgcaatacgagtaaagcgttttgccgcttgtaaagttgctttatcagaaaaatccagctgctcaaaagccaataaatctttgcccaaaaagctagcgttattctgcaacagcgaagcaataaagccttgattttctttaaattgatacgtcattgacggtgaaatcggatctccggttgcagcacatacgccgaaattcacaccgtaacctaatgcttttaacgtgtgaaattcaaaagttcttaaaatcgcttcgagattatcaggctgagttgctaagtgtgttacacactgtaaatagtgctgaaaaagcgccggataagcggtctgattttccaaaactcttgcaagaacttcatttacataaaagccgctgtataacgccaaagtttgcattggtaaagttaacgaagccggttcggctttggttaaagtttttaactccccttttccgctccaacgtaatagcaacggcgtaaatggttgtaacacggcttttaatggcgaacaaggacgtcttgcgcctttggcaagtaagctaatacgtccgtgatcttcggtaaaaaaatctaccaacaaacttgtttcactatattcacggcggtgtaaaacaaatcctcgatgccaattttctatcatgatttatttcagaaactactcgtccatatagcctaaactacgtaatgcacgttcgtcatccgcccagccggctttcactttcacccataattctaagtgaactttgttatcaaataagcgttccatatctgcgcgcgcttcagtaccgatggttttgattttttgaccttttgcgccgatcaccatttttttctgaccatcacgttctactaaaatcaggccgttgatttcataagtaccacgctcattcagtttaaattgttcgatttcaaccgtaactgaataaggtaattcttcaccggtaaaacgcattaatttttcacgaataatttccgatgccataaagcgttggctacggtcggtaacatattcttcagggaaatggtgaaccccttcacgtaatgatttacgcacaattttttgcagaatatggacgtttttaccacgctgtgcagagatcggtaaaatttctgcgaaatcgaatttttgtgaaagctcggtaatatgcggtaataactcatctttttctttgatattgtcaactttattaatcgctaatactaccggtgcttttgccgcacgtaatttatttaacaccatttcgtcatcgtcggtccattttgtgccttcaaccacgaaaataattaaatcaacatcaccgattgccgagcttgccgcacggttcattaaacggttgatcgcacgtttttcttcaatatgaagtcccggcgtatcgacgtaaatcgcttgatattgttcttcggtatgaataccgacaatacggtgacgtgttgtctgcgctttgcgagaggtaatcgaaattttttgacctaaaattttatttaataatgttgatttaccaacgtttgggcgaccaacaatggcaataaagccacaataggttttaggttgttgattttgttctgtcattgttattccttgatgcagcggaatactttattgttatcttttatttcgctgctatagattatttatttaattttaccagcacttgctcggcggcattttgctccgctttacggcggctggtaccaacaccgataaaggtttcatcgaatgtttcaattttacaagtgactttaaaggtttgattatgtgcttcacctttaatatcaatcacttcataggttggtaactgtaatttacgaccttgtaaaaactcttgtaagcgtgttttcggatctttctgcgcatcacccggtttcatttcggctaataagtcttgataccatacggatacacgctcaatcgcattatccataccggaatccagataaatcgcagcaataatcgcttccacacagtcagaaagaatcgactcacggcggtaaccaccacttttcaattcgcctgcacctaatttcatatattcgcctaaatcaaattgacgagctaaaatcgctagcgtttgttcacgcacgagtgttgctcgcatacggcttaattcaccttcatttgccttagggaatttctcaaatagcgctttaccgatagcaaaattcaaaatcgaatcaccaagaaattctaggcgttcattatttttggctccggcactacggtgggttaatgcttgtaaaaggtaatctaggctaataaatttatagcctaattttttttgtaatcgctcgatatgcataaaaaattaaagggtgggcttacacccacctttctctggttattggattgaactgaacattcgaccaaaacgaataccgcttgggaattcatttggcttcttatcaaggcttaaccaaatataagttgccttacctactacatttttttccggtacaaagccccaaaaacggctgtcttcactgttgtctcggttatcacccatcacgaagtaatgacctgccggcacaatccattctccggctggcattccctcttgtgtgaagaaatacggttcataattaaacggctgtggattatttaagatttggtgagtcacatcacctttctcagtacgctccacttgcatttcaccatgatagaaaaactctgggtttggtacgcctacgctatagtcaaatacaacttgttggccatctgcgtgggtcaccgttaattgctgagtacgtacatcatatttaactcggtcaccacctacaccaacgacacgtttgatatagtcgatatgaggctgtttcggtgctttaaacacaatcacatcaccacgttgcggtttaccggtttcgattaacgtattctgccaaatcggatctttaatgccataactaaacttgtttacgaccaaaaaatcgcctacacgcagggtcggttccattgaaccgcttggaatttgaaacggttcaaaaataaacgaacgtaatagcgtcactaaaaaaagcacgccaaataatgaggcaaaaaattcaccggttgccgaacgtggttgaatctcagctttctcttcttccgttaacggacgatttaaatgcttttcttcacgagcaattgccaatttacggcgaggatccgcactaaacttgtaaaacgcccaaaatccgccacaaatcacaactaatgaaaccaataaaatggagattgtgtttggtaattgcattgaatcaagccatttccaaacaccgtataaaattgcgataaaaataatcggcataatttgtgccattgtgttctcccttgtttatctactgctatctacgacaaaaccacggaatatagcagataaaacttgcaaaatttttgcaaaaatcgaccgcttgtattccgtgattctaagcatcaagcggtaaatgattagtctttacctacatgaagaattgctaagaatgcttcttgtggcacttctacgttaccgagagatttcatacgttttttaccctctttttgtttttgtagaagtttcttcttacggctcacgtcaccaccgtaacatttcgccaatacgtttttacgtaattgttttacggttgaacgagcaataatgtggttaccgattgccgcttgaattgcaatatcaaactgttggcgtggaattaaatctttcattttttccactaactcacgaccacggtattgcgcattatctttatgtacgatcaatgctaacgcatccacacgttcaccgttgatcataatatcaacacgtaccatatccgccgcttggaaacgtttgaaaccgtaatccaatgaggcataaccgcgagaagtcgattttaagcggtcgaagaagtctaacaccacttcacccatcgggatttcgtaggttaatgcgatttggttgccgtggtacaccatattggtttgtacgccacgtttttccacacaaagggtaatcacgttacctaaatactcttgcggcacaagcatattacattccgcaatcggctcacgaatttccgcaatattgctaattggcggtaattttgccgggctatcgacataaatggtttcgccgttagtttgtaccacttcgtaaactaccgttggcgcggtagtaattaagtcgagatcatattcacgctctaaacgctcttgaatgatctccatatgtaataaacctaagaagccgcaacggaaaccgaaacctaatgcagttgagttttccggctcatagaaaagcgatgcgtcattcagacttaatttacctaatgcgtcacggaatgcttcataatcgtccgagctaatcgggaataaccccgcatatacctgcggttttacttttttaaagcctggtaacacttcagttgccgaattgtggtgatgagttaaggtatcacccaccggtgcgcctaaaatatctttaatcgcacatactacccagcccacttcgccggtttttaattctgtcgtatcaacttgtttcggcgtgaaaatacctaaacgatcaacgttatatgattgaccggtactcattaccttaattttgtcgccttttttgattgaaccgtttttcacacgtactaaagagacaacgcctaagtagttatcaaaccatgagtcgataattagagcttgtaacggtgcttcaggatcgccttccggtgccggaattttttttacgatgtcttctaatacatcttcgatacctaaaccggtttttgcagaacaacgcaccgcatccatcgcatcaatccctacgatgtcttcgatctcttccgcaacacgctcaggatctgccgccggtaagtcgattttatttaaaatcggcacaacttctaaatccatttcaatcgcagtatagcagtttgccaatgtttgcgcttctaccccttgaccagcatccaccactaataatgcgccttcacacgcagcaagcgaacgagaaacttcataagagaagtccacgtgtcccggtgtatcgataaagtttaattgataagtttcgccatcttgcgctttataattgagcgttacgctttgtgctttaattgtgataccgcgttcacgctctaaatccatcgagtctaaaacttgtgcttccatttcacgatccgataagccgccgcaagtttggattaaacggtcggataaagtcgatttaccgtggtcaatgtgagcaataattgaaaagttacgaatgtttttcatattcatcgggcaataaatgtcctgtgttgtaataaatttatttaaaagggaaattaaccgaccaattctactttaaatccgttgctttggaaaggaaaagcacaaaaaagcaagcggtcgttttttcgaaaattttgcaaaaaaatccggaaaaaagaccgcttgttcagacaaccgtttaaagtaacgctttaaccgcttgcgaaacattagacgctaagctaattgcactaatcactgcaatcccatttgcaccattttgcttaagtattgcaacgtgttcagctttaacgccaccgatagaaacaatcggtttacgaattcctgcatcacgggctttcttaacaaaatccaaaccgatcggtggattatgtttttctttagaattagtcgggaagacgggccctagcccacaataatccacttcaatcatttgttcggaacgccaaagatcttccaaggtattattcgataaaccgataatcaacggtttattggtcatctggcgaatcatgattggagatatatctttttgcccgacatgaacaccgtccgcatcaatctcgatcgctaacgcaacgttatcatccacaataaacggaaccttgtatcggtgacataaatcacggcattgaatcgccaatgctttttgggcttgtggctgagcttctaatgaattattacctttatcacgaaactgaaagcaagtaatccccgcttgcaacgcctgttctaaaatcaacaataaattttgcgcgcgatcttcggtcggattcggacaatcttgtgtaccggcaataaagtaaagttgaagcatttgtcgtatatcgtacataatcattcctctatgggtaaatcttgataagcccaatgattagtcggcccatatccatagccaatattcagaggatgcgaaattgctgcgctgatatagtcttttgcaatttttattgcagtttcgaccgcttgtcctttggctaattccgccgtaacgcaagcagaaaacgtacagccggtaccgtgtgtatgacgagttggaaaacgtggacattccaaaataaaatgagtcgttggagtaaaaatccaatcacggcaatgcgtactttgcgaatccgccaaatgcccgcctttaatcaccacagtattcacacctaaatcttgcaatttttttgccgcctgataagcggtcgaatcatcgataatttttataccggttaaggcttctgcttcgggcagattcggcgtaatcacatccgctaacggtaacaaatacgtttgtaatgcactaatcgcatcttgttgtaatagtggcgtgccacctttggcgatcatgactggatcaagcactaatttaccaaaattatactgacataaagcatttgccacacactcaatcgctttcgcagtgcctaacattccgattttaaaggcagaaatttgaaaatcttctgcaattgctttgatctgagattcaatcgtacttaacggcacagaatgaatatcgaatacgcctaacgtattttgagcggtaattgcagtaagaaccgaagtgccaaaaacgcctcgcatttggaacgttttcagatccgcctgaatccctgcaccaccaccgctgtccgaacctgcgatggttaaagcctgactaatcttactcataagagaccctcccgtatttttcgattgtatcggcagaaagcgcgcccagctgatctaataatgcaatattgaatgaaccaaatgcattagtagctaatcctttcgcagccaattcaccggtaatagcatacgctgttacgccctcgcaagttgcctcaaaaatttgaccgcttgtcgcaacggcactaaatgctgccaatacagatccaagcaaacagcccgaagccgtaatcttgggaaataatggtgtaccattgacaattttcgctaagcgtttgccatcgctgatataatcaacgcttccactaacagcaactacacattgatatttattcgctacataatgcgctatctctgcaatatttgccgttccattacctgcatcgacccctttagtttgccaatttagttcggctagtgtggctatttcacctaagtttccccgaatcaccgaaaaatgaatttcatctaacagtctcatcactgtctggtagcggtaatccgttgcagcaattccaaccggatccaatacaatagggatttctgcttgattcgcaattttcccaactaaacacatcgcttccacttctgctgaacttgccgtaccaatattgataaggagtgcattgctaatttttgccaaactttcagcttcttcaatagcggtggacattaatggtgaagcaccgatagcgagtaagccattagctgcaaaatgagcggcaaccacattagtcatattgtatataagaggattttgctggcgaatttgttctaaataatttgatttcatatttatctccatgggtaagtgtaaaaaatgacgcaaatagataagtcatccttactcaaggaggcataagatttcttatcatgcataaaaataaatgcacgcagctattcatcttgtttatctcaagcacagatataaccattacaaagcttgctgtgatgttttaaatgaatggcaacaaaaaaatgacaagaaaaaggaaagggtaagagaaataaagattggcatattagtttcctacgtcagtattaactgtatcaggttcacgggtttaatctcagcctcgttggaggcaccccgactaaaaattgttgttagtttaaagacattaccgatgaaaaccaatcggctgatgttgaatatgtgaacaagatcacactaaaaaaacaagcggttaaaaaatgtaacttttttgcaaaaaattacgaaatttaaccgcttgtctcaaagttagaactgatagcctacatttgtatggaatgatgtaccagagaaattgtcacgacgacctaaatcacgttgcaccgcaagttggaaatgccatggacttgattttgctttccaatcaaggcctgcttgtacattcacccaactcttatctgcttgcgctaagcctactttaaatttgctattgttaaaagtagtcactaattctgccggtgaatcacgccactcttttacccaacgagcatttacatacggctgccaatcggtaaattgataacgatattccgcaccaacaccgctacgcacgctacgaatttgctgttcttcaaaacttagtcgcattgcattcgcttccgtctcgccaaaatctgttactttaccatggctattggtaagatccgctaataatgccacttggctctgatcaaacttccactcatagccaccaaatacgctggcactgatgactgctccgcttgtttcacctttttgtgaacgtttagcactgcctagctgaatctgacgactggttttatagtcattgtcgcttaactgtaatgcagcaccaacccaccacttatccgcatcataacgtaccgcggtattaatcgctttgctcttaatctcgcctttcgttgagccttttgaaccgtctaaatcactttggctaaataatgcggagaattgccattgtggggtaaattgcgctttcaaccctgcataaatcgcatcaccttcgttataacgttgatatgctgcgataccttgtacagtattagtttcttgctttaataaacgattactgttgctttgttgacgagcgaaatcaaaagttttctccgttgaatataacgctaactgtggtaatacgcttacttcgcttggcgcttgtaatacatttaaaatgtaatccgccatcactttgtgcgctaccgcccccgggtggaaaccgtctgcaaataatttaccgtctgcgctagtttggtcagttggagtacaaactacctgtgtagttgatgcacatacggttgcagttgtattggttaaaccgaagtctgccggattactcaacatatccgcaaataatgcatccgtatcaatgcgaacaacattaccaccgactgaatttaatgcttgggtagttgcactatttaagaaacttgttgcgcttgctgcttgtgttgcaaactgttgatattgttgaagaagcgtattagtaaaagtcttctgatcaattactgcacttagtgctgaacctaatgaagattgataaagcgctcctactgtatttgctaatacctgcatacgtgcattttcaaaatctgccagatttgtttgagtcgtattatttaatgcggctaaatttgcatcaaacgcatcctgaaaagcttcctttgccatttcaccatagccagtttgagctgcgaagctacttgctgcagatgtaccaaattgttggaataatgatggcgtataagccacattaggtactgtcggtgcaacaagtaaagttacacccgattgttttaaagctgcccattgttgtgcgctattttgcgccgctactgtgctttcggtttgaactgtttgtaaagcatcttggcttgctatcgctttcgttaaaattgccggcatatcattaccgcctgcccacataacatgtaacgcatcattttttacgccatttgccaagtaattttgaatttgttgtgcgactgcaacattgggttgcacattggtatattggctattagttggaacaactaccccaccgctataagcatagttagatccgccttttgatgaagctgttaaagtactgcccaatgtttttgctatatgttcattataaagggcatttggcgtgccgttcggttgattataggtcgctttatttaaccatcctgtttgccccacatcgcttaaactgtctccaaacactacaacatcttgcgcaattgccgcagaggttaaagctgaagcaaataacgctaaatgtgtttttttcattttcactgtttttctcctaaaaataataaagcgataacattcatttacaaaataatgtaaataaatgttatcgctttacaaataaaaaacagattggacttgttagctaattagtcatttttagacttccaaatcaacggatccactccacgatgaattagatcttgatgctcttcaatcttaaataccggatcttgtcctgctttaacttgacggatatagtctttcaataagcgccatacaattggtgcgaggattaaaattgcaattaagttaatcaccgccattgatgccattaccgtatcggcaaatgcccatacaataccgccgtcacgcactgcaccgaaataaacgaagaataacacgatgattctgaagccccaaacaaaccaaggtttgtttttaatataacgaatattggtttctgcatacgcatagttgccgataatcgaggtatagcagaataataataagatgaacgctaagaaatgtaagccaaactcacctaaatggtattgtaatgcggtttgagtcaattcaacgcctttcaaggtgtcactaccgtaattatccgacattaagataatcactgcggtacaagtacaaaccaccattgtatcaacaaatacacccaacatctggattaaaccttggcttgccggatgttttgcgtctgacgttgcagcggaattcggtgctgagcccatacctgcttcattcgagaataaaccacgtttgatccccattagcatggtttttgatactaatgtaccaaacataccgccagctgctgccgagaaatcaaatgcactatcaataattaacgctaataccgatggaacccgctcaatattcattccaagaataatcacggcaataatcagataaaataatgccatcatcggtacaattttagaggaaacttgaccgataagcttaacaccacccgaaatgataataccggttacgatcactagtacaacgccgacatattgtccgtcccattcccaagctttactggttgccgccacaatagagttcgattgcacggcattaaacgcaaaaccgaaagtaaaaattagtgtcaccgcaaacgcaatcgccatcggcttaaattttagaccacgtgtaatataataagcaggaccaccacggaacataccgttcgggtcacgagttttatataactgtgcaagcgaagattccgcaaatgcagaactcattcccattaatgcagtaatccacatccaaaagactgcgcctggtccacctaatgcaatggcagttgctacaccgccgatgttgcccacaccgactcggcttgctaaaccggttgcaaatgcctgaaacggtgtaagtgagttcccttctgctgaacgtccgccccacatttcttggatacttctcggcaataaacgtaattgcaccaaaccggtagtaatggtaaaaaacattccgacgcctaaaagtagaagaatagttacgtcccaaagcggcccgtcaacagtgttgacaatccacgtcagcaggttttcaaagcctgaaacaataaaatccattaaaaaagcctcataaaaagttaaaaatagaaaaagggaaacgattgcattgtaatgattttttaacgtttgaaaagattttttaatctaatcaattaacaaaagttatcgtcttagtaatccagaaccagtcgtaatctcaataaaactgctatgaaataaggtgatgcctagcaaaatcaaaccaagccctgcagcaattttcaaaaagagtaccaattttttactggtctgttcagagatataccacgaacttaaacgaatcgctttattgcgagcgactaaaaccagccaagcaaataaacttagggttaaaccggtgccgaccgccattaccaacgctgaagcaaccccccaaatatataaatccaacgtataggctaaaaataaaactaaaattgcaccggaacaaggtctggcaccaatacttagaataatcattagctgagctttccaatcttttgctttctgcatttgatctgatgaaggcaaatgttgatgaccgcagccgcaattctctgtatgaatgtgcggtttagcgttaacaagcggtcgaatttgactcattttttgcaaattcggagttgcagagattttgcgaatattaggcttttgctgcacggtcgtttttactttccgtgaaacattttttaatgcttgatagcaccaataggtaccaaacaaaatcatcaacacaaaactgccccgctccacccatttaagcgtaaaattaaagtagctgcgagacagggtaaagaccaccacaatcaccgtcaccaaactcactgcgacaataccttgcattagtgcagataataagctgatcttcatagcttggtttagtttagtcttttcaagcgaaagatagctggtcaaaataaatttaccgtgccccgggcctaacgcatgaaatacgccgtagagaaaactaataagcatcaatgtcataccggcttgttgcgaatgcatacttagcgccgttagtgagcctgataattgttgattaaatgccttctgccatatcattacctgataaagtatcaccggatagatttggtaaatagcaaaaaatacgagaaacatgaccgctagccaaattgcagatttactttctattcgcatacaacggttaccttttgtgcaaattgagcgcctaacgaattatcttcattatcagacatttccggcgattggtttttatctaaactggaagcatatagacgtaacgaattactgattttcggttgggttaatgtcgctttacattgagggttcgtaatagacaatgtattagcactattatattccatccccatataatagctgggttcataggtataaaagcggacagggttatttttgagatcatgcggcttacttaacgggatcgtaatataaaacacaactcgattgccgtggattttaaaacgagtattaagtggcttcgcactaaatttgataggttggtctttcgcatcataaagatagctgaaataatgcgtttcaatcgcagtttgcgtcatttcatcggtaattgatttttctgttgccgctttatctggactattatttacctcataaattaattccgctgaggcaatctcatccagcatccactccatttcaaacgcctttagctttgtcccttctaccaagacgttattttttaaatcgacaaaagaatgcggatgtgcgagtaataccgaactaaacagtaccgctggaaatatactgaataattttactaatttcattgagtctccctattagaaaaacaaaaagcgaacaagtcaccctgttcgctcttttagaattaggctgagtcggtcgataagccgagttctgtcgtggacaatcattcctctaggcttgcattcgcatacaagctcaagcaacctacccgaactctggacgggccatccattgagttcctatttggtcttgctacgagtggagtttaccgtgccgtggaatgttgccacccacgcggtgcgctcttaccgcaccctttcacccttacctgcgctaatgcacatcggcggtttgctctctgttgcactggtcgtcggttcacaccgcccagacgttatctggcactctgccctgtgtagctcggactttcctctcgtttacttgtcccactaggtcgttcttgcgaacaattaagggcttcaataaaccagcgattgcctaaccaactcagaatagcgagtataatggatttgcaaagttttgccaatatttaaccgcttgttcggctaataattagcaaataaaaaaggattaagttccgaaaaacttaatcctctcttctcactaacttttaacgtttaaaaaattaaacacgtttgaagtctaagtgaactaattttggtttagttgggtgacgttgaatcgcttgtactttaacttgctcttctttacccgctacaacgatagttaatacttcgctatagaacgcatcgtggatttgtgcgttgtttacgttatcgtggtttaaaacgattgatacaggctctgcgttaccaccgtagatgattgcaggaacttgaccattgtgacgcaggcggcggctcgcacccttaccttgcgcagaacgaacttcagcttcaaatttgaatgacattgtttgattctcttaaagtaaaaaggaacataatgttccgtgaatataaaaaatagcaggcgacccagctatttcacaaaataattccgactaaaaaagccgagtgcgtattctacgcatttttttgacaaaatgcaaaacaaaaagaggcgaatagtatcgcctccattcattatttaaacaattaagctactagcgcttttacttgttttgcatacgcatcccaatcggtaatcgggcgagttgccacgcctgaatccattgctgctttcgcaaccgctgatgaaactgccacaattaaacgtggatcgaatggtgttggaattacataatccggaccaaatgataattcaccataggttgataatacttcgaatggaaccggctctttcgctaaatccgcaattgcgtgtgccgcagccattttcatttcttcattaatagttgttgcacctacatctaacgcaccacggaataagaatgggaagcaaagtacgttatttacttggttcggataatctgaacgaccggtacatacgattgcatccgcacgtactgctttcgcttcatgtggtgttgtctcaggcactggatttgctaatgcaagaattaacggatcttttgccatagttttgatcatatcttggcttaatgcacccgctttagaacagcctaagaatacgtccgcacctgcaaccgcatccgcaagtgtacgccaacccttatcttcaatcgcatagaattgtttggtttcatccatattatcgccacgaccttggtaaatcacccctttagaatcgcacatcgtgatattttcttttttgaaacctaatgaacgtaataagttagtacaagcaattgcagatgcgcctgcgccattaaccactaaacgaacttcactaatatctttccctacgatttgtaaaccgtttaccgctgctgcgcctacgataatagccgtaccatgttggtcgtcatggaatactgggatacccatacgctcacgtaattttttctcgatgtagaaacattccggtgctttgatatcttctaagttgattccaccgaaagttggctctaacgatgcgataatatcaactaatttatccggatcatgctcattaatttcgatatcaaatacatcaacaccggcaaattttttgaataatacacctttaccttccattactggtttagacgctaatgcaccaatattacctaaaccaagtacagctgtaccatttgaaattactgccactaagttaccacgagcggtataacgacgtgctgctgccggatctttttcaatttctaaacaaggttcagcaactcccggagaataagctaatgctaaatcatgctgtgtagcaagagatttagttggagtaaccgagattttacccggtactgggaattcatgaaaatctaacgcttgttgtcttaaatcgctcatagcctatccttaataatacgacaaattgatgtgtgttttagcagttaacaattgaaagacggctgaatacaacacgtctctaaattattaacaatgctatagtattttactgcaaaaattagcaattttgtgtgatttggatctaatttttaacagtttgttaaacataacaaaaaacgatgggattttgcaaaagaattgcaaaatcccaccgctattttactctaattaggtagattaattcactgttggtaaccaacccgctgagaataagaattcccaccatgcaatacctaatgttgcgtgaataatcaagctaccaaacgcaataataaaaccggctgtccaccaagatttgatgtcgttataacctgcaccgaatgtaatcggaccaggaccgccaccatagtgagttaccgaaccaccgtaagagttcgagaataataagcctaatgctaataattcaaccggtgcacccgcaactttaccgaccgttgcaaacacaggcaccattgcagctacataagcaccgcctgaagcaaatagataacgtacagatacacttaaaattaagataacgattaacgcaatgttaccgtgatcaccgaaatttaaatttgcacttagcgtatttgctaaccattcaaagaatttcgctttttctaaaatacctgacataccgatgataccaccgtaccaaattaaggtatcccaacccgctttgtttttacgaacatcatcccaagatacaatgcttaataccacacaaagtaccatggtaattaatgctacagttgtcgagtttacatgtaagaaatctgcaaagatccaacctaataacgccaatacgaataaaactgctaatgatttttcacggaagctcattgggcctagttcttctaagccttttttcgcaattgctttgttatccactttcgttaattctggttttgcaattaaatagcatacaaacggaataatgaacaagcataataaccccggtacagaagccgctaagaaccactgaacccaatttaaatttaaacctaagatgggtgccattaatgaaagagctaacgcattcggagccattgcggttaagaaaatataactggttgtcttaaccaccatataaacgtttaataaaaggtaacgaccggctaatttaggcgatttttcaggatctgaacctaatgcaaccgcaacactgttaatgattgggaatacgataccaccggcacgagcagtatttgatggggtagcaggagaaagtaataaatcaaggaaaacggtcacataacctaaacgaagtgtcgtactacctaaccagctaatcatatggtaagcaatacgtttacccaaaccggtaatcacaaatgcagaacttaacgtaaacgctgtaaaaattaaccaagttgtacccgattgataaccggctaaagtgtggctgacttttacaaactcacttgctccttcagtattaccgatagttgctgcagaagcggctacagcggcaagtaataataccggctcaccataaggtttcattacaagaccgacaatcgttgcaatataaatacctaataagcgccatgcaataagtggcagaccttccggtgcgggtaataagaaaaatataatcggtattgccactaacaccgctaatttctgtgcttttgataaagccatagattcacctctgtgtaaagattgaaatatataaaaagaaattcttatacctctaaagagtaacatcactatttttaacacactttaatgctaaaaaccttgatatttctctaagttttgcaaatttttttatttattaaaataatcaactatactctatgcctttaatgcaaaggaaaaatatcattaatgcaagtaaatccgcactaccgccacaactaatatttcgacggatacattcgttatcaagtttttccaaagcggaaatcatttctgatttagtaaccgcatttcgtaaaatttcagccgcttgctgtttcacaaaagttaaaccgtccatgccacctcgatgaacaacattcgtatcatcattgtgtgccatcaaccataataggatttggtgtaaattcggctgttcttgactgccaaattgcgctaaacagtgcgcaactgtgtttaaaccgttttctgcctcacctctcgcaccggttaacccatatgcccgatacagttttactccgtgtgtaagcggtaaattttcagggtaattttgcaattctgccgttagccctttcgcaaattccgataccatatcaaatagttgtgagagttctaccctatcgggagtatagatactatacaatcgtccgatagcacaacagatcagaccaaaagcaaaaatagcgcctttatgggtatttaccccattagttacttctaacatcgcattttcggcagcgatcccaagcggtcgaattgtcgtcaaaatttgcgattcaggcaatgtacttgtttcgattccctttaagacaaatttcgcaaaaaacggacgtaaagccaaggcgcttcgttcaaacgtttgcacattcatatctttatgtgaaccgttatttcggcggtcaactaacccaggtttcggagtgagataaacttcttgtaatagtgattgataaacggcctctgctatctgttgggcaaaaaaatcatcctctgcacgttgttgcatttgcgctacaatttgctcaatagaatgcttacgtgatctggcacagagtttggcattttctgcacaacataaacaagagcgaggtgagaatcccaatgctgtccgactcaataattctccatttggagtgacaacatcaatatcccacaagcgggcaagtggtgaactgtcttccaaatcaatgcaggccttttttagcacaatggcgtcaacaggcaatacaaaaatagcctcatgccctgtcacgagcggacgaataaactccgcagtcggtgaaatatttaatcttttgaataaagcacttagatgttccaaacatcttacaaaaatataatcaagcaattcatttttcttcaccccacctacggcggttagagtgacggacaataacgtttgctgatatttttcaaggcattcttgttgtaagaatgcacgttcctcacgtgcagttaatagctgttctagagaaatttcttctcctttgagagaaaagtttttgcaaaatttttggaaaatcataccgcttgttacttattgataaatacatataaaaaaggcgtgcttggcacgcccttacaattgaatattataacaattattcttttaccgcatataccgtatcgatcacagaaccgtcacgataacgtactaccgctaccggttgatcagttacctcaatttctttcggtttacctgtgatactgtatgcacgttcacaaagttgttcgatagtgaataattcaatgcctgcttcagataatttttcaattaagtccggacgtttcgggttcactgccacaccgtgatcggtaactaaaatatcaatgttttcacccggtgttacgcaagttaatacgttttctaccacgcaaggaatacgaccacgtactaatggcgctacaatgattgccacttgtgctgatgaggctgtgtcacagtggccgcctgatgcaccacgaatcacaccatctgaacctgttaatacgtttacattgaatttcgtatcaatttcaagtgctgaaagcaccacgatatctaaacgctcaaccgatgcaccttttgaactgaagtttgcatattgatttgccgatacttcgatatgattcgggttacgcgctaatgattctgctgcgtctttatcaaatgattgtacgtcgattaattttttgattaatcccgcttcgtgcaatgccaccatcgttgaagtgataccgcctaaaccaaaacttgccgtaatattttcacgacgcattttatcttctaagaaacgagttactgcaagcgatgcaccaccggtaccggtttggaatgagaagccatctttgaaatagcctgaaccgaaaatcacatccgcacatttacgcgcaattaaaagttctcgtgggtttgtggtcatacgggtcgcaccaccaccgatttttttcgggtctcccacttcatctacttgcacgattaaatcaacacggtcttgcgtaatacttgctggatttaatggatattcaccaaattcttcagttaaaagtaccactttatcggcaaattccgcatcaatacgtgcataacctaatgaaccacatttacttttaccgctaaaaccattcgcattaccgaatttatcgcacatcggcacacctaagaatgctacgtcaatttttaattcacccgattttactaagtgaacacgaccaccgtgcgaatgaatatttactggttcttttaaaatcccttttgagatctcgtccgctaatttgccacgaatacctgatgagtaaattttagtaaccacaccatttttaatgtgttcgataattgggaaatggctgtcaattaatgaacttgaagcaagtgttaagtttttgaaacccattgctgcaattttttccatcaccatattcactacgaaatcgccggcacggaatgcatgatggaatgaaatagtcataccgtcttttaaacctgagcggcgaatagcatcttctaagctatcacatactttacgatcttttgcggtacgaacaagtgattctgctttcggtacagcttggtaaacaggtttgccaccattaaatttttcgatacgttgttctcttgttgtcatagcggttcccccttattcctcacgaataccatgttttgcacgttcaagtactaatgcggcacggtcaataattggtgcatcgatcattttaccgttgagcgataccacacctaaaccattgcgttttgcctcttctgccgcctcaataatgcgtttcgcttgatccacatctttttgcgttggcgcaaataagttatgaagtaattcaatttggcgagggttcacaagtgatttaccatcgaaaccaagctgcttaattagtgctgcttccgctaagaaaccttcttcgttatttgcatttgaataaacagtatcaaacgcttgaatgcccgctgcacgagccgcttgtaaaattgaacaacgtgcaaataataattcaataccttctggcgaacgttcggttttaaggttacgtacatagtcttccgcacctaacgcaataccgattaaacggtttgaagctgttgcgatttggttcgcttgagtaataccaagtggcgattcaattgcggctaacattaatgttgagccaacttcacgtccacatgctttttcaatttcggtgatcgcatgatccatatcaatcacatcttgtgcagtttcagtttttggcatacgtacaatatcaacacctgcacgtactacggcatttaaatctgctagaccgaattctgaatctaatgggtttacacgcaccacacattcaatttctttataaagtgggtgttgaagtgcatgagcgactaagatacgagctgaatctttctcttttaacgccaccgcatcttcaaggtcaaacatgattgaatcaggtttatagataaaggtattactgatcattgccgcatttgaacccggaacgaaaagcatacttcttcttaatctaattttttggctcatagcactttcccccaatcgatttgttcgtcagttgcacgtaataaggcggcttttaatcttgcacgaagtacacagtctaatgcacctttatcttctaccgtcacttgtgctgcatttacatcaaattgagcgagtacttctttgatggtggctaaaatgtcatcaccaaattgttttcccaccgagctatttaactcaatgtttaacgtattcgcaggctcaatgcggacttgcgcatcactagattctagtgtgcctgccacagcgattttagttatctgcataatggtttccttattttttgctaataaacgaattactaatggacaaaagattacaaataaattggaaaatacgaccgcttgtactcccttctccattggcaactggttgtgatcgacggtaaaaacagaaataaagaaaataaattaaggtaagtaaaaaaaggaagaaatttgaccgcttgtaacaacggatagcaagtaacatagccaatagacgaactaacggaagcttttcgccactgtatttgagtctgtcttatgatatgtcttatagccatatgttaattattttaagaaaaaaaatattaccgcaataattgcattctaacgaattctcataattttgctaattagaaagaggtattgttgatatggatcaaccaacaaaatacaaagcacaataattatgaatataattcatgttaattctgaaaattatgaaattgacgttaattaaaagataaaaataaaataccctcactcgataccagaaaaaacggttgcaaattcaacaccattctaataataacaattcgcaagagggacaaaatatgagctatgctaaagaaattgatcatttaaatcaaagtgttgcagacttaaacggtcaaattaacgtttcatttgaattttttccgcctaaaaatgaaaaaatagaaaccatgctatgggactctattcaccgcttaaaagcgctaaaacctaaatttgtttccgtcacttatggcgcaaactccggcgaacgaacacgcacgcactccattgtaaaaaatatccagcaagaaaccggcattttagctgcaccgcatttaaccggcattgatgccagccctgatgaattacgtacaatcgctcaagattattgggataacggcattcgtaatattgttgcactccgaggagacgagccggctggctatgcgaaaaaaccattttatgcagcagatttagtgagattattaaaagaagtggctgattttgatatttcagttgccgcttaccccgaagtacatccggaagcaaaatcaacgcaagccgatttaatttacttaaaacaaaaaattgaagccggcgccaatcgcgcaatcactcaatttttctttgatattgatagctaccttagatttcgtgaccgctgtgccaccgtaggtattgatgttgaaatcgtaccgggtattctgcccgtttctaatttcaaacaattagaaaaaatggcaaaagtgaccaatgtgagaattccaagctggatgcaaaaaatgtatcaaggtttggaagacgatcaaacaactcgcaatttagtcggggcaagcatcgcaatggatatggtcaaaattctctcaaaagaaggtgtgaaagattttcacttttatactttaaaccgttccgagcttacttacgccatttgtcatacgctcggcgttcgtccatagacactagacaataatgtacaaataacggacaatgttcatattgaatgattgtcctgttgacttatgctatttttaaccaaactgattaccgccattatccttccgccatttaacgctttgattttatggattttttctttatttctccataaattacaattcaaaaagctgagctatttttgtaccgcattaggtatgacgattctctatatttgtagtacaccttatttctcacatcaattgattcaagcggtcacttttacccaaaaacttaccattgaagattacaaaaaagcccaagcgatcgtagtattaggcgggggattgcgtgacagtaatgagctattcggtaattatgcgattgccgccgcaccgttagaacggatgcgctatgcggcttatttacataaacagaccggtttgccgattttagtcactggaggaagcccagaaggacgagagccggaagcaaaaattatggagcaagagttgaacgattttttccatgttcccgttacttggattgaggaaaaatcaaatgttaccgaagaaaatgcaacattcagtaaaccgattctgatgcaagccggtattcaacatattgttttggtgactaaccaatggcatatgaaacgcgccaaaatgctgtttgagcgagagggctttaacgtgcttgcggctagcactaccgctcatcaggcgcttgatatcggaattttaccgtttatcccgcaagcacaagcgctacaaaatagtagcattgcccttaaagaatggattggttattggaaagaaaaacttatcggataaatagaataacaaagcctccgtttgggggctttcgcattaaggtgaatgaatcagatggtcaatcatcaaactggcaatatcaatgccgcttgcctgctcaatcccttctaacccagggctggcattcacttctaacaccagcaatccgctatcagaacgaatcagatcgacacccgccacgctaagtccgattgcttttgccgctttcgctgcaagttgttgttccgcttcagttaatgctatcgtttgagctttgccacctaaatgaatattggctcgaaattccccctcattaccggagcgcttcattgccgccacgacacgatctccaactacaaacgctcgaatgtcctgcccttttgactctgctacaaaatcttgcaacaaataagctaatttcgcttgctgtaaaacagccaaaacactttgggcggtttgttggctctccgctaacattactcccacaccttgcgaaccggataatgttttcgttactaacgggagctgatgttgggttaaatgcccttctaccgaacacagttcaccggctaacgaacttgccggcacagcgatttgtgcggtaaccaaggcttgcaaacttagccatttatctcttgccaaagcaaaagcggtcgaattatttaagacttttacctgttttgcttcaaagtaacgcaaaactcggcatcccatttccgtactggttgtgccgaaacgaggcaataccgcatcataatcaggcaataattgcggaagcggtcggtttttatcgtaagtttcacccgtttgataatagagctgtaataccgattgaccttgctccaccgctaactttatcaacatccgattcggatcaagaatatctaagtggatacctcgctgctcacaagcttgctgtaaacgtcggcagctatataaacgaggttctcggcacaacattaaaaatctcatcgtttcaacaatccttgttgttggaaaaatggcaacatatgcggacgtaccgctttatttaaggttttatcgatcgcagcctgccactgctgcccttcaccggttctctcctgataataagcggtcaaaatttcgttatattttgcaagttcagattggtctaacggctgatattgatcctcatagcaaactaatgttgccggcaaacgaggtttaagtgccggatcttgtgccggataacctaaacacataccaactaacggcacacaatattgcggcagtcctaatacctccgctactttagcgacatcattgcgtaatgctccgatatatacaccgcctaagccgaccgattccgcagccaacaaaacattttgtgcaaaaattccagtatctaccgcaccgataacactcacatccgcccaatctaattgcgaatccggtacaagctgtttatgtttataaaaatcaatgcaaaaaaccaaaaattctgcacattcggtcacatatgccataccagatacctcacgcaatgattggcgtatggtttgatctttgacacgaatcacgctcacgcattgtaaatgattggacgtggaggcttgttgcccggcttggattaaggtttggaatagttcttccgagataggttgttcggtaaatttacgaatcgaacgatgagaaagtatcgtttctaaggttggtttgctaatcatattgcccccgataaaaaagataaaaaaataagcggtcgaaattgcaaatttttttgcaaattctaccgcttgttctacaacttttccaaataatgacgaccgcctaatgccgtcacttggcgcataatccacgcctgacgtttacgcatggtcggccccggtttattcacccgaaacactaacggattaggtaacgaagcggctaataaagccgactcttgtaaagtcagatctttcgcacgttttttaaagaagtgcttcgctgccgcttctacgccaaagataccgtcaccaaattcagcaatgtttaagtacacttccaaaatacggcgtttaccccaagtattttccatcacaaaagttagcggcaattcaataccttttcgtagccaactttgtccgtgccataaaaacatatttttgaccgtttgctgagaaatagtggaagcacctcgcacttttttcgatttagcattgcgctgtaatgcaatttcaatcgcttgtaaatcgatcccaaaatggctttcgaatttttgatcttccgaagcaatcaccgccatctgcatttgccaagcgattttatctaaactgacccaatcatattggattttataattatcaccggcaatcaaatgctcaacttttttctgcgccatataagcggaaaatggcacgggtaataccgaaaaaatcatcaaaaacgtaacgaaagcaccaccaagccccgcccctaaacggcttgagccgaaccacaaccaaccggctctcgaaccaatctcctgcggaataaaaaacttgataaatttacggcataagcgtttgatcaaactaaacatggtgactgacttctttttgcgttttcgtttacgctttgccattaagtttctcgtttaaccactcaataaattgcggctccaatgttttcagcatattagaagcgcgcgtaatggttgcggcactagtgttcaagttttgctgaatttctctttgcggcacttcaccttttagtaacgccgcaacaatttgcacacgtagacctaaagagttacgttcatctgccgttaaaaacgaggtaaaaaactgttctaatttatcttctgccaccgcctgttgcaataaaaccataaactgttgccactcttgcggatcacgttgactataaagaattttcattgaacctccaaaataaggaaagcggtctgattttggcaaaattttgcgaaaataaaaccgctagtaaaataaattatttcttagattttttaccgccacgttggtcatctaactcagcgcctttcggtacgctaaatttgaacaaatcagacgatacgccaccaccggtaatattacgtaatacgtataaattgctctgtccgtctcgttcaatggtactaaaaccttttaacataccgctttgatcgatacgcacatcaaactgttttaaattactttttttcgatttcggttttaatacgaaagtatccgcattttgtgtcacatcatactgatcccagtggcttttatcactactggttaataatacgaacggtgtattatttactgcatcttgcaccgtattcaccgtcacttgtgacacaaacggatcataaaaccataaattcgcaccatcagaaacaattaaattttcttgcggtgatttagtatccatacggaacagattcgggcgcttcacttggaatttacctttacccgattgaatttgtttacctttgcttgaacgtaccgtttgatcaaaatccgcactatattggctgacttgctctaaacgtcgttgcaattcggcaactgactgcgcatcagcaaaagctgcgccagtcatagaaactaaggcaaaacctaataatgattgcttaattaattttttcattttttgttccttctatcaaagagaatcaagtgcctctttgacaacctattctgtaaaagtttcacaaagcttcgtactagcataacgatacaataaaataagccaaacaccaagaagcatttggcttttattttattgattaattatttttcacaaaattagtgcgcttcgtcccagttatcgcccacgccgacttctgcaattaaaggcactttaagctgaatcgctttttccatttccgctttaattaattggctataatgttcgatcaattcttcttttacttcaaacaccaattcatcatgcacttgcataatcattttgatattttcatcgcctcgaatcactttatcaatgccaatcattgcgactttaataatatccgccgcagtgccttgcattggtgcattgatcgccacacgttccgccgctttacggcgcattgcattactggacttaatttccggtaaatataaacgtctgccgaaaagtgtttccacataccctttttcactcgcactttcacgaatatcggtcataaattgttgcactgccggataacgttggaaataacgttccatatattttttcgcatcggcacgtgaaatgcctaattggtttgataaaccgaattccgacataccgtaaattaaaccgaaattaatagccttagcactacggcgttgctcacttgttacttgatccaacgctaaaccgaaaatttccgctgctgttgcacggtgaatatctttaccttcagcgaaggcggtaatcataccttcatcatttgctaaatgcgccataatacgcaattcgatttgtgaatagtcggctgcgacaattttatagcctttattcgcaataaatgcttggcgaatacgtctgccttcctcatttcggatcggaatattttgcagattcggatcacttgatgaaagacgaccggtcgccgttactgcctgatgataagaggtatgcactctgcctgtttttggattaatcattaatggtaacttgtcggtataagtcgatttcaacttacttaagccacgatgttccattaataatttcggcactaaatgcccttgccccgctaattcatccaacacttcttcattggtagaaggcgcacctttcggtgtttttttcaagacaggtaagccaagtttagtaaataaaatttcttgtaattgtttggtagaagcaagattaaagacttcaccggcttcactatgcactaactgttccaactcagctaaacgctgctcaatttctgccgattgcgccagtaatttttccggatcaatcaatacaccgttacgctcaatgcgagaaagcacttcaaccaacggcatttcaatttcattaaacaatttaaccaatgtcggcgctttatccaattccggcgcaagcacttgatgtaatttcatcgtcacatccgcatcttccgccgcatattgtgaagcgacatcaatcgcaattttatcgaatgtcagctgatttttgcccttaccagcaatttcttcaaactcaatcgtcttatgccctaaatagcgatccgctaattcgtccatattatgacgaccggtactatttagcgtataagattccagcatcgtatcgaatgcaacacctgccacctgcacaccgtgatttgcgaaaatagtcagatcgtatttaatattttgcccgatctttttcacatcatcattttctaataccggcttaagctcattcaaacaagcggtcaaatttagctgattttttgcaagttcaaagcttgtggtagtttccacttctgccggctcggcaaacagatcgctttgctgaggctcaagcgttacctgttctttgtgcgttaacggaatatagcacgcttcgccgttagccaagccaaatgaaattccgactaaatttgccgacatagagtccaaactatcggtttcggtatccaccgccactaattttgcttggttgatcttttcaatccaactctgcaactgcgccattgtggctaccgtttcatatctgctacgatcaatctccacttttgcaaaagtttgctcggtttcgaccgcttgcggtgctgaaacagtcgcttgataattattaggaattttttccgctgaattttgcgtgaccgggttagcgtcattcatcacttcattcagccagcgcttaaattcataacgtccaaacaactcaactaattcatcacgcttttgtgattgcaccactaattgttcatgggtgacttccagttcaacatcggtcttaatcgtggcaagcaaataagataaatccgccgcttctttctccgcttctaatttcggtgcaagtgttttagcaccacggaatgaaagtgtggcgacttgatccaaattcgcataaatctcttttaatgagccgattccttgcagcaaacctaatgcggttttctcgcccacgcccttcacaccaggaatattatccgaagcgtcgccttgcaatgctaaataatcaataatcagctctggcggaataccgtatttctcaatcacaccttcacgatcaagcaaagtattgttcatggtattaattagcataatgtgatcgttcaccagttgtgccatatctttatcgccggtactgattaacacgttttttccgtcattcgccgcctgcaccgcaagcgtaccgatcacatcatccgcttctacaccttcaatcgagatcagcggaatgcctaacgctttaataatcgtatgtaacggttgcacttgtgcacgcaagtcatctggcatcggaggacgatgcgatttatattgctcaaataactcatcacggaaagtcttacccttcgcatcaaaaaccaccgcaatatggctcggctcaacctgagcaattaaacttttcagcatatttaacacgccatacatcgctcccgtcggctcaccatttttattagtcagcggcggaaacgcatgaaacgcacgataaagataagaagaaccgtccacaagaacgagcggattttgagcaattgtagccattttaacctttattttagaagtgaaaattactgcaattatagcggatttttctacttaaatctgaagaaatcgataacttttcgagttatatcgaaaaaatcacttttgcagattgaagaataaaaggaaaaacttattctcaatttatctgatttaaatttgtatatacaaaggtgaaaaatgctgataatctcacatcaaatttatttaaaactgattcagaagcatggactttctgatccggaaacggaaattctcgaagcattttcaaatataaacggacaatttttaattgatacacgtgaagaacatttgagcgaaccgccaacagaatggtttattgccgaaaccaataggggaataaaactcaaagtctgttttatgcgaaaaaataacgacatttacattcgaacagcctatcgcccaaatgcggaagaaattcgaatttacgagaaatataaatagaggtaagtatgaaaaatattgaaaaatgggaaaacagagaactagggcaagatgaaaaatttgtacaacgttcaactcatacaacgccagaaatgttagaagaactacttgctttacagccaatctcaattcgcttatctaagggattaattcaagatctcaaagatatcgcccaacttcacggactaggctatcaacctctaatcaaacaaatcctaacgcgtttcgttgagtctgaaaaacgaatgttagccaatgaaaagattcaagaagatctcgccaaattacataatgcagcttaaacacaagcggttaaatcccctttaaattttgcaaaattttctggaaatttaaccgcttgtttagtggtgtgctttagcctttggctaaaatctcttttaagaatcttgccgtgtgcgagcgtttgtctttcgctacctcttctggtgtgccggttgcaataatttgtccgccacccgaaccgccttcagggcctaaatcaacaatccagtcggcagttttaatcacatctaaattatgctcgatcaccacaattgtattgccttggtcacgcaatttgtgtagcactgaaagtaattgtttaatatcggcaaaatgtaaaccggtagtcggttcatctaagatatacagcgttttgccggtatcacgtttggaaagctcggtcgctaatttaacacgctgcgcttcgccgccggaaagtgtagtcgaagactgtcctaagcgaatatacgataaaccgacatccattaacgtctgcaatttacgcgcaatcgccggcaccggtgcaaaaaattctctcgcctcttccaccgtcatatccagcacttgatgaatcgttttgcctttgtaacggatttccaaggtttctcggttataacgtttacctttacagtgatcacacggcacatacacatccggtaggaagtgcatttccactttaatcacgccatcgccttggcaggcttcacaacgtccgcctcgcacgttaaaactaaagcgtccgacattatagcctctcgctctcgcttcttgtgtgccggcaaataattcacgaatcggcgtgaataaaccggtataagttgccggatttgaacgaggcgtacgtccaattgggctttggtcgatatcaatcactttatcgaaatgcgacaagccatcaatcgattcataaggtgcgacatcagtacgttccgcacgatttaatgcattttgtgctaacgggaacaaggtatcattgattaaagtcgacttacccgaacccgacacaccggtaatacaagtgaataaacccaccggaatatccaactgtacttgttttaagttattaccactcgccccttttaaggtgagcaattttgctgcgtcataaggcactcgttttgccggaatttcaattttctgcttaccggaaaggaattgtccggtaatcgaatcttccacctgcataatttcttctgccgtaccttgcgcaataacttgaccaccatgtacacctgccccagggccgatatccacaatatgatccgccgcacggatcgcatcttcatcatgctccaccacaatcacggtattacccaaattacgcagatgaattaaggtatttaataaacgttcgttatcacgttggtgcaagccgatagacggttcatcaagcacatacattaccccaactaaacccgcaccgatttggctggctaaacgaatacgttgagcttcaccaccagataaggtttctgccgaacgagaaagcgagaggtaattcaagccgacattgaccaagaactgcaaacgttcacgaatttcttttaaaattttctccgcaatcttcgctttttgaccggcaagatctaactgttcaaaaaattctaacgcttcgccaatcgatttctccgataccatcggcaaattagttttatctaaaaatacgtaacgagcttcacggcgtaagcgagaaccttcacactccacacacgggcgattattgatatatttcgctaattcttctcgcaccgaattcgactcggtttctttataacggcgagccatattatttaacacaccttcaaaggtatgtttacgttttactttatcgccacgatcattaacataaacaaattcaatttcgtcttttgaaccgttcagaataatttcacgttgttttttagtcagctctttaaatggcgtatccagtgaaaaatcataatgatccgccaccgatttcaacaaaccgaaatagtaaaagctacggcgatcccaacctttaatcgcaccactcgctaacgagacatccggattctgtaccactttgttcgggtcaaaatactgttctacccctaagccgtcacaggttgggcaagcacccgctgggttattaaatgagaacaaacgaggctctaattcgtgtaacgaatagccgcaatgcggacaagcaaaactagacgaaaagacgatttcgtccgcactcggatcatccatatcagcaataatcgcagtcgaaccggataaatccaatgccgtttcaaacgattccgctaaacgtgttgtaatatcacttctcactttaaagcgatcgaccaccacttcaattgtgtgctttttctgtaattccaatgccggcggatcagataaatcacagatttcgccgtcaattctggctcggatatagccggaagcggtcaaattttccaataattttacgtgttcgcctttacgatctttgaccaccggtgcaagtaacatcaaacgcttgccttccggctcttccattactctatccaccatttgcgaaatggtttgtgccgccaacggtaaatcgtgatccggacaacgaggctcgcccactcgggcaaataatagacgtaaatagtcgtggatttcagttaccgtccccaccgtggaacgagggttatgcgaagtggatttttgctcaatagaaattgccggtgaaagcccttcaatatggtcaacatctggtttttccatcaatgaaaggaattggcgtgcataagcagaaagggattcgacataacggcgttgcccttccgcatacagcgtatcaaaagctaaagaagacttacccgatccggataagccggtaattacaataaatttatctcgagggagaattaagttgatatttttaaggttgtgggttctcgcaccacgaacatcaatgtactgcataatcggttgctctcactaaaaaatgttttttattatcgcatattttaaagtaactgtacaaaatatcagttttaatgcgtgcatttttttgaatttcaggtagaatgtcgcacaaaatttcaaagcacttaattaattcacagaggattttatggcaggtattaataaagttatcatcgtgggcaatttaggtaacgatcctgaaatgcgcaccatgccaaacggcgaagcggttgcaaatattagcgtagcaaccagtgaaagttggacagataaaaatacgggcgaacgccgtgaagtaaccgaatggcaccgtatcgtattctaccgtcgccaagcggaagttgccggtcaatacttacgtaaaggctcacaagtttatgttgaaggccgtttaaaaacacgtaaatggcaagaccaaaacggtcaagatcgttacaccaccgaaatccaaggtgacgttttacaaatgttaggcggacgtaaccaaggcggcgatttcggcggcaaccaaggcggttggggaaattcagcacctgcaccacaacaaagttacaaccaaggtaacagcggttacggttatgaccaaacagcaagccgccctgctcaacaagctgcaaaaccagctcaagcagaaccaccaatggataacttcgacgacgatatcccgttctaaacagtgtaaatcaatatcaatataataaatacaaagagaagttctcatcttaatatgaaagatagaagaacttctctttttttaaatacatttccttaaaaccagaattaaatttcttcaatatcttcaaactcatttacaaatctaaatttatagatataatatccctatcaaattttggagcgaatatggaattagtcgaaatttttaaagtattggcgaatgaacatcgcttgcaaatgttacgttggattaaatcgcctgagcagtattttcgtggggcagaatttactgttgatgcgattgcagctgatggcggcgtgtgtgtgcaggcaatcacgattaagtcaggcttagcgcaatccgtagtatcgggttatttaaatagtttgaaaaaagctgggctagtggaaatgagtcgttctggaaagtggacatactaccactacaatgctgagaaaatcgagcaatttctaactactcttcgtattgagatttaactgaaaacgccgtcatttggcgttttttaaagcaaaaacatatctacatttttagatttaagaaaataaggatttattatgaaaattgaaatttggtctgattatgcctgcccgttttgctatgtaggtaaacgccatttggaagcagcattgagccagtttgcccacgctaaacaggtacaaattgtgcataaagtctttgagctagacccaaccgcgtcaaatgatgttactactacaacacagcagcgtattgaacgtaaatacggtagaacatctgcagatgcgaaagcatttatccgtcaagtagaagccacagcgcaaaaggctggtttagagatgaaatatgaaacagtgcaaaacaccaacacttttgatgcacaccgtttaaccaaattagcagaaagtttaggcaaaggtgatgcaatgaatgagcgtttaatgcacgcttatttcaccgaaaatctcgctcttacagagcgtaaaaatttagttaaatgtggcgaagatgttggcattagccgtgaattgatagaaaaattattggactctgaccaattcgccagcgaagctcgccaagacgaacaagaagcccgtcaaattggcattcaagctgtaccgttttttgtgattgatggcaaatttggcctatcaggcgcacaacctacagattatatgttgcaagccctaaatcaagcatggaacgaacaaacagaacttgaaatcaccacaggaatggcatgcggtattgatgggtgtaactgatggcggacattcttattccacataatgaaccacttatcataccgtctggaaaaaatcctgaaaattccaccgcttgcgtgattttcttacacggtttaaccactagtggtttgcaattccgccctattgctgaatatttagcagaatcattaccgaacgtaaaattcgtcttgccctctgcaccagtacgttttatcagatgggcgaacgctcccgtttcgggctggtacgatttactaggcgataattttctgattgaagaagacgagtctggcattcaatgtgcggccaattatgtgcataaattgatcgatgaacaaatcactcaaggcataccaagcgagaagatttttctgagcggtttttcacaaggttgtgctatttcgctactagctggcacaacctattctaaaccgctaggcggtattgttggcttatcaggctatttgccattaacaaaccaatggcaagacaacggatattttacaccgattttatggttacacggaagccaagatccgctaattacgctcacacagattgagcaaggcaagctgatgctggcgaaaaaccgagatttcacattcaaaacttatcctattgaacattttgtagcaatgcctgaaattgatgagatgggaagatggattcgaacaaaactttaacttggagagcaaaaatgacattaaataaaatgatgaaaacccttattgcaaccgcaatgatagcaaactttacccctgttctacacgcagaaacaaccgcacaacctgccgtgaaacaagctgaacagcaagttgctggcttttaccgaatgcaattaggcgatttattggttaccgcattatatgacggtcctgtgaatgtgccacataaatggattcacggtatttcagcagatgaaatgcaagcagtattcgacaaaatgtttttacctcgtactgcagatggtatccaaacagctgttaatgcatttttaatcaagcagccttcaggctataccctcattgatgcaggagctgcaaaatgttatggcgatacgttaggtcatattgttgaaaacttaaaagcatcaggtgttcaaccagaagaagtgaaagatattatagtaacacatttacattctgatcatgcctgtggtgtagcaaccactgatggaaaaatggcattcccaaatgcaacactttatgcaccgaaaagagattcagatttttggttaagcaaagagattgcagcccaacaaccaaaagaagtacaaattttctttgattcggctcgccaagctgtaacgccttatcaagaggctgggcaatttaagacatttaatgaaggtgaaaaccctattgagggcattgaaactgtacaagaattcggacattcaccaagcatgacaggctatttagttggttcaggcaaagatagattgttagtatggggcgatattattcacagccatacgattcagttaaaaaatcctgaaatttctatggaagtggatagcgatgaaaaagcggcgatcgccacccgtaagcgcattctgaaattagtcagcgaaggtaaattatgggttggggcagcacatatcccattcccagggattggacatattgtgaaagaagaacaagggtattcttgggtgccaatgcaatacttacctttagaaaatcaataagatacaagcggtctttttttgcaaaaaaaaagcaaaattagaccgcttgccataaggagaaaaaatgcaaacacaaaaatccattgcatggtttatttttgcaggactgtcagcaagtttgatttctatcggcttggcacgttttgcttatacgccactattaccgttgctaattagtgaacaatggttttcagcttcagatgcagcttatttaggtgcggcaaatttagctggatatttgatcggtgcgttatctgggcgaccgatgggaaatgccttttctaacaagcaaacattacgtgtaatgatgctgttagttacactctcattttttgcttgcgccttcccgctttcaactgcttggtatttcgtttggcgattaatttcagggatttcaggtggtgcaattatggtattagttgcggcaactatcacaccccatgtacctgttgaacaccaaaatctcgccagtggtgcaattttcttaggtattgggttaggtattttcgcctctgcaactattgttccaatgttaattaatttagggttaaaagcgacttggtttggcttaggtattttttctactattttgaccgcactgagttggtttaacattcctgatcctgtcataaaaatacaggaaattgcacctgcccaaacatcactaccagcccaaccacatatcctagaacccaaacctgcctttctgattttatatctccaatatggtttgatggctgtatttattgttgcaccagccgtatttattgtggattacattgcacgaggcttacaacttggcgctggcacaggtgcactattttggagcttatatggcattggttcgatgattggtccaccactttatggctatttcgctgataaatttggtgcaaaaccaactttacgcacagtactagcggtcgaatttttagctatttttgcattatgtgccacagaaaatatcattgtaatagcgatacttacggttatcatcggctcatttccaccaggaatcgtgccattaatgcttgctctcatttttgaaatgacctcctgcccacggttacgcaatgtaaactggagtaaagctaccgttttctttgcctctgctcaagcattagctggttatggtttatccgcagtatttagcgccacccacaatgaccatcgaattttgttcattattggtggtatagcattagccatttcactaagtatggactggctatttcaaaagacagaataatttatttaggggctgtcctagataactgacaaatttcctatttaggatacaatatcccaatgagaaaaagtcgtctaagtcagcataaacaaaataaactcattgagctatttgtcgcaggagttactgcacgaacagctgctgaattagttaatgtaaacaaaactactgccgcatactattttcatcgcttacgattacttatctatcaaaacagcctgcatttggaaatgtttgacggcgaaatcgaagcagatgaaatctactttggtggcactcgtaaaggtaaacgtgggcgaggggcagctggcaaagtcgctgtattcgggcttcttaaacgtaatggcaaggtttataccgttgccgtaccgaatacgcaatcagcgacattactcccgattattcgagagcaagtgaagccagacagcattgtttacaccgatacttatcgtagttatgatgtacttgatgtcagtgaatttagtcatttccgtattaatcacagcacacgttttgcaactaatcataaccacattaacggaattgagaatttttggaaccaagcaaaacgccatctacgcaaatttaatggcattcccaaagcatattttgagctctatttaaaggaatgtgaatggcgttttaattacagtgacataaagtctcaaatttccattttaaaacaattggttagaggaagtttgctctagttatctaggacagcccctttatctataaataaaataccgtctggatatcactttcagacggcattttttaatcccaatgaaacaccactttcaaacctgttgcatctgcaaagttttgaatggctcggcggcgatcttttgttgataaatgggaataaagataaatatcctcttcaagctgagtcgtatatttcattccatttggtctaaaacttggcgcattcccaatacaatgagacgctgttggttttccatttaaacaaaaatcctccactaaagaacgatatttaggctgttttaataaaaataaaaagaaatttttctgattatctcggtagcttttccctgaaatcttatgtccgtctaactcaatataaatttgatcagttggattttcttcttcagtaacataactttcaaagatattaatatgcgcaacttcatctaaaatttcttgagcaatattccaaacattgtcagctttgatcttactcgttttttcaataaaagaggtattacccgaagtggcattatctaacgttaaattggttttctgaaaagcctcaattaatttcttctcaaggtaatctgtttgcgatttatccaaatgtccatcttctcgcccaaagaaaataatcttactccaccaatttttactatcattatgcgtaattaggcgatcataaatttttccgctcgcctgcccgacataacgctgattctcgcctaataaaatataaattccggctctattcgcttcttccaaatgttttaatgcttttaaatcttcacgatccgcaatcgctaaaaacacaggttctttggtataaactgtgatgttgtcttttgccctatcgctaataataacggtatgggtaaccataaattttcctcttatctcatcgatattaccgtatccattttaacctaatcgctcgaataaaaattcacttagcacattaattttcatcatttggcggttatttggggtgtaaaccaaataaatgccgtcattttctgcggtatccgtgggcgtaatttgccaatttgcaaaaatttgcactaatttgcccgcttgtaggtggcgttcaaccaaccaatcgggcaaatgggtaatgccctgcccatctaggcaggcttgaagcaacatttcggcgttattgcccgacaaattgcccttcgcccaaatgctttccattttctcgccttgcttgaaataccattttgctgccaagccacgataagtaaacggtaagcagttaagtgcggtcaaatcttgcggagtttcaggcgtgccatgctgttgtaaataagctgggcttgccactaacaaacgctgttgcggggcgagttttttggcgatcaagcggtcatcattgatttgccccaaacgaatcgctaaatcaatcggctgactgaacagatcgacaaaatcatcagagctaattaattccaactcaatttttggataacgagtcgcaaactctgccaacagcaacgagagtttacaagcgccataagtattggggaacgtaatgcggagcttgccctgcggttcaagcacttcgtcttttagttgctgattgacctgctgtaaatcgtccaaaattgatttcgtctgctgttggtaacgaatccctgctgcggtgagtgataatttgcgggtggagcgattaagcaacgcaatgccaagcgattgttctaaattgtcgatttggcgtgtaaccgatgacaccgccaccccaagctgtttcgctgttgccgtaaaactagtggtttcacaaaccgaatgaaaaatttgcagtgctgaaaaatagtccatagtcatccttgcgtttaacgcaaaattaaattgctttttcgctatattatcattttttataaaaaacctataatgcagacatcgcaacgcaatgcgaaaattttttgattcactcaaataaggatagcaaatgaaaattaaatcattagcgacagcaattttattaggtttaggtatttcagcaggggcgaatgctcacgaatctcacgccgctttcacgccaaaagcgaacgttgtaaaacctgttttacaacaagttgatggctactaccgctttatgttaggcgattttgaagttactgctatttatgacggttatttagatattggtaatgacatttatgcgaaatttactaatttaagcaaagaagaattaaataaactaatcgaaaacgagttccgtcctttaacggaaacaggtggcgtgaacactgcagtaagtgcttatttaatcaacacaggtaaaaacttaattttagtcgatgctggctctggcgatgtatttggcgataaagtgggctttgtggaagcaaacttgaaaaaagcaggttacaaacctgaacaagtggacattattttgcctacgcacttgcatttcgaccatttcagcggtgtaactcgtaatggcaaagcggtgttcccgaatgcaactatctatatttcaaaccaagaaaaagcgttctggaatgacacaccgatcgagaaaatcccagctcacgttcagcaatatgtgcaatggacaaaagatgcggttgcaccttatgaaaaagcgggcaaagtgttctattacgactcaggtgtagaagtgattccaggcgtgaaaagcgtgaaatctttcggtcatacaccagggcacgcaggctttgaatttgaatcaaaaggcgaaaaattattcgtttggggcgatttactacataatcacgctttccaattagccgtgccagaagtggcggcagaatttgacgtgaatgccgaaggtgcgagagaagctcgtcttcgtttattacctgaactagcgaaaaacaaaacgtggattgcaggagcgcacttgccattccctggaatcggtcatatccgtgctgaggaaaaaggcggctattcttgggtgcctgtggaatacacaccaattgaagtgaaaaaataacgatttttcataatgctcacctgtgagcaacctttcaagcggtcattttttgcaaaaattttgcagaatttgaccgctttattgtaggcaaataccagcaacctttgcatttaacgcaaaactatttagccttttaggcttattatcatttttacgcaaaaatatataatgcacacataaatacgaaacaaattaaaggatcaaaaaatgacaaaacaaattcaatttaatcaaactggctcggctgacgtattacaaattgttgatgtgcaagtggccgcaccgaaatctcacgaagtacaaattcaaatgcaggcgttaggcttaaaccgtgcggaaatgatgtatcgtgaaggggcgtatgtgattgaacctgttttccctgcgacaatgggttacgaaggtgcaggcgtggtaacagcggttggtgcggacgtgagcgagttcagcgttggcgacaaagtgagcgtaattccatcatttatgtttaccgaatacggcacttatggtgagctcgtgaatatgcctgttcacgcagtggtaaaacaccctgaaaacctcacaatggaacaagctgcggcaagctggatgatgtttgtcacggcgtatggcggtttaattgaatttggcaacctacaaaaaggggattttgtggtattaggcggagcgaccagctcagtagggcttgcggcaattcaaatcgctaaaatgcaaggtgcaaccgtgatcgccctttctcgcacccacaccaaaggcgatgtattactagaaaaaggtgctgattttgtgatcgctaccaaagaagatgacgttacggctaaattactagaaattacaaacggcaaaggcgtgaatttggtgttcgaccctgtgggtggtaaagaagcagcaaaaattatcaatgcaatggcgcaagacggcaaatacattatctacggtgcattaagccacgatgacatctctgtgccagtgttcccaattttaggcaaacatttaaccgtgcgtggctatgaattatttgaaatcaccaccgtgccagaaaaactcgcccaagcgaaaaaattcgtatttgacggcttagcaagcggtcaattaaagcctgaaattgacaaagtgtttgcttttgatgatatagcggaagcccaccgttatatggaaagcaatgcacagattgggaagattttagtgaagttgtaaggagagatgccgtctggaagtaggtttcagacggcgtttattaactatgggtcatttgagaaaatggaacgtaaattctgccttctctagctgcaatttgcttttttctattaattagttcaatgaacgaaattctttcttctaagacagccataagatcagaaccatccataagaatcattactttatctgaagattgagatgctgctacaccatcttctgaaaatccatcaatggatagaaataatcctagagtattttccaacttagattttactttttctttaaaaatagctaaatctgaattattaattggaggtttaacccattttgcttcgaaaagaaactctatcccatctaaagtaaatgccccatctatttgttgtccgataattttgaatgctgctttaggatctaaatcgtttaatgtgaaaagcttattcatcaaattttctaacttaaagcctctttgctggctatcttgactggttgctagagaaataaactcttgcttcaaagcacataattcttcctggtaacttttaaatgatttctgtttttcttcagctgctttttttcgttgttttcttaatacttcctcttgttgtatttcctgataaggaatcataaattgttttaaatgatttactgcgtttttagctaaacgtattttattttctgaatcctcaagatgcgctaaatgctcaaaagtattaaattgacaaatattttctgctagttgcagtaaaatttgtgtgtgctgtttttgagctaatttatcaacaatagctgtaataatctctcgtttcgtaagctcccaattaatatgagaaatctgaatattttcaggtaagctatttaataaaaatgatttaagatcctttttaaaccaataaatatgggtaagagcatcttttaaagcgactaaggcagctggtgttaattgtttactcatatataattctttatcctattctaagaaaccattacatctacgtgataatattattatatcccatacaacggcacattcaccacccaatcctgttccctaaaatctgccattgaaaaccgtatcgcctgctcgggctggaactgttccacatatacttttaaactttttgcttttaaattttcttcagctttgacttcaatcgggattatggcttgtttgcgttgtacgacaaaatcaacttctgctgtgcctttttcggttgcccaatagaaaactggattttcttgggtggcaataagctgctgtaggacatattgctcggttaaagcgcctttaaattcggtaaaaatacggctaccttcaagcagaacgctgacatctaaatggctttgagcggcaagcaatcctacgtctaatacataaagtttaaatgcgccgtcttgataagcagaaagtggtaaatgtgtttttttcacacgtggcacggaatgcactaaaccactgtctttcagccattgcaaggcaatttcataatctttacttctcgcccctttttgcaggtgtgagtagatgaactttttgttttctttggcaagctgttcaggaattgaagcccaaattaaccgcactttttgcactgtctgcccatctttgatatgtttagaaaaatcctgttcatacgccatcaataaattgcgttgcacttggcggacttcatcaaagttttgcgtttctacaaagactttcacggcttcaggcattccacccacaaaataatattggcgcagcaaatcaatatagctcgttttcatcgcagaaataagcgaccaatctttgagttccaatagttgtactaaatcttgcttaccaagtgcggtcaaaaactcatgaaaatccatcgggtaaagcggtaaaaaatctaccttgcccacaggaaaagaaacctgatgatgtaatgacacaccaagtaatgatcctgccgccacaatataaaattgcggtgcattttcataaaaatatttgagcgaagatagtgcctgcggtacttcttgtacttcatcaaaaataatcagcgtattttcagcttgaatatctacaccactttcaatttttaaaccaagaatcaagcggttaatatcataatctcccgaaaatagcgttttcattcgtggattattatcgaagttaatgtacgccaccttttcaaaagattgctcaccaaaacgcttcatcgcccacgttttacccacttgtcttgccccttgaataattaaaggcttgcggttaggtttctgtttccatttttctaaggattgaattatttttctttgcataatttgctcattttctattctttggaaactattttaaggataattaaacattttttcaaaggaaaatctgtaataaaaatacattttttccaatgaaaaaatgttaataatatacactttttcaaaggaaaaattgaaaatattaaaaatctaatgcatcaaataaacaggaaatctacgtttaccactatcttttgaaagagtgaatacatgaatatctctcctctcttcctatggattctggaacaatccttctgcggtctctctcccgtaaacgtgaaatggttaatctttacagcatttttctctttctattaaaaacctctcacaaaaccctaaaaaggttttcatgattgctgaggggtggcggtgagcgggatagatggcgtgaataggataggttggtgccggatagtcggacatcagttcgactaagccgaatttctcggtgagttcttgagccatatagtctggtaattggcagatggcgtgcgcatttttggcttggtgggcgatggcatacacgtcattagaggtaaaaatcggttcaattttgaccgcttgttcgcccagttgtaatgttgcacttttttgccctgctcttgcccagcaggcaaatggtagtgcagtcaaatcttgcggtgttttcggcgtgccgtatcgagcaagaaaatcagggtgagccaccagcactgcatttaaatccatcattttgcgagcaataacattttccgtatgcagatcgcccattcgaaacgcgatatcaatgccatcttccaccaaatccaatacgcgatcggtcgcctgacaatgcactttcacctgcggatattctgcctgaaattcagcaattgccgcccaaatcggctcacaggcggaaacggtggaaatacgcagataaccgctcaattcctgctgttcaccaataaaatcctgtgtcgcttgcgttaaattgtctaagctcaaataaaccttttcatacagttgcaaaccaagtgcggtcggtttcacccctgttttgtagcgatcaaagagttgggtggaaagcgatttttcaaattccgcaatacggcgactaaccgtcgcaactgggattgcaagttgttccgctgctttagaaaagctctccgcttgataaactgccacaaacagtcttagattatttaaatccattttatcttctcatttttgaaaatcttattcttattttagatgcttctcaaccaattttgcaagattataatagctaccattcattcgcaaaaaaggacaaaaaaatgaccgcttgtaaccgtattactgacattttaggtatcaaatttccacttgtgcaaggcccgatggcgtggatgacagacgcaaaatttgttgctgctgtaagcaatgccggaggtttggggattttaggcccgaatgccggcttgcagaaagcgccgaaaaccaccgaagatttgctccacactttccgtgaagaaatccgtaaaaccaaagcattaactgataagccattcggtgcaccggtgattttatcctacgatttcagtacgattgatttgttagtggatttattaattgaagaacaagtgccggtggcattaatcaacggtattgatggctatgattacaagccgatgatgaaaaaatttaaagcagcaggcacaaaaaccattttccgtccgcatacgcctacagtagaaaatgcacgctatgcggaagaaatcggggcggatattttcgtcgcaactggttttgatgaaggtggcactgtaccgaaccaagtgatcggaacattctctatcgtgcctcaaatggtcgatgcagtaagtattccggtgatggcagctggcggtattgctgatgtgcgaggcgtacgagcaagttttgcactcggtgcggaaggcgtatttgtcggttccgtattgttagcaaccgaagaaaatcgtatgcatgaaagcgttaagcaactcgttgtcgatagcaccgctcaagatttattgttattccgtacccaaccggcatattaccgttcgctaccaactcaattagcacataaattggtagaaatggatgaaaacggtgcaacacgagatgaactcgccgaaacgcaaaccggtggttacggaatgcgccaaggtatgttacttggcgattttgagaaaggctatatttcggtaggtaacggtattacttatattaaatcgatccgctctgtcaaagatatagtggaagatttaatgcaggattttgtataacaacatcttacaatcaataaaaaccttgagcttttttgttgatagtctcatattaaaatagcctagaataaatataatttaagttttttcttgacaaaaaatcaccaatattgtagcataacattcaattcagtttggtagttatgctacatttcaatttagtgaatcctcactatcttatattatccttttctaataggataattttcaaaatcccctatcttgtagggtatcaataaatcaatttctttttatatggtacttttttgttattttaaacttcagaaatagagaaaagtgcggtcttattttagctaaaaatggagcataagatgagtttcattcaagaacttcgtgcatcaagcacactaaaagccccgatttttgtgccgacggtgttttttgtcgctttagtggcgcttttttgttcggcttttcctgagcaggcacaaaccactttaaatgcagcaaagcaggcagtatttaccaactttagttggttctacattctggcaggttctattttcttcctgtttttgatgtttttgtgtgtcagttcactaggtagtattcgtcttggtgcagacactgatgaaccggaatattcctttatgtcttggatggcgatgctctttgctgctggtatggggatcggtttaatgtacttcggtgttgcggaacctttctcgcattacttaaaacctgtacaagaggggttaagtgaatctgaacgtatgaaagaagcgatgatgaccacgttctatcactggggaattcacgcttgggcaatttatgcagtcattgcattagcattagcttatttcggttttcgttataaattgcctcttaccgtacgttcaggtttttatccattactgaaaaatcgcattgccggtttttggggaaatttaattgatgtcgtagcattatgtagcacgatctttggtttaaccaccaccttaggctatggtgctatgcaggtgaatgccggttttaaattccttggtgtgttagatagcagcagttttggcgtattagccattaccgtcattattgcaatggctcttgctgtaacctctgcgatttccggtgtgggcaaaggcgtgaaaattctaagtgaaaccaacttagtgattgccagtttattgctgatcttcgtcattgttgcaggccctaccttattactcttttcaggacttaccgaaaacctaggttattactttagttcacttttagaacttagtttccgcacttttgcttatgaatctgaaaaacaggattggttaagtaattggactgttgtgtattgggcatggtgggcatcttgggcaccttttgttgggacgtttatagctaaaatttctaaaggacgtaccatccgtgaatttattttaggtgtactttttgtgccttctctgttcaatattttatggatgaccagttttggaagtgctgcaatttgggttgatcaacaaacaggcggcgcattaacggctatcagtgacagtacggaagccttattattcggtttctttgatcaattaccctttggcatgattgcatcaacagctgcggttattgtcatttcaattttctttgtaacttctgccgactcaggcatttttgttctaaataatatcgcctcacaaggcgctgaagactcgccaaaatggcaaagtgtattctggggtgtattactcgctgtgcttggtttatcgctgttatattctggtggtttaggctcgttacaaacgatgaccttaattatcgccttaccgtttatggcaattatgattgtgctatgtttcggtttatggaaaggtttaatggtagatagccaatactctagcaaaaaattcacccaaggcagcggtaactggacgggcgaaaattggaaagaacgtttagaaaaaatcgttaacccaaccaatcgcaaagatattcgtcagttcctattaaaaaccgcacgccctgcgtttaaagaattagttgaagaatttgaaggacacggtttaaccgcacaaatgcgttttattgacggtaaaaatccgaaaattgaatttgaagtggtaaaagaaaacctccgtaacttcttatacggtattgagtgtcaatctcgtgaattatcggatttagtggtggaagacagcaacgtgccgaatatggatgaaagtaagatttacgaaccgattacttacttctttgacggtcgtaacggttatgatgtgcaatatatgaccaaagatgagttgattgcagacgtattaaaacaatacgaacgctttatgaacttggccatggacgaaagccacgccttgatgacggctgatgtggaaaatatgactgaaactgcattaaatgaggaagagaagacagaataattatttgtaaggcgggtatcgtacccgcctctagattccaatttataacaaaaatttaggagctattttgcaaacaaccaaattttattcgctcttttccggtatctttttcctctttttcggctatgggttattcttaaactccgctggtgtaaaacttgctgaaatgggcgttagcgatgtcgtgatcggtttacttaacgcagcgttttttgtaggtgcagcacttagcgctattcttgcccaccgtattgtatccagtgtgggacacatccgttcgtttagtgtatttggtgcaatctttgctattgctgcacttagccatatgatgattgataacctatgggtgtggggcgtactgcgaattattttaggcttctgtcattacagcttattgttattagtagaaagctggttaagcgagaaaaccaatgtggatacccgaggcaaagcattggcaacctataatattattttctatcttgcctttattttaggggtgagcttactcagtctggaattaaccagtaacaatatttttacgctcgctacgattttagtagtgatgtcgatgattccgattgccttaacgaaaatgacccaaccggagattcccgctcgagaacgaatcagcgtaccgcgtttattagccatttcgccccttgcgttagcgacaagttttattagcgggatgttggtaaacggctttttcactatggtttcagtgtttctcttaaagctagatttttcattaggcgaaatatcgctatatctgatggcatcgatgattgggggctttatcagccagttgccggtagcaggtttatcggatcgcattggcagacgtaatacaattttaatttgtgcggtaattgctagcttaactgccggttcaggaatatttgcaatttttcaaacaaattcgaccgcttggttacaatatatcatcgcattcatttttggctgtagtctgttcagtctttatgcactaagcattgcccgtgccaatgatgaattaccaagcaatatgaatacggtagaagtcagtcgtggtttgctcttttgctatggtatgggtgcgttaattgccccgctgtttctcggcttcgcaatgggcttatcatcccaatatggtttttacgcattctttggcatcttctcggtgattctcctgctctgcgcacttaaaaccaaaccgattccaaaagcagagcgtgtagatatgcaattaaccacacctattgcgacagcaagtgcggttgaagatatgttagaaagcaatgaagaccttgtgccatttaatgaagaggcggtgcaagaatatcaagcggcctttagtgatgaagaacaaacgaatgccgatcatgaaaatcaagaaacgactgtgcaaacagtggtagaagatgagcagaaaagtgttccataacacttgtatacgactttaaacacaagcggttaaaccttgctcaaaatttgcaaaaaactttcaaaatatgaccgcttgtgtgtaaggcgggaataatcgcttgccttaacataaaaattacctataataggaagccttgcatatcgctagaaaagatatgtaatccgatggggcgttattggttcctcgcaacggtgttcagcttacttagtcaggttcggaagaaagcagcttgggttgaaatttctgtgtgccgagggttgctggtaatgccccacccttttctatcctccccaaaatcattcttatttctctattacattttcactctatgccaaataacaagcggttaaattccacttaaaatttaccttgtgcaaatttattgtaaaatttaaccgcttgttacaactttttgtaatattaacttagcgctactctttttccggttttggtaatttgtatagctgattcttatataaatagctgccgagcaacgcatacgctaacgcttcttttttcatggcttccggctgttcttgtgctttcaaactgtgatccgctttattataaacaaaaccttgaatcggtgtatttgggcgcattaccaccacagaaccatcatctttcatcatcgcttgtgttgcatcatattgcataaaggcacgattcggatttacatctttagttaaatcataaccgagcataggatatgctccacttatacctgcaagtgaaagtaaagttgccggcatatcaatttggctaactaaacggctatcacgttttgcttcaatgccctcaccgataaacaatgccggaatatggaaatgttgaatcggcactaaatgttcgcctaccgctcgagaatcgtgatcagcaatcaccaagaaaatcgtatcctgccaatacgctgattttttggctaactcaaagaaatgcccaatcgcaaaatcagcatattttgccgcattatttcgagtttgtttcggctgttcatataattcgattttaccgtccggaaattcaaacggatcatgattacttgaactaaatactaaactgaaaaacggtttgccttctttgtgtaactgagtgaacgtttcatttgctttatcaaacagatcttcgtcactcatgccccaagtggctttaaacttcggatttttataatctttttcatcaataatacgggtaaagccattgccatagaaaaagctcgccatattgtcgaaatgtttttcgccgccgtagataaagctagtatcataaccttgacggcgtaacagctcggcaatgctaaagaaattatgctgactcttggtcaatttcaccaccgcacgtgccggtgtcggagtaaagccggtagtaaccgcttcaatacctcgcacagaacgagttcctgtggcatataaattctcaaataaccagccttcttttgccaagcggtcaaaatttggggtaagcggtttaccgccaagcgttccgacaaactgagcgcctaaactttcttctaagacaattacgatattttttggcttgccttgataggttgcttggttataggtcaatgtcgggatttcagttgaaatatagtcagactctgctctgcctcgcgcttgtttaactaaagcaaacatttcctccaccgacattttgccatactgttccgcagatttatcctcatcttttaattgttgtaccgcatacagtaccgaataaccggagctcaataccagtgaattaactaacggatcgcttgaaaatgcgaccattgccggatttatacctcggtgagcaaccgaagaacgtccgcctacaaccactaaagccgcaaccagtaagccgattaacgggcggaatttccaattcggaaaacgaagattgttagtcgcccaaccagacaatttccaatacaccactaacgaaatcgccgccaataatgagctaataattaccgaagccaaatgcccgttaatcagcatactaaacacttctttcgggtgtactaagtattcgataaacagtcggtttggacgtaaatcaaaagtttcaataaagtttggcgtcgccgcttccataaacagaataaaaaccgaaccggcggtgagccaaatacgcaaaataacacgccatattgcgcctaatttattgtgatttaagaaaagtgcagtaaataatgcgggaacgccgaatagccaacaaagagcggaaatatcaatgcgaatgccttgtaagaaaagcggtaaccagccatcaacggcggtaactcgttcagattgccataggctaagccctaggcgagataaagacagtatgagtagattgatcccaacaaaaaacagtattgggaacaacacagaacggcgttgttccataatttctccttttaaatttaaaataaagcacataccgataatcggctgcgcgcataatatcgaatgattattaagattttattaagacttggtcgcctaagcgaattacaccgctattttgaggtactaaatgaataccaaaaaccggcttacctttttcattggtatgcatttgtttaagtgttcggaaaggctcaacattcgggtcaagttcaagtgtggttaaatcacgggtaatcattacacagcgtgtgcataatgcagacttggtgaataagacctcgccgatttgtacttgttcccattgctcctcttcaaacgcctgatttccgtccaccacaatattcggacgaaaacgatccattgaaatctcaatcggtgaccactgtttaacttgctcaaatgatttttccgacatgagtgaaaccggattgctatcggcaaaacttaacggatgttgagaaaagttcgctacttcacgatggctcttgcctcctaaccaccgtagttgtacttctcgcccgaaaatttcgcttagccattgatttacttctgtttttgccactaaagagtcaaaatgagtcccccaaacttcgctcgtctgaacgtactgaaaatcttggtaaagcaccacgcatttttgaccgcttgtatggcaaatgacgatccccatcgcaatcggaaacacagctaaattgtataattccgcatctttacgagcagtcataaacttgccgtctatttcggtaatcataaattcccgatcaaagttcagtcctttaagctcaacaaaggcttgttcgacacgataagctgccgttgatttaatcgggtaaagattaagttgtgtcactttcattggtaaaaattcctgtaaatttaaccgcttgctaaaatacgttcgcaccatacccaaaagcggtgaaaaagtaaaaggaatttgcaaataaagaagggagacgataaacttacaccatttatcgccctaaattaggtaattgaaatggctaaaaaacccacccaagattttgaatcaaccttaaaagaattagaagcaattgtcagccacttagaaacgggcgagttgcctttagaagaagcactcaatgaatttgaaactgcggtaaaacttgtacagcaaggacaagaacgcttacaaaaagcggaacaacgcattcaaatcttactcaataaaaacgaacaagccgaactttctgattacgaataaaaataacaatgagctactctctctcaactgatcttaccgctattcagcaacgtattaatgatttcttaagtgtaaaattacacactcatcaggcttatgattcaccacttgttgatgcaatgtcttacgccgtattgctgggtggaaagcgtgttcgtcccttcctgatttatgctaccggcagaatgctcggcgtatcgcttgaacagcttgatcacagtgccgctgcaatggaagcgatccacgcttattcattagtacatgatgatttaccggcaatggatgacgataaacttcgccgaggtaaaccgacttgtcatatcgcttttgatgaagcaaccgcaattcttgccggcgatgcgttacaaagttttgcctttgaactgatcgcccaagacgagtcattaaccgattcgcaaaaagtttggcaaattcaagcgcttgctcaagctgctggtgcgagaggaatgtgtttagggcaaagtttagatttacttgctgaagataaagcagtgaatttagcagagctagaattaattcatcgtaataaaaccggtgcattgatcgttgcttccgtattgatgggctttaatttatccgctcattcgcaaaatttagcggtaaaacaaccgcttgaacgctatgcgcaagcaatcggattggcgttccaagtgcaagacgatattttagatgtgattggcgaaaccgataaaatcggtaaaaccgtaggctcggatgaaaacttgcataaaagtacttatccaaaactacttggtttagaaggcgcacaaaagaaagcacaggacttatatcaaactgcattaaatgcgcttgaggaattaccgttcgatacctcagccctcaaagaattagcgcattttattgttaaacgtgaaagttaatttgcaaaaaacggtgcggtttcaaccgcttgtttcagataaaaggcgaggtacttcccgccttttttattaatactcacttttggaaagcgaaataaaccgcccctaagatgcagataaaacttaataaataatttaatttaaacccttcatttaagtacactaccgcaaaaactgaaaataccactaacgcaatcacttcttgtataatctttaactggaacggtttaatttgccattgtgcgcctaaattattcgctggcacagcaaggcaatattcaaaaaaggcaattccccagctaatcaatacaatttgccataacggtaatggcgtcgctgacggtttaatatgccaataccaagcaaatgtcattaaggtattagaaagcgttaaaagagaaattacaattaaccaactcattatttttccttctcaacttgcaaaattttagcgatttttaaccgcttgtaagatcaaaaaagcacactcgagagtgtgctttttttcgtatcaattcagattatttctggcgcattgcagggaataagatcacatcacgaattgacggtgcgtttgcaaaaatcattgctaaacggtcgatacctaaaccttcaccagctgtcggcggtaagccgtgctctaatgctaccacgaagtcttcatctttaaacattgcttcgtcatcgcccgcatctttcgctgcaacctgagcatcaaagcgttctgcttggtcttccgcatcattcagttctgagaaaccgttaccgatttcacgaccaccgataaataactcaaagcgatctgttacttctggattttcatcattacggcgtgcaagcggtgaaatttccgctgggtgtgccattaagaaagtcggttgaattaattggtgttccgcaacttcttcgaaaatggcatttactactgagcctaagccccaagatttttggatttcaatacctaaacctttagcaatttctactgatttttcgaagctatctaaatcctcacgtgtaatgccgttaccgtattttacgatcgcatcgtgcatggtgatacgctcgaatggtttaccgaaatcgaacacgtattcaccgtaaggaacggttgtcgtgccaagaatatcaatcgctaatttacgtaataattcttcggtgttatccattaaatcgtggtaatccgcatacgcttgatagtattcgatcatggtgaattcagggttatgacgcactgaaacaccttcgttacggaagttacggtttaattcgaatacacgctcaaaaccaccaactactaaacgttttaagtaaagctcaggcgcaatacgtaaatacatatctacgtctaacgcattgtggtgagtgataaacggttttgctgccgcaccgcccggaatcacttgtaacattggtgtttcaacttcaataaagtctttctctaagaagaattgacgaatgcctgaaaccacttttgaacgaatcataaacgtacggcgagattcttcattagaaattaagtctaaataacgttgacgataacgtgtttcttggtcggttaaaccttgtactttgtttggtaacggacgaagtgatttagttaataactctacttctgaacaacgaacggttaattcacctgttttcgttttgaaaagcgtaccggcaacaccaacgatatcgcctaaatcccacatactgactttatccgcatacacgccttcagcaaggttatcacgtgcaacataaagctggatttgaccgcttacatcttgaatggtaaagaaagacgctttacccattacacgtttaagcataatacggccggcaactttcacttgaatatcttgttcttttaacgcttcaccctctacttcatcgtattgtgcgtgtaatttttctgcataagcatcacgacggaaagtattcgggaacggattaccttgttcacgtaattttgctaatttctcacggcgagctaacatttcaccattaagatctaattcttggttttcaacttcagacattttttaaccttttgcttgataaattcgaaaaatgaaagcaattataagcgattttacagatttttggtaggaaacaagcggtcggattttaggaaaaatttgcaaaactttcacaaaatccgaccgcttgtcgattacatgacaacaacatcaaattgatcttgatgatagtaaggttctaatttgatttcgactttcttgccgataaaggcttctaactcagcaatcgaagcgtgcgtttcttcattaattaaatattccgccacttcttttgatgcataaacgcgcactttctcggttttaaacaagtgatgaacacgcacaatctcacgcagaatttcataacaaacggtttcaaccgttttaatcgtgccgcgccctttacacgctggacaatcacagcaaagcactcgctctaaactttcacgagtacgtttacgggtcatttcgaccaagcccagttgggtaaagccgttcacattggttttaactcggtcgccttttaacgcttcttgtaatgactgcaacacacgctcacgatgctcttcttcttgcatatcaataaaatcaataatgataatgccacctaaattacgcaactgtaactgatgtgcaatcgcttgggtcgcttcaatattggtattaaaaatcgtatgcgctaaattacgatgaccgacaaacgcaccggtattaatatcaatcgtagtcatcgcttcggtttgttcaataattaaataaccgcctgattttaaatccactcgtttatccaacgctttttgaatcgcttcttccacaccgtaagcgtcaaataacgtttggctaccgctatataaactcacgttttcggtcagttccggcataaactccgctaaaaactctttaacttgttcataagtcattttcgagtcaatgcgaatcgaactgatatgtgtaccaacaaaatcacgcaagactcgttgtgctagagccaactcaccatataacattgatttaacaggatattttgcttttcgctctaaaattttacgccataaacgtttcaagaaaatcgtatcttgttgcaaactttcttccgaaacttcttccgccgctgtgcgtacaataaagccgccaagttcatcgcaataaggctcaaccaacgcttttaagcgattacgttcttcctcgctttcgatacgttgcgaaacgcccacgtggctattttccggcataaataccaaatagcgagaaggcaaagtaatatcggtggttaaacgcgcccctttggtactaatcgggtctttcaccacttgtacgataatatcctgcccttcacgcactagctctgcaatatcttttacgacaaactgtttcttctcgttttcatcgacacattcagtatgcgaaacaatatcggaagcatgtaaaaatgccgctttttccaagccgatatccacaaatgccgactgcatccccggcaacactcgtgtcacacgccctttataaatattaccgacaatccctcgtttcgcttcacgctcaatatgaagctcttttagcaatccgttctcaactaacgccacccgagtctcactcggcgtcacgtttactaataattctgcaccgctcattgttgtttttctctaagtcgttaaatcatattcactaaagtttaacattgacgaagtaagaaaacaaaaaccaagatcaaataagtggtggattttgacattcacttcaattgaatgctttcacttacattacatattcaatctaactaatagctaggtagctcgtgggggagaaatttcacaaaaaatttacttatctgtggggatttttgctaaaatgttgcggtttttttacgacaagtcaaaggtattacaatgtcagaacaaacttttattaccggtaaagatgctgcgcttgaggacagtatttctacctttcaacataaattaaaaactttagggtttaacattgaagaagcgtcttggttaaatcctgtaccgaatgtgtggtcggtgcatattcgtgatgcggattgtccgcagtgtttctcaaatggtaaaggcgcaagcaaaaaagcagcgcttgcttcggcattaggtgaatatttcgagcgtttatcaaccaactatttctgggcagatttttatttaggtcaagaaattgcgaatagtgaatttgtgcattatccgactgagaaatggttcccaatcgaagatgatgagcaattaccggaaggtattttggatgatttcttatttgattacttcgatccgaatggcgagttaaccccgaatttattaattgatttgcaatcaggtaactacgatcgtggtatcgttgcgttgccttatactcgtcaatcggataaccaaaccgtgtatattccgcaaagcattatcggcaacttatttgtttcaaacggtatgtcggctggtaatacgaaaaacgaagcgcgtgtacaaggtttgtcggaagtgttcgagcgttttgtcaaaaaccgtattatcacagaagcaatcagcttaccagaaattccgcaaagcgtgattgacggctatccgacaatcaaagcatctatcgaaaaacttgagcaagaaggtttcccgattttatgctatgacgcatcattaggcggtgaattccctgttatttgtgtgatcttgttaaatccgaataatggaacttgtttcgcttcattcggtgcgcacccgaatttccaagtggcgtttgaacgtacggtaaccgagttattacaaggtcggagcttaaaagatttagatgtgtttgctccgccttcatttaataatgaagatgtggcggatcacgctaaccttgaaacgcactttattgattcaagcggtctgatttcgtgggatcttttcaagaaagatgccgattatgaattcgttcactgggatttctcaggtacaaccgagcaagaatttaccaatatgatggcaatctttaataagcacgagcaacctgtttatattatggattatgaacatttaggtgtgtacgcttgccgtattcttgcgccaggtatgtcgaacatctatccaagtgacgatttagtttatgcgaataacaatatgggcatggattggcgtgaaatcttgttagatctgccacatttccatcacgatcgtgaaacttatcaagaacttcttgatgaattagatgaacaaggtattgatgatttaactcgtgtacgtgagtttatcggtttagtagcagaaaaaggttctgcaatgcaaaccttacgtatcggtgagcttaaatctatgctgcatttagctttaggtaacttagagcaagcgttagactgggcaaactggactgcgaatatgaatgcgagcgtattctcagcggagcgtaacaattattaccgctgcctaattcaatcgattgagttgttcttagatgaagaacgtgatgcagaacaatatcgtatggtatttgagaaaatgtacggtaaacaagcggttgaatctgcttggggcgcaatccaaggcggtaacccgttccacggcttaaccgcatcggatgaatcgcttgaaaatatgaccgcacatcagaaattacttgatgcttaccgtaaattacaggtggcgaaagtaaatccgattgctcgttaagcttttcaaatggtgggcgaaagcccaccttattatctactatatcttcctgaaatctctcgcacactttccactacttcatatttcaaatcattaaaatcttgctgaagatagttgaaatttttacgtgcataagcaattttcatctgctctgattgatccaacaaactttcatctacaccagcctggatgcctttacccgtatttttggtttctgccacaaaataaattttattctgtcctttaaacactaccgcccaatcggggttataattacctaatggtgttggaattttaaactttttcggtaatttgaaataaaactcaacttgttcactattttcacaatctcttgcaaacgaagtttccgtatttgaatctagggaaatatattcttcgtgaattgttttttcttgctcattcactttaaaagtgaattgatttggataaaactcaaaatcttcgaataaagtcatctcataggttttacccgcaatacgtcgatactgtacaccttccgccataatttcttgcaaagcaaagttaattttctctgcaactaagtcaataaaacgctgtggattagcaaagatctcctgcaagcggtcagatttttgcaaaatattacaaagcgtttcacgggttagtcccgttttcttttggagcatattcaatacatcaggaattgcccattccacttttgttatatcacttccttcacctcgtaaatctgtctgtacccctgtttcatcaaaacgtaatttaactttcgtatgctgaattttaaccgcttccactctctgcattttggcaattttcgctatggcattttcaattaaatcagcttgtgcaaacgccactcgataagtggttttatatttgattcgctcccataaggtttgaaattcagggtgttggctaaaatctttccgataacgcacaaccttacgttctgctttatttttgatttggcttttttcaaatgtaacgccacaatcttcttcaatttcacgttgtaatttcgaagcaaattcctcgtagctttcattggctatcacagtcaaaatatttttacttttatcttgcaaacgaacaccattttgatcaactggtaaacgtaaacctcgcccgatctcttgacgtttttttagctcgctagcagtatcatttagagtacaaatttggaatacgttaggattatcccagccctctctcaacgctgaatgggagaaaataaaacgcaatggattatccaatgataacaagccttctttatttttcattataagttggtaagtatcattatctgcctgcgttgtgccgctggtatcttttactacaccttttttatctttcgaaaaatagccatcgtgcacaccttcgggggactcatttaccaattcttgataaatttcttcaaaccactggtagaatttcccaccattgcgatagttatccaccttatcaataaaaaacaacgataaaaccttcacgccaagcggtcgaaatttcttttctttttgcaaatgctcttcaatcgtgcggcgaatctgcattttctgcaaatcgtcttttaaagcagaattatttgcgcctgcgaaaacttgcataccactattaaattcaatcatttgagcatcaaaatccattccactcaaaatatagccactgcgatacatctcattttggttggaaagctcaaacaaatcttgatttggcttaatggtaacgacttttttcttcatcgctttcttatcattaaacaaaatttccacctttgccgaccaactttttgccgttgttttaagttcttttaatgcgacataagctccatttacctcgttttctgccagaacgctatctacctcaatttgtttcacataaccctgttcataggcttgtacagggttgaaactaaaaattgggtggtaggcatttttatgcgtcgctgaataacgtaaagtaaataatggattgaggctatcaattgctttacggcgaatttcagtttccatattttgaggttcgtcaataatcacgattgggcgagcctgttgaatatagctaatcagagcaacaccactttcattcatcgtattgataatgttgctatctttcgcaaatgagtcgatattaatcactaaaatttcgatattgtgattttctgcaaactgtttcaaacgtgaaagttggttacttttatactcaaatttttggtttacactcacattatcgaataatgtggcgaaatgctgacgtgtagtttttaacgtatgcaatacgccctcacgaatcgccacgctcggcacaacgattacaaatttttgccaaccgtattcacgatttagctcaaaaatcgtgcgaagataaacataggttttccctgtccctgtttccatttctacggtgaaatttaaaccgtgatcagaaagtgtcgttttgtacttaatgttttgagcgttttgctgatttgccaaattctcagtaagaggcaagtctgcaaccaactctgcatttgggcaaaattgagaatgatgagccagttgtaaatcatttgtctgttgattcggctgcccaacaaataaatttaataccgaacgtaccgcttgttgttgataatctaacgtttcaaattggagtttcattttaaattcttctcgatctactcccctctttataaaagaggggctgggggagatttaataacgatgtctcatttcgtatgagcataaatcacttctgccaaatctccccttcccctctttgctaaagaggggttttaatttaaatcacaaaaaatgcaatattcgcatctttcatctgcaattcggcattttttttcaatgcgtcattgccagcaaacaaacgatctaatgccaccactttttgcggttgtacattgataacactattaagcaaattctcatcgatatgctccaataaaatggcatagtgctgtgatttttcatcttcaatccaaaatatgttgttttcataacgcacattacaggttagtttcagccccaaacgtagcagaatttcatatagcattacttgtggttcggtgttttctttcacattgtcgataaacatttctagttgttccgcaaggttttctgccgttggcgattgccactgtttgaaatggctatccgttaatttgaatactttaaagcccacatcaagcggtcgattttcctcatttttttgcaaaatttgcgaacctgctctgcgaatacgctcttttgaaatttcggcaatagttgcaggaacccctaaatttaaacaaaattcaacagcttctttttgatcttcattatctacatttaatgattcagctaattgaacacttataaatgtattctttttaccttctgctaaattagtctctaatatcgcatgagcagtggaaccactcccactaaaaaaatccaagataatatccgtcccccctgtaaaccaacgaataaaatcacttaacattggtaatggtttaggattattaaatactgttgcattcatcaactcttttaaattgtctgtatgcaaactgctcataccatatttaggtaataaggtaggaggagttattgatgttctctcttttctacatttcaactttcctgttgatgaaaaatagaactcaataaccttttgacctttagtgtcataaacttcatttcctgcaaaaaactctgtcatttgtttcttctgtgtccaacctgcagataatgtaacttcttctagggttctgccatttattgccctaaagcatcctttaacaacagtaactttttcactatctccaaaagttccttttagttctacaccatcttttgcttcaaattttactccagcaggaaatgtaaattcactttcaggattagatttagagattttctttattgctccagcatcaataacacctgtcccacctttaatattcttatgattatttatattcttagcataaagtaaaacgtattcatgatatgtcttgaatagcccttgctgttgagaatgctgcttatcccaaataagttctgccacaaaattctcctccccaaacacttcatcgcacaataatttaagctgtgcctgttcgttatcgtcaatggagataaatatcactccgtcatctttgagtaaattacgagcgaggtggaggcgaggcaacatcatattcagccagttactatggaaatgcccattctctttggcatttttgcggaaggcttttttgagaaagccatcttcgcctatttcaccagtttgagcctgataatctgtttggctttgggcgaaattgtcgttataaacgaagtcatttcccgtgttataaggtgggtcaatgtagatcattttgatcgaattgaaataggatttttgcaacgctttcaatacttctagattttctccctcaataaagatattttgcgtttgctcgaaatctacgctctcttctacacaaggtgtaagcgttttttgcgtaggaatttgtaattgctgatacgcctgcgatttgcccgcccagttgagatgatagcggtcaggttcagtagaaatgttgtcagagaaaagctgttggaacttatcaaaatcaattttgccctcgctaaaaatttcaggcaagagtgcttttaattgaaaaagttgttgatctttaagcgaaaagttggcaaggctgtgctgttaggcattatgatgtccctttgaaaaaattcaaaggacttattctacaaatcttatcattttaaacaaagagtaagcggttaaatttttagatttttttgcaaattttgctagaatgtcggctttattttaatgacacaaaaatttctatgattgactttcgtcctttttatcaacaaatcgcaacaacgaatctgtccgcttggctggaaactttgcctttacaattaaaacagtgggaaaaaaccacgcatggtgattatgccaagtgggcaaaaattgtcgattttatgccaaattcgaccgcttgtattaatttgaaagataaggtggaatcgattccaaatgcaccgctttcagtcggcgaaaccaaacaactgactcatcatttaaaacagctgatgccttggcgtaaagggccttatcatttgcacggaattcatattgataccgaatggcgttccgattttaaatgggatcgtgtacttccgcaccttgccccgctgaaagaccgtactattttagatgtcggctgtggtagtggttaccatatgtggcgtatggtcggcgaaggcgcaaaaatggtggtgggtattgatccaactgaattattcctttgtcaatttgaagtggtgcgtaaattacttggcaatgaccgccgagcgcatttaattccgcttggtattgagcaaatgcaaccgttagctgcttttgatacggttttctcaatgggcgtgctttatcaccgtaaatcgccgttagatcatctttcacaacttaaagcgcaactggtgaaaggtggtgaattggtattagaaacgctagtgattgatggcgatgtgaatacttgtcttgtcccagccgatcgctatgcaaagatgaaaaacgtttattttattccgtcggtcgattgtctgattaactggttggaaaaagttggcttcaaaaatgttcgttgtgttgatcaagccattacaacattagaagaacaacgtaaaacggagtggctagaaaatgaaagtttggttgatttcctcgatccaaatgatcatagtaaaaccattgaaggctatcctgcgccgaaacgtgcagtaattttagccaacacctaacacatatacctatctgctaaagcctcacattgctgaggcttattcttttgaactaaatcaaactcgttccaatttaccccattttttgtatatccccctattttcgtcagttttaaaattttaaaaaacgaatggagtataaattatgtcgaacccttttactgtcgcttggagtcgtaaacaacaagttatgtgtttaggtcattggattattcattacaatggtcgagaacttaccctgcctaaagaccgtcaagataaagatatgggcacaaaagggatttataactatatggatccggatgatgagctttacttagaaggattggatgaagatgattggattgtggaaaatattgaatggttaagtgattggtttattgaacaagatgtgccattagaagaaaacattattcgctatttttatcaagcggtaaacaaagaggactggcgttgtggcagttgtggaggctgtatctagaagctaacaagcggtcataatttgcaagtttttgcaaaaatcgaccgcttgctacgatggatgattagtttaatacccaaacacgtccgtagtgtttcattaaaccggctttatgacccgcctcatcgccgataccttggtataagtcaaagtgatgaccttttaccgcaccgccgacatctaatgccaccattaaacgtaattcatgtttgcccgtccagttaccggcacgatcgattaacggcgtttcgaccaataatacactgcctgacggtacaaggcttttatctgaagcaactgatgccaatgcgactaacggtacgcctgccgaaccttttacttgaccggtcggatcatttttaaagaaaacgtaagacggattacgttctaataaaccttgtacacgatgcggattacgttcgccccattcacggatcgcttgaatagacatcttctcttttggaatttcaccgtcttcaactaataaacgaccgacactcgcatatttaaagccgttttgaccggcataagcaaaataatttaaacgaccgtcaccgaaatcaacataaccgctcccttgcacgccaagtaagaagttatctaacattgaatcactgtaagccagttctaaacctttaccttctaacgcgccgtcataaatttgtgaacgggtaaaacgtttttggcttggcatcgcataaatcggatgctgatatttaccttgcggtgtacgacgtgcgtgaattaccggagaatagtagccggtcattaacacgttttgaaagccgtcttcaccacgcatttgtaacgcgtgaatattgtaacgagctaaatctgataccttaccacctgaagcgatccatgaggaaactttaccgtaagtgcctgcataacggccggtaataccgccggcatacgcacgtacattatttaactgttttaagaaatcttggaaattaacaatagatccatttgccgccactctcggtgtgctgacaaaattatgcggaatatactgacgacctttatataccgcgccaaactttgcgtgttcggcttggtaatcatgctgccctttgtttgcattatctgaagaacaacttgcaactaaaagcgcaatagcagtaacctttgcccattttttatatgctttccaattcataaaagaccttaagtaatgattgatagaaaagaggctagcgtatcaaaattcctgttaaaacgatactaaatttttatcctttacacagccttaatttacgatattttatgctatttctgtttcaaattcagtcaaacaaactaatttcgataaattatgcttgcaatgatgctaaaaacgagtattatacaccacatacagacgcggggtggagcagcttggtagctcgtcgggctcataacccgaaggccgtcggttcaaatccggcccccgcaaccagaattcttagccctcgataatatcgagggcttttttgtatctgcaaaaaacaaatgaaaatttaccgcttgcaccttatcttcttttaccagtaaactttcccaaaatactcggcaactttctagatatgaacaatattcttaccatcacgcaacttaactattcggtacgcaatttacttgaaatggaattagggcaagtttggcttaccggtgaaatttccaattttagccaacccgtttccggacattggtatctcacccttaaagacgaaaatgcccaagtgcgtggtgcaatgtttagaatgaaaaaccaacgagtcacttttcgcccgcaaaacggtatgcaagtactggtacgtgccagcgttagtttatatgagccgcgtggtgactatcaaatcattattgaaagtatgcaacctgccggtgacggcttgttacaacaacaatttgaacaactaaaaatgaaactggccgccgaagggctttttgcacaagaaaagaaaaaagctattccgccttttgctaaacgagtcggtattattacctcttcaagcggtgcagcattacaggatattttaaatattctaaaacgccgtgatccgagcttggcgatcattatttatccgacgctagtacaaggtaaagaagcaacacaagatattgtaaatacgattgatttagccaatcgccgctgtgaatgcgatgtgttaattgtcggtcgaggtggcggttcgcttgaagacttgtggtgttttaatgaagaatccgttgctcatgcaattttccgttcggatattccgattatcagtgcagtaggacacgaaaccgatgtgacgattgccgactttgttgcagatttaagagctccgaccccctctgccgcagcggaattggttagccgagatcaacaagagttagtacgtcagttacaacatcaatttgacaaattaagccttgcttttgaccgcttatgggcggagaaacaagcatctttcgaacgtttgaaactacgtttaaatgctcagcatcctgctcgtcaggtacaaatacaacagcaacaattagctcaatttagctatcgcttagaaaatgcaatacataaaacttatttaaccgaaaaacagaaactcgaacaattgttgctacgtttaaccaatcagcacccacagcgtcagttacaacagcaacaaattcaattaaagcaagccaaatatcgtctggtgcaagcgatagaacaaaccttaatccgcaaacaacaccagtggaaacatattgctgaacaagtgaaacgtaatccgttgccatattatgtagaaaagaaaaatcagcagtatgtacaattagcacaacgacttcagtttgcgattgaaaagaaattaaccaaagaacagcaagcatttcaggaactttgtacgaaaatagacggtttaagcccgctaaaaattctagcgagaggctactctgtaacacaaacctcgcaaggcgaaattcttcgctcaacccaaaatcttgaggtaggaacacaaatcaccaccaaactttcgcaaggcgaaatcgtgagtgaaatcattaaaattaattgattaaaatataacctatattattttaattaatatttcctttgccaaatcaagatgttatttgctcttgtgcattgttgttcacgaagttatccacaagttgtgtgaataacttcgtttttcaagttaaaataagtgttgctttttaatgcaaacaatgttttatgcgtttttatcccttgcacaagcggactaatttccctataattcttctcgttctcagttctgagaaattcactaaattcatccttgcctgggtggcgaaattggtagacgcagcggattcaaaatccgccggtgaataaccatgtcggttcgagtccgacctcaggcaccatacctaaaacccttccttttaaagccaatactccttaacgttaatttctttgttaagtgagtaaattatgaatttattacaaaacgcttcaaataagccctttgttattactgtagcttcaactaaaggcggctcggcaaaaagtacaaatgcagcaaatattggtgcattttgcgctgaacatggcttaaaaactcttctcattgatactgatacccaacctacattaagttcttattatgctttggattatcaggctcctggtggcacttatgaatttctacattttagagatgtagaaccgtcacatatcatttctaaaacacaaattcctaatcttgacttaatccagtcaaacgacccatcaaataaaattagtcctatgttacgagattcgccagatggtgcacttcgctttagcttacttctaagtaaaattgatggatacgatgtagtcattgtagatactcgtggtactcgcgatattaccgtagatatgtctgtattagctgcggatgttcttttttgccctattcttccacatattttgtctgcaaaagaatttattcgcggcacgattgggatgtatcaagatttgcagacttttgcaaattttgggttcaccctccctccattgaaagctgtcattaattgtgttgatcatactaatgatgtgaaatttgtttcagaacatttacatacgctatttgcaacagaatttgatgcttccaaaacattactagattttacagttccagataaagtggcctatcgtgaggctgcaacattctctatcccggtatacaaacaaaatcgagcagaatataaaacaatccaacaactctgttcattgctgatgcctcaatttgctcaaagccattttatgggtaaggagtaaagaatgagccataaacaaccaatagagctttattctgtagatgccgaaagctcggtactcggtgggcttattcttgataatagcctctttgatgagatagttgatgtgatcattccaaatgacttttacctgcacgcacatcaaattatttttaaagggattttttcattattaagtaatgctaaacccgtcgatatattaacgcttgaacaatatttcaaagaacaaggtattttggagcagctaggaggattagcttatatcgctcagttagttaagattactccaactacagctaactttaaagcttacattgatattgtcgtgttatacagcaagcaccgcaaacttttaagactgggccagaatattatttctgaaatacaagttgccaaatcagccgaaaaattagatgaacttctcgaaaatattgaaagacagtttacggatttaacactctctcagcagacagagggcgttatagatttaaatgaaactttaaaaaaagtggttcttcgaatggaatcttctgcccaaaatgctgatccagttacaggcactcctacaggtattcaggaattagatgaagtaactacaggtggtcaggcaggagattttattgtaattggtgcaagaccttccatgggaaaaactgcattttgtcagacaattgcttatcacaccttagaaaaatttaaagatttacctattcaattctatagcatggaaatgccggcagaacaaattctgcaacgttttctagctatgcgagctcgagtgagtttacaagctatccgtaaagcagatcagttaggtgaagatgaatgggcaaaaatctcacttgcgatggggcatattctagatgaatggaaaaatcgtttactcattgatgatgaaggaggactcacccctcaaaaattacgttcgaaagttcgttataacatccgcaaatatggtaaaccggcggcaatttttattgactacttgcaattaatgcaaggttctcgtcgttacgaaaatcgtcatttagaaattaccgcaatttctcaggcgttaaaaaatttagcgaaagaagtggattgccccgtttacgctctctcacaacttaaccggagcttggaacaacgcgcaaataaacgtcctatgaatgccgatttacgagaatcaggctccttagaacaagatgcggatctcattctgttcatttaccgagatgaggtctataacgaacaaactgaacatcctggtactgcagaaattattatcggaaaacaacgtaatggtccgttaaagacagtatttacgcgatttatcggtgaatactcactctttgaaaatttagcagtaacacaatactaggggaaataaaaaatgacaaaaaatgaaaaaagagcggcagctattgcacgaaatttaaatgtaagcccaattgccaatatatctccatcatactcaactgtcacaccaaatcattacagctcagaggtggaatatattactgtcacattagataagttacgcccttatgagcataatcctcgtaagacacgtaaccctaattttgaaatgattaaagaatccatccgccgccgcggcttagatcataaaccgaatattactcgtcgcccaggagaagatttttatattatcgccgacggtggcaatactcgaattcaagccttgaaagaattatttactgaaaccaaagatccgaaattttggtcaattagttgcgaatataaaccatggcaaggcgattctgcagatagcgtagaagctgaattaaatatcctgatcggtcatttaattgaaaatgacactcgtgcagatttatctttcattgagaaggccttagggattctacaagcgaaagaatattacgagaaaaaactaggaaaatcactttcatctcgtgaattatctactgagctggaaaaagacggttatattatccactatacgctaattgccaaaatggaacgctgtgtaacccatttgtatcctcatattcctgatgtgctttttaaaggattaggtcatacgcaaatcgataaattacttgcaattcgcaataacgcagatgaagtttggcatcattatcatcttgaaatggatacttcttttaacaatgtctgggcaagttcattatcaagttgtaatgaggattcgccatttcaagtacgtgattttcaagataagttaattacccagatggctgatttactagaagggaaaacaagctatgaatctctttatcttgaaattgatcttgatgaaagaaaattcaaaaaaattgcggcgaaacaacatgagatagaaaataatgttgagcatagtcttgaacaaattacacaacaccaagaaacggtaaaaacaaaacctatcgctacaagtacatcaaaacctagtgataaaaattcactcattaaagaagattctgcactaattcctactactccttcatctagtgaggggaatgaagacattgaatctagtggagagcttacatcaaatgtgatggatttctttaataatgcacaaacaagtattgtgaatacgagtgaaaacacggagacagaactactaactcagatttcacaagattttggtttaactccaggtatgagtattcaagagcaacgtgaaaaacgtgcagctgagaatggactttcgtttgcttgttgtggtcgtcagccagtcgaagatatttggcagatttatcccgctcgcaactatcgttcagaagcctattctttggctttagatattgccgaaacagccaatattaatgaattagttgaacatgtggttaaaaatcctgtggattatagctaccgaatgaaacctaacgatagttcactttcggattatgcttcttttatttatcagttactttcaatgttacaaacacatgatttttcacaatcggtacattgcaatttaaatagccactttttatttgacattcaacaatcaggcactggaattgatgatattacgttagtcaaaattttccgtcttattcgagttgtacgtcatttacgccagggagctcaaccatgattaagcaaacaactattaatgaagccttgttagccaatgtactacttaatctacgagaaggtaatgttcgttcttgtttaaatctaggcttttcggaagatgagcttaaagcaataaatcaattaactttggacgaattattttatatcggtcattccacagttcaatttgcaaaagtagaaattaatcatgatgcattttggaaattgcttgctgttgcacaagaaaatgcagaagagcaacaagttattgatcgcgcactcctacttggagcttctatcgaaatgttgaatcaatacttcgggttatctacttcagctgtttctgctcgtcgccaattacttggcaaagaagaaaaaatgggcagaaaagcggcagcaacggatgaagagcaggaattgatttggaatctatggaagaaataccaagcaacgatagaaaatcttcattcattagaaggattggagttgctaagtcttattgcggaagaaagcaatataaaccttactgtcgtttggaagcttgtttgcgaatggcaaagtaactaaaagaataaaccccaaagacagcctaaacctctatctttggggttggagatttccatctatgactctatggaaattattcgttgtaattatatcaccacaacatattagtgcaataaaaaaactctttatgttggctggagaataaaatgaagataacccaacaaaataagcgaacagaacatggattactcttttttggtaatcaacatgaaactgtaccgacacgtttattgcatgatccttatttaacacctagagcaaaatttgcctggcaactgattaaatgcaatgcgcgagaatttcaaagcggactcttcccgtcttatgacgtattaggaaaattattatcagataaaccttatacagagagccgattatctgaaaaagcgattacacaaacgctttatcttttacgtttaactcgttggcttacgttatgtgaaactgtaaggaacgagaaaggttatgtaatgggtaatgtttacctattgcacgatgaaccaattcctattttagatgcaattcaattaaatgatgaatatttaacgtttttggaaaaatgtgctaaccatcatgacgggcttgtaaatagtgtagctaatcatattattgaacatttactttctgataaaacgcaatggcactatgtatcgcatctcgaaagtatgcaagttcgctatcgtgaatatcaacaacgtatagcacaaatacctgaagactcgtctttaccaaaaaaagaactgcaaaatcttcaacaaaatatcctaacttccaatatggaagtcagggataaaaatgtggaagtcagggaaaaatcagctaaaagcctaacttccaatatggaagtcagggataaaaatgaggctaactcattgattttagactctcttccattagggaagtcaggaaaacagtacagtactagtactttatatattaataagtactgtactggaaatgcagaagaattaatttggccagcagaaatctcgctttctacggtagaaaaaaacatggctgctaaagcgatgaatggattagatttaggcttatgtcgagctatcttgctagaagcccaacaacgcattattcaaaaacaagatgtaaaaaaacctagcggatatttgtacacattgatacagaaagcacatcaaggcaactttaaaccctattattttgagcttgggcaacaagtatcaaatacaccgatctctgtaaaaccagcatccatagcaaatagatcaaatgcgattggaacaacgcaagagaaaaaaatctctccaatggagcgagaaagattagtcaaacagatgaaacagctacggatgcaactttgcctcaattaatactgaacaaaaaacaaccagtgtagaggggctctacaaagtacaaaatttaaccattatgtaaaaactacactatgaataaaaaataatcggtgaagagggactcttcaaagcacaaaatttaaacagaaataatctataggagtattaactatgacgactacacctgaatctcaacttggtccgttacgtagtgagattaaatttaccttacatacccaatatgcgcataaattatggacaggtcgaaattctacgaaagacgagaatggtaaaattactcaatcatctattttgagtatgccaaatgctttaaaactaattgggctgatccagcaagatgctgctcaagatgatccttatgctgatgattatttattacgatttgaagaaaaggtactaacttaccgtcaagaaatgcagcaattagtggataagctagtagggatttatgcggatagactaccagaaagtattgagtttgaacgttgcactaatgtatcacctatttcttacccaatttatgtcaattctcaattaggctatcaattactgtatcttttaggtgacttcgataatttagctcgagtaaccatgactgccgcacatattgcgttacttactcgttcagatgcacaagaatggctagaagcaggagctgtcctaattcgtagatgttttggcgtgattgaaaactacaaacattctggtatcactcgtaaagatgcgcaagaaaataatgcacgttatcaagctgcaattaaacgaatgggatatgaagtaccagattatgtgattaccggtgagcgacgtgcggactatgctcctttcattcgtcataattctctattaggcgatgagaatgaacaagccgttgagagccatgttacagcaagtacaaaacaggaataaggaataggttgttttatgggattaatttctgaagacatgtatcgtgaacttgcaaaaaaagctgatgtaaataatgtactgaaacaactatttagtcatttagagactgaggcagattatcaaattttatttgagcaagttcatcaagcacgtacagcttttatggattatcagttagaaatggttcagcgagtgagagcgagtgaattacaacatttacccatttttatgatcaaagataaatcctcatcatcaggtgggacatttttacgctggcgcagtatgcatcataccggtacaggtgaaaccgtttggcaaccattactaactgatagtcatgtgccagaatctttacgtaatcagcttgtcgcagtggaaaaagatcgtattttagtcaatatgcagatttctatcttcaattatattctgcgacagttgtcagaatgtgcatctaaaattgaaaaagtggaaaacgccctgtgatgaaatctctgaaaacttagatatgtaaagcctgaaaaagttaggtatgtaatccctgcattaaaaggccttttaaaggtaaggggacaagccccttaccttaacgaagaaaatacctttcttattgaggagtatatgattgcaaatgtgaaaatgatatttagtgtcgaagtagatggtgaagcctttattcaacatcatctgctaaaaattcattccaatgagattttaattaaatgattttttcttgagttgaatcgagtctaatagacctaacttaattctttaaaggagtaaataagatggctggtatcaataaagtcattattgttgggcatctcggcaatgaacctgaaatgcgaactatgccgaatggtgaagcagttgcaaatatcagtgttgcaacaagtgaaagctggacggataaaacgaccggagaacgccgtgaagtaacagaatggcatcgaattgtattctatcgccgtcaagcagaagtagttggtcaatatctccacaagggttcacaagtatatgtagaaggccgtctacgcacacgtaaatggcaagatcagaatggtcaagatcgttatacgaccgaaattcaaggtgatatattacaaatgctaggtggacgtaataatggaacttctcctgctccaacacaaaatcaaccgactaatgcagttaatcaaacggagcctccgataaataactttgatgacgatattccgttctgagttacatataatttaaaactgtaaaataaaacccatataaatatagagaaccctttattttaaaagggttctctttttttacattaatttcgacacaacatctttaatttgatagtatttatatatgatatttttgtaaattaaatgaatatgtatagattagaaacagtccttttttcaaatggagaacgttttcctatattggttaatgttaaaactggtattcctgatttttattcaaccttatgggtaactgtggaactacgtaatcaatccgcagtaaacacaattagaaataagctgggaactatacagtggataatgaattgggaaaaacagaataatcttgttattagtgatctaattcataacaaagtactcttaacagaaaaccaattagaatctcttattcggcatatgagaataaatgtaaaaaagcaaaagaatgtaatcaatacaaaaaaagtgtgttaatgaaaggtaggactcaatttattgatatttattctgccgtatctcttagtcatcaatataatagactaacaacgctttcagaatacatattatttctatcaagctgcggcaagttggatgatgtttgtaaccgcatacggcggtttgattgaatttggcaaggtgcaaaaaggcgattttgttgtattgggcggagcgaccagctcggtaggcattgccgccattcaaatcgccaaaatgcaaggggcaaacgtgattgctctgtctcgcacgcacgccaaaggcgatgtgctgggcggattttgtgattgccaccaaagaagatgacgttacggctaaattactagaaattacaaacggcaaaggcgtgaatttagtgttcgaccctgtgggtgacaaagaagcagcaaaaattatcaacgcaatgacacaagacggcaaatacatcatctacggtgcattaagccacgatgatatcgccgtgcctgtgttcccaattttaggcaaacacttaaccgtgcgaggctatgaattgtttgaaatcactaccgtaccagaaaaactcgctcaagcgaaaaaattcgtgtttgacggcttagcaagctgtcaattaaaaccagaaattgacaaagtttttgcttttgatgaaatggcggaagctcaccgttatatggaaagcaatgcacagattgggaagattttggtaaaggtttgattgttttaaggtaaatatgccgtctgaaaaataagtttcagacggcacatcgttattttacctgccgattaagccaccacactagcgagagcatcacaggcacttccaccagcacaccgaccaccgttgccaatgccgcccccgagtgcaaaccgaacaaagaaattgccaccgccaattcaaaaaaattactcgtgccaatcaagcacgcaggggcggaaatttcgtgtggtaatttgagctattttgccaaaacgtgagccaaggcaaaaatgccgtaagtctgtgccagcaggggaatagcaatcagcagaataatcaaagggttggcaataatggtttgggtttgaaaggcaaacagcaacaccaccgtcaaaatcaaacccataatggaaaaaggtttcaggctgcctgaaaaatattccgctattctttttctttaataccttgaataatctgacacttatcaaccgttttattttcacaacccacaaattgcattaaaaaagttttaacttgttgtagttctgtgatttgttcgtccaaatatgccaaatgttgctcggcaagtgcattgatttcattgcattgtttgttaggcgtttgttgtaattgcaacagcgttttgatgttacttaaagaaaaaccgatattacggcaagttttaataaagcgtaattgttctaactgattttcatcaaacacacgatagccattttgttgatgtgtaggggcgattaagccttgtttttcataataacgaatggtttccaaatgtacgcctgtttgttcactggcttgttttattttaaaaaattttgacactttagcttgaccctgtaatgactacggagtttatagtatagcaaatttcatcttaaaacaggagcaaaaaatggcgtgccaaaattgttgtggttcaaatcagcccattcatcaatcgcccaagtacaaaaaagccttgtggattgtcttgatattaaatttatcaatgttttttgtggaaattgtgatgggggttaaatcgggttcaacttcgctgttgtcagacagtttggatttcttgggcgacagtgccaattacttgataagtttgattgttttgccaatggcgttaagttaccgagccaaagcatctatggttaaggggctaacgatgggcggttttggtttatttattttaatgacgaccatttatcgtgtgttttatggggaaatgcccagttattctgaaatgagcattgtgggatttttggcgttattggtcaatgtgtcggcattgttgatattattaaaatttcgtgatggcgacagcaatgtccgcagtgtgtgggtgtgttcccgaaacgatgcgattggtaatgtggcggtaattttggcgggtatggcagtttatttttttcaatcaaaatatcctgatttaattgtggcgtttgttttggcatttttggcattacaagccagtcaagaaatcatcaaaagggcttgggcggaattaaaagtcagttaatttaaaacaccgtttggattgatgttcaagcggtgtttttatttttaaattttgcaaaataactttcaggctgcctgaaaaacctacacccctttattccccagcgattttcggtttatccaccacaccagcgagagcatcacaggcacttccaccagcacaccgaccaccgttgccaatgccgccccagaatgcaaaccgaacaaagaaattgccaccgccaccgccaattcaaaaaaattactcgtgccaatcaagcacgcaggggcggaaatttcgtgtggtaatttgagccattttgccaaaacgtgagccaaggcaaaaatgccgtaagtctgtgccagcaggggaatagcaatcagcagaataatcaaagggttggcaataatggtttgggcttgaaaggcaaacagcaacactaccgtcaaaatcaaacccataatggaaaaaggtttcaggctgcctgaaaattgtgccaccaatttacccgatttttgtaaataagagcggataaaccacccagccagcaagggcaacagcacatacaaaatcgtgcttaaaatcaaggtattccacggaatttctatgccgcttacgccgagcaatacgcctgcaatcggagcatacgccacaatcataatcaaatcattgaccgaaacctgtaccaaagtgtaattggggtcgcctttgaccagttgcgaccacacaaacaccattgccgtacaaggcgccaccccaagcaaaatcatacctgcaatgtactcgcctgccgattgttcatctacccagccagcaaaaaacaccttaaaaaacaaccagcccacaagtgccatcgtaaaaggctgttatcaagctatggcattcatctgctttgatagtggttaaaaatcgcccaagccttttaagatggggcagtcgggattgtcatcgcccccgcaggcatcgctccacgcttgcagggtgtgttgcattgattttaattctttgattttattggataaaaaatcaatatgactggcggtgatcgttttgacctgagcacttgtgcggtgtggattgtcttgcagtgccaaaagctcgccaatctgtgcaagcgaaaaaccgacgctgcgggctttggcgatgaattttagccgagcgatgtcattggagttataaatccgataacctgcttcactgcgtgatgggttaattaataagcctgctttttcataatcacggatttgtttgacggaaagttgggtagatttagacgcttgtccgatgttcattgttgctccttattgagtggtgtgtaaaaaaatgttatcaagtaaaaataacccttgaccctaacgtaatgttagggtttatgatgcacacatcaaaacaaaaaagcaatgcttttaatcgcttaaaagcactttgttttgataatccactttaacttaacattcggagaaactgttatgaacgctgattttgttcaaaaccgacacgcccattgcggctgccagtcttgcacggggcaaaactgccgtccggactgccaatgccaaaacggcaagccctgcatttgtgatgactgcacttgcaacggctgtgcgtgtgaatcgtaaaaccaaatagtgaaatggacattgggcgaatctgtcatttgcccaatgttatcaatgcccattttgacaaggagaatccaatgacattcatcaaaaaccgtgccgtacatcttgtcgctgccgctgttgttttggcgacttcaaccgcttttgccgacggcaaaaacgaagtgccgacgcactcgatggcgtgcgacaataactacacccaaaccacccacgactgcccaaataaccaaaacgggcacgcagcggtgaaccacgctaatatgaaccacgcccatatgaaccactctgctatggcgatggacactcaaaatgctccgccccatacccaagcctatcttgcaatgatgaacaagatgggcgatgagatgagcaaagcgggcaatcttgccgatgctgataccgcttttgccaaaggtatgattccgcaccatatcggagcagttgagatggcaaaagtacagcttgaatttggcaaagacgaaacaatgagaaaacttgcccaagcgattattgatgggcaacaaagtgaaatcgacctgatgaacgcttggctggcgggtaaagacaccgcaacccaaaacccgcaagccccgcacgccaaggcctatgccgcaggcaaggcgcaccacgaggcgatgatggcggcaatcaatgagccaaaccctgatgttgcctttgccaaagggatgattccgcatcatcaaggggcggtcgagatggcaaaagtgcaattacagttcggcaaagacgaaaaaatgaaaaagctcgctcaagacatcatcaaagcccaagaacctgaaatcaagctgatgcaagactggctaaaacagtaggggcaataaggcaaaaacaccgcttttgataaagcggtgcttttgaggtcgtctgaaaacaggtttaaggctttttcagacggcatttggggttttcaggcaacctttaaaacaagccccaaggaaatgatgatgccgacttgtcggacacatcggcaagcgatgttctgaaccttctgctttttcagacggcatcggtatttgcaggcagcctgaaaaaaaccgtcattctgaccggcccaatccgtacctgctttttcgataaacgaccggtgatgaccctatgaacccaacaggagaaattgtgatgaagcaagaaacacacaaaccgcccaaacaccacgagtgccgacacggacacggacagcaccgccctgtgcagacaccgtccgatgcagcggctgcttcgggctacacctgcccgatgcatccggaaatccggcaagaccgccccggcaactgccctctttgcggtatggcattggagccgctgatgcctgaattggacgacgacaatccggagctgcgtgatttttcccgacgcttttggtacacgctgcccctgacggcggcagtgctggtgctggcgatgttcggcgagcgtctgaacctgatggatatggccgcacaaagctgggtagagctggtgctgtcgctgccgatcgtgctgtgggcggggctgccgtttttctcacggggttggcagtcgctggcaaaccgtagtcccaatatgtggacgctgattgcactgggaacgagtgcagccttcgtttacagcgttgttgccaccgctgcacccggcatctttccggcatcgtttgtatcgatggggcgggtcggcgtgtattttgaggcggcggccgtcatcatctcgctgaccttgctcggccagatgctcgaactcaaagcccggtcgcagacttcggcggcaatcaagaccctgctcggactggcgcccaaaaccgcacggcgtatcggcccgggcggtgctgaagaagatgtgccgctcagccacatccacatcggcgaccttctgcgtgtgcgccccggcgaaaaagtgcctgtcgatggcgtggtggttgagggcgcaagctcggtagatgaatcgatgctgaccggcgagccgctgccggtgcgcaaagccaccggcgacaaagtcatcggcgccacgctcaacaccggcggtgcgctcgtcatccgctccgagcgcatcggttcggaaaccgtgctttcgcagattgtccagatggtggcccaggcgcagcgctccaaagcaccgatgcagcgtatggccgacggagtggcaggctatttcgtactggcggttgtcgccgtcgccgttgccactttctttgtctggggcgtgttcggcccgcaaccgtcttgggtgttcgggttgatcaacgccgttgcggtcttgattatcgcctgcccctgtgcactgggactggccacgccgatgtcggtgatggtcgccacaggacgcggggcaggcaggggcatattgttccgtgatgccgccgctatcgaaaacttgcggcgagtagacactttggtgattgataaaaccggcacactcaccgaaggccgacccgcctttgaccgtgccgttgcggcagcaggcttttccgccgaagaagtgctgcgtttggccgccagcttggatcagggcagcgaacacccgctggccgacgccattgtgcaggccgcacgggcacaacagctgaagctgagcaaacccgaacagtttgattcaggcagcggcatcggcgtgagcggcgtggttgaagggcgtgcgctggcactgggcaacacggcgtttatgcagcagaacgggcttagcgtcgaaccactgatcgagcaggccgaatccctgcgcagtgaaggtgccagcgtgatatatctggctgcggacggacatctcgcgggactgcttgccgtctccgatcctgtaaaagacagcacccccgaagcattggcctcgctcaaagcagccggcctgcgcatcattatggcaaccggcgacggattgaccacggcaaacgccgtgggcgcaaaactgggcatcgacgaagtgcacggcgaagtcaagcccgccgacaaactggcactgatcgagcggcttcagaacgaagggcgggtggtcgcaatggcaggcgacggcatcaacgatgcccccgcactggccaaagccgatgtcggcatcgcaatgggtaccggcaccgatgtggcaatgagcagtgcgcaaatcacgctggtcaaaggcgatttgcggggtattgccaccgcacgcaaattgtctgaggccaccgtgcgcaatatgaaggaaaacctgttatttgccttcttatacaacggcctgggggttcccgttgccgccggcgtgctgtacccctttaccggctggctgctctcaccgatgattgccgcactggcgatgagcctaagctcggcatccgtggtcggcaacgcactgcggctgcgcaaaagcaagttgtagaccacagccccgcaggcttcttccaatgacaaaacgacctcaaaaacaccgcttttgataaagcggtgttttttatgccgtctgaaaaggtctttaatactttttcagacggcattgtgtttttcaaacagtttcgcagtgtgcgtcattgcaccaacccaatatttcatcaggaaaatggtgcaacaagttgcaccctacatctttgatgcttttttaagacggcatttttttcagacggactaaaacgcccaatctttccatttttaaaaaccaacttcccatttttcgccattcttattgttattttaaaacgctaaaatacgcccatttttaatataggtcaaaacaatgagcaaacaaatccaatttacaaaaacaggttcgcctgatgtcctgcaaattgttgatgtacaaatccccgccccaaaatcgggcgaagtgcaaatccaaatgcacgctttgggactaaaccgtgccgagatgatgtatcgggaaggggcgtatgtgattgactctgtgttccctgcgactttgggttatgtaggggcaggcgtggtcgtggcggtgggcgatgacgctggcgaatttcaaatcggcgacaaagtgaacgtctgatctgcaccccaaaagttggactaaaaaccaactgattaaggtgcagattttttatgacgaaatccctctatttttatagttagataccactattccactttaaacatccccatcataccgagattttcatgttctaaaatatggcaatggtacattttcaacccagtatgtccttgcttaaagcgaataatcactttttcataagggcgtaaattaaccacatcttttaacgctctgccttctggcttaaaggttttaccgtttaacgtatgttgaattacttcaaattgagtgccgtgtaaatggaatggatgatccatatggctttcattgaagatttcccactgttccacttcattcaatttggtaacaaaatcaatacggttcatatcaaaggtttgaccgttgattaagaacataccattcatcattggtggaatagggttgtccgttagtgttgtagtagcgtgatgtgtaccgtgattcatcattggcatattcgtatggttcatcattttttcactaaagcgaatttggcgaacctgctttggctcatcccagttaggcaaggaccttaagctttcaggtaactgaacaggttctgatttcacctgaattgtggctaaagtgagatctttaggctgttcttgaaccatcatcttacggcgatcataataaccgctttgtaaattgactgttccttgcgtttcacccaccataatcacttcaacgcgttcggctggtgtaagtagcagttcatcaacaggcgagcgaggtttttcaagtaaaccaccttcggtacccaccacaatccatttcacccctggaatgtttaaacgaaaataacgagcgctagtggcattccaaagacggattcgttcattcgttttcacttgaatctggggctgatattgaccgttgattaacacaaattcaccctcacgaccgttcatccaatctaacatcgtgtttgctggaatggtgccatcggcatttaaacgcagatcggaaatcacccaatgttgttcaggaaggtgtgcaagcggatcatttttcgctttaacaacgaaagtgcctgctaagcctttatagacttgttcggaaacatggtcatgtggatgagggtggtaccaatatgtcccagcactgccttgaggtagcgtaaagcgatagacttttttcccttgcggttcaaccatatccatcgggttaccatccgcctcatttggtacatctaagccgtgccaatgtactgttgagggttgtggtaggtgattgataaattcaatttctacggtatcgccttcaaatacttcaatttgtggccctggtagttgtccgttataagcccaaaattccgtttctttattgtctgcgaggcgaattttaattggctctgcttttaaagtggctttgaacagtccagcttgagtcgattgattagcaagttttggtaatatcccattaagcgataaacctgaaggcattgcctcagttggcattaggccagtaggtactgaatgcatcatcgccatattgccatgttgtgcgtggttcatcatattcgcaaggctataaagcgagctactggctaagctaattccaattccataacgtaaaaaatctcgacgtttcattctttccccccctattggttataggatttaaacacttcactttcaccgtttttcttaatcaaaacaacatcataaggatctttgcgtccgccgtatgcttcaccgtccatacctggtgaaccaattggcattcccggtgcagacaagcctattgcatcgggtttttctgcgagtaaacgtttgatatcctcagcaggtacatgtccttcaatcacatagccatcaatcacggctgtgtggcaagaagcatgttcatatttaatgttaaagcgcttatgagcatcataattgcctgtttcgttgactttaacctcaaaaccgtttttctgcatatagctgatccattcattacaacagccacaagtcgggcttttccacacttccatagaaagtgtttgtgcttgagcaaaagcggttatgcctaaacttaaaagcaacaatgagcgggtgaatttatgtaatttcataagatgtccttattttttattgagattgaatggacatcattttaaagcttaacctagggttaaggtcaagtaatctgaaaaaattctatcatttgaaaaattttctcaaaatcctactgcttgtagtagagatatgccaacgtaccatccactattattttttaaaatgtgatcagaattattatttatgatgttctgaatgaccaccttgagtattcggcatattcatattagggttcatttcttgatgcatcttcatcatttcttcaggcgttatttcgcccgtcatcatttggttgtgcatttctgttatttgtttagcatccatttgcattgaatgagtcattgctggtgtagtgggttgatagcctgctgaaataggatctgccatgccaaagatcatagcaaagtgactcacaaataagaaaatcacaagataaaccgcatgtaatttaatttttgcactatccacgagatttttatgaataacttttaattccatgagtaaaataataaaaataggaaaggtagctaataatagtgatgcaattgatgcgatatctacccaaccacgccattcagtaatagtcggtacgataaaacgcttacaaaccgaccgtattgacttactctatcaacaccgtgttgatcccaatgtgccgattgaagaggtggctggcgctattcaagatttaatgaaacaaggcaaagttttgaattggggcttgtcggaagcaggcgagaaaaccattcgcaaggcacacgctattcagcctttaaccgccgtacaaagcgaatactcgttgtttttccgtggtcgtgaaaaagatgtcattctcgtttgtgaagaattagggattgggtttgtgccttggtcgccgctggcaatgggagcattggctggttatgtggacgagaacagccgttttgaggctgatccaagcaaagatttgcgtggtattatcccacgctttacacccgaagcgatgcaacaaaatgtgaagttaatccagcttgtgcaaaaatgggcaaaacgcaaactttgtacgcctgcacagctttctttggcctggctaatggcacagaaagcgtttatcgcgccaattcctgggacgagcaaagcccgtcatttgttggataatttaggcgcagacgatgtgaaatttaccgaagaagaattggcgcaattccgccaagaattagaagccattgaaattgtcggcttgcgtttgcctgaagcaattttgaatttttcagaagcgaaatagttttcagatacctgaaaaagtcgtaaataaaaattctttcttacagcggtcgttttcataaaatcctttgaaaaacgatcgcactttttcttgaatatgtagcaagattagtggaagatttatcgaaattgaaagatattgggaaaagggtaaaactggaatcagacagatgattaggcaaaacgctatagtcaataagtgtaaaaatggcataatcaactcaatgaatttatggacaaatattatctgtttggtattttatagtaagtacattgtgtaaaaataaaatctgaaatttagtctttttatactttatttttacgtactcatacttcaatctgggaaacttaatatttaattaattgatttaaaagaattttataatttacattcctaagtgatatagaaacaaccgttctgaattccatatacataaattctgtaaaaataaattacaaaactagctttacgttggtccagcgtaattaaataagtggacaccatcctaaactatcttctatatctcattgcatctggaattaatcttgccaaaatagaggtttataaagatttttctcttggagtaaattctctagttctaaatttaattcagtcaaatcataaaaagatgaaggtgaaataccggcatgtttagctaataagatcgcatttttttcgttataaacatatactggaaattgttttactccattagcaagcaaccatattgttcttgtaataccgttaataaatgagcaccatgtaacttgttcctctgaataccctactaattttttaaaccataaaaaagatttttcgtaaattggagtactcttgatatattccgtacaacttacgtctgctaatgggacgggatttgttcgtccaattcgaaatgctctttctgcatggtgaaatttgttatcgtttctccattctcgttcacttcctgaactaagatgaatatcctgtaggtatggtgcatttttccacatagctaaaaactttgtatcttgaacaaatactatttttttaacttcatcgctagatgaatgataaataggatgttgcatatatactttgcaattatccttagttgataattcaaaaagtaaatggttttgtaatgtatattcaggctgttcaataaaaatagcatggtgtggaaatttcattaattccattaattaaatcctttctgtgaattgaaaaagtatttatggctattaaataatctacaaaaccaatatagcatttttttatctttatactcaaaatggtttcgagtagattttaatcagactttagccaaaaatgaatactaaccaactattttaaggagaactacatgcgttattctaaattttctctacttttagtagcttcaaccatacttattacaggttgtgcagaacttagtgccattaacacaaaggtaggtgaaattgccggagaaattaatcaacgtgtttatggggcaaactctagcaatacgaccgtaaatcataatggggtgactattcacaataaagatgggagtcttacttctcgccaaaatattgaccaactctttattaaagtaagacgtgagtttgggtttagacctatagaatctgatagtcgagcaggaaaagtttatcatacagtacctggtacactttatcatgtttcaggctttttcgggcatgatgaagattctcgtggtatttcgttaggcgataactaccttgaggtgattcttgagaaaaccggaagtaataccgtcagtgtgagctgggaaatatcagggagtgaagcctggattagacgagctgaatcacgcttaactaaagtcataaaaaattagtaatttcattaaaacactcctagagaattatcccagctatattgctgggatttttttatcaaactcgcttttttctcaagagattaagttattgagaatagtctcctccttgtttgtaatactccaataatcagtcatctattggagataatatgaaactctttctttgtgaaaaaccctctcaaggtaatgatattgctaaagtactcgatgcaactacacgtggtgacggctgcttatttactgctgataaacaaatctgcgtgacttgggggataggtcatttagtagaacaattccagcctgaagaatatgacccctctttcaaacgttggtcatttgaaaccctacctattattccgggtgagtggaagttatcacctaagaaagaaacaaaaaaacaatataatatcgttatggctttgatcaaaaaagcaagttcaatagttatttctacagatgctgatcgtgaaggcgaaatgatagcaagagaattacttgatattgcaaaatttaacggacaagtattgcgtttatggttatcggcattggatgatactagtattcgtaaagcattatcggtactgaaatcaggaaaagagacggaaccattatattatactgggattggtcgtagtcgttctgactggcttattggcatgaatttttcgcgtctatttacgttattagcacagcagcaaggttatcaaggtccccctttaagcgtggggcgagtgcaaagcccaactcttgcaatggttgtaaaccgagatcgcgaaattgcaaattttattcctaaatcacattttgcattaataatacagttacagacgcaacaaaatcagtctttcctagcaaaatatattgtcccagaaaattatttagacactgatggactttgtttaaatggacagtttatacaacaaattagtgctgatattcaacgtctccaagctgctacagtaacatccgtagagacaaagcgtgataaaaatgcagcgccgctattatttgctttaagtgatttacaatcagaatgtaaccgtttatttggtatgggagcacaacaggttttagatattgctcagtcactatatgaaaagcataaagcaacaacctatcctagaactgattgcggttatttacctgaatctcaatttacagaagtacctcgggttttatccagtatagtgaaagcgaatcccaattggcaaaaaattgttcctctcttaaacttatctcaaaaatcacgagcatggaatgataaaaaaattaccgctcaccacggtattattccaacgatgagcacagtgaatttaaacgcaatgaatgaaagtgaactaaaagtgtatgatttaatttgtcgtcgttatttagcacaatttttgccattctttgaagtggataaaacagttattcacttgcaaagtggacaacatttattgctagctaaaggaaatcatgtgattacagcaggttggaaagttttatttggaaatacagatgaatctgagtatgacaacgataaccaaggacttccagcattaaatacaaatcaagtttgccaaattatatcaagcgaagttaaagccttaaaaaccacgcctccgtcacattatacagaaggtacattattgagtgcgatgaaaaatgcagcgcggtttgttacagatgaacgactaaaacaacgtttacgagaaaccgaaggtctaggtacagaagcaactcgtgccggccttattcaaggtcttattgataaaggcttcctgaaaaagaaagggaagcaaattctagccacagaacaggcaaatgctttaattgatagtttgcctgatttattgaaaaatccgggacttactgcgctttgggaacaagcacttaatcaaattgcagaaggttcaatgacacttttagattttatgaagaaacaagaagactttattcgtatgttgatgaataattgtctcaaacaaggaataaatctgggtaagattgaaattcgaaaatgcccactttgtggtaagccaatgcgaaaaattcagcatactaaggggactttttggggatgttcaggttatcctgaatgtcagcacaaagaaccagataaaaaatcagcaacatcctcaaaatcgaagaaatcatcttcggtcaatgtaactgaacaaattgctaatttgcgtagtctcattaagtaaaaattagttatgtaactattaaaacatgtattaccactaaaaataaaataattattagggtattaacatattaaaatggcatggaagtaatataataatagtgataccataataagcataaagagccgtttgtgaattgtcggttatcaattcacaacactagccgaaatgtctcccagcattctgagagggaactctgtgattttacaggaatgccacctaaacactggatagaactcttatactatcccatctggtcagcctcgccattgtaacgtcctaagtatatttacagaataagtgtaattatgacgttgcaatggcttgctacttattcttttcctgcgcccacaggtgaataaagggtgccctttgtgtccttgcgatgccaaagatttaccgattaaaggccactaagtaatcggataatttgcaaagaaaataaaagcacgtaacgaaggtgacgttattttctaacgtaatttatattggtctacctgtatatgattttattcattctatatagcccctcattaagttctatcttattgaggggctttcctttttgcaattctcggaaacgtaaatttaattagctgtttttttaccaagacaaattcagtaaattgaactcattaagtcgctgggaacagctcttaaaaaagtcgtaagaactcttgagaagcgacggttacccttgaggtaaaggagttcaatgccaaaatgtcttccagcattctgaaaggaaacactgtaattttgcaggaatgccacctaaacagcatatcaatttaccctagcggggaacgtttttcccgtgttgggcaaggatgtttctccgctttttttatctttggagaaacaaactatgactactcaaacttctactcaacaagcaaataactatttcgatcttcatactcatggcttaggctatttaagccgtattcgtgatgttgatccgaagaaaggaaattcatttatcgcttgtcaaattgctgcattagctggttcgagtgataagcccgaatatcgctattttgatgttaatgtcgtaggtcatgaagccgaaagactcatcaaaaaatgcgaaaatgcggttaatgcaaagaaaaaagttctcatttcttttgttattgctgatttatggactgatatatttacttattcaactgatagtaaattccataaaaaaggtgatactggtgtgagtctcaaaggccgtttaattcgcattaagatgattaaaatcgatggtgaattaaaataccaagaacaaccaaaacaaaataaacaagaaactttcgatgcagaataaacctaagaccaacaatttttgttggtctttctcattttaacatttacattatattaaatcccatagggaaacatggttccctttgggaatggtgtttccctttcttataggagaaataccatgacaattaacacttatgcaaaatttgcacctactgtttttgttgctaaatgtgccgaatctcacgaaaaaggtgaaatcattacattaacaagtaaatacggaaacgaaacagaggtagagatacataatcttgtcaaacaacaagacggatattatttttactcctttactcgttgtgatgggatgaatagccaagtgcgagcgactcagaaagcagaacgctatcaaagctatgcaaataatgcaatgaaacgtagccaacaatattgtgaagcagctaatgagggacgtgattttttgactctaggtgaaccgattaaaattggccaccatagtgaaaaacgccataaagctttaattgaacgtaatgcccgccggatggataaatctgttgaggaaatgcataaggtagaaagttacgaaggtaaaattgcttattgggaattaatggcagataaaattgatttatctatgcctgaaagtcttgaattctttgaatttaaattggcacaagctaaagaaaaacatcaagaattaaagactaatcctgataaacgaactcatagctattcattaacttatgccaaaaaagcggttaatgaacttgagaaaaaagtgaaattagctaaattactttggtcataaacattgattttacccttagggaatacatttcctaaggggatgtgttcccttttttggagaacacattatgaatcgtaacattgtgaaagcatcatctcataaactcggagctgaaactcgctctttactagttaaagcagaaattgcaaaacaatgcgtaatccctgaaacagtaaaacttggaactatttcagccacccgagcagttattgaactactaggtaagaataaggctctagagcttattcatcgccatgagtacaaagactatggtgatttagatgaacatgatatttatgcaaatgaattatcactattggtagggaatagaattgtttcaagctaccaggttgaaaatgagaagattttcattatcacagaagcagatcgtagttacacaacaattatgatggctaatgaatattaaatcagctttccaaaagtaccacacagcaatgtagtggtactttttctattttgcctaaattttatcttaatttgtaaaagaattttctattcaaattcaaggctaagttttacatagtgagatcccatttatggcaaatgattggagagttaatatgaataaacaactatcgctgaccgcactcttagctttgatcttaagtggctgtgtcgctaaaaacacttctgaaacagaaattaccccccttcctgagtttccaaatattcaggctacaaatacccacttaaaaccgatacctcctgagccagaagctagaattgttcagaatgatatttatcaatattacacaccgtctaacacagaagtaattcgtgatggtcgttatacgcttgtgaatatctcaccggaagatggacagaaattcttattagaacaagttgtctcaatcaatattcttccgaagaataaaagaaatctaaataaaagtgttgaacaaggtttacgtagtacattacagcataccggacttgacttatgttatgcatctggaatgaatgtagatcataatgttggtactcttttctcccgtccgctacctaaagtacattatcaatttggcccgatgaaactctatgaagcccttcaaatgattgcaggcccaggttatgaaatgaccttgaatgaagttactcggacagtatgctttaaaactcgaatttctccagtcgatcatcagaaaaaacctctcgaagaagttacttcgaccacaactacagaaattattgaggataaataatgtgtaattcaaagactcttttactatgtgtagggttattaagtagttccggagtgagttttgcaagtgtttctacaaccgtgaatcagcaatcattaacacagcaaaacttaaataccggtacgactacgcaacagaaatccatccaacaagcggctgaatggggcttaactacagaagaatggaatcgttatacggcattgatggccggcgaacgaggaatgtggtcgcctaatttagatccattaaccgctttaggtatcgaagcaaaaacagaagctgaaaagattaaatatgctcgcatgcttgcggaacgtttccgtgccagagtattaaaagagattgaattcgacaaaatttatcggcaggaatatgaaaaaatgtaccctgaagaaacggcgtttgcagtcgaacctcatatatcccaatctgtcggaagagttatttactttacacgtttagataattgtgcatcttgtaaagctgacctcagcaagatcttaaatcatgtcaatacccaaacacctatagacatgtttattgtcggcgataatgtttctgatgacgcaattcgcaaatgggcaaaagataatcatattgatgccagcaaggtacaacgtaaattgattacgctcaaccacgataacggctattggtttaaatattcgtttggcaaaatgcccgctgcttatcaagtgaaaggagacggacaatggcaagctctcacttattagtcacacttttagtgataggaatgacatctcagtcggtattggctaagccatttaccggctttggtaatgatgtagacagctatatccaaactgcagcaaatcggtaccaagtcagtgaaacaatgttacgtggcttagtgaaaatggaagatggttggttaaataaattatctcctactggagcaactggcgttggtcaatttactgtaggtacttggaattggttagctgagagagatgaaggccgagctcttggaatggttcgtgttactgctcgtagtcgaggtactttagctgatcctcgccgtaataaacgtattaataccttagcaattggagctttggctagatggcacatcgcacgctttcaagaactaggtattcgcattacagatgagaatctctatatggcacataatattggattagagggactacatcgtgctttggtaggtaaatcaacaaaagaagacattcgtaatatgcgcttaaatggtatgaaacgctggatgacggttaatgatttcttaacctatcagaaaagacgttataacacacacaagtttgaagcaaatttcatgcaaactgcacaaaaatcttcgcctctaataaaatctagcagacctatgaaatgggttgaaccggtagctatagcaaaaatacaacccaaaccaagaaacgaaactattatggtaaataatgtatcttcacaaatgaaatggattgagcctacaggctcaatggtatggatagaaccgacacattaaggaatttaataatgaaaaaagtgatatttatgcttattacgttaggattgtcttttaatgttttagctgaaaatattgtgattgcagattacggtggggaaagtacagtacgtttttacgaatcactacaaccggaacatgatcaaaatgcgccccattaccctaatgcacttccttctagcgtttctgaattcgatatacttccggttgtgtcacataaattaacaccaggtaaagttgaaaataaagcctttgatttagcaggtattcagccaatttttcttattggcacagataacttatctcgatactggataacagataattatcaaaaattaatgcaattgaatgccacagggttagttgttaatgtggatactcagcaagaattaattgccttacggaatattgctcctgaattacgcttattacccgtatccggtgatgatttagccgaacgaattcctttatctcattaccccgcattaattacagaaacaggagtatctcaataatgacaacgaagcatactttagaggcattattacgccctccggttgagtttttcccagcgactgttcatgcttgttgtgcattggttagtgccactgcgccttggtcattagcccttcatcctagcattggttatggtattgcagcaggttttggagcattaagtgcttatagagccaaacaaggctggcgcatcgtcaaatatcatcaaaatttgaaacgactaccatattatgcaatgactagtcgtcaaatacctgtaagttctaaatttttatttgtcggcaaggggtttgaatgggagcctattcacacgcagcgtttacatgactgtttctcatcaaatggttccaaataccgtaaaccgtccaaattattccaacaagtacgtgaatatgaaaaacgccatgaaaattggcttactggaattacctctttagattcaccttggaacccttttagaccgcttcccccagtagagggtattccagctattcatgggattgagctaaatgaagtagatgttgttcaagctatcagttctcgtgtaggacatacggctgtatatggtacaacccgtgtaggaaaaacacggtttgctgaaattttagtaacacaagatattcatcgaggaaaaaaaatagaagaacgtgaagttgttgtattttttgatcctaaaggtgacgcagatatgctgaaacgcatgtatgcagaagctaaacgtgcaggtcgagaaaatgaattttatgtttttcaccttggctatcctgagatttctgctcgttataatgcggttggacgttttaaccgaatttctgaggttgcggggcgtatttcaggacaacttagtggggctggcaactctgccgcattcaaagagtttgcgtggcgatttgtcaatattgttgcacgagctttagtggaattagggcaacgtccagactacgtacaaatttctcgctatgtgcaaaatattgactcattattccttgactacgctaaaactttcttcaataaacaagataagcaaatttggctgaagttatcagaaattgctgcgaacgttgatgaaaaaatgctaccgtttggaatgaaagatcgccctttaatctttatcgtaaataaatatattagtgagaatgatgttttcgacccaattctccaaggcttagcaagtgcggtacgttatgatcgcacatactttgataaaattgttgcctcattattaccattactagagaaattaacgaccgggaaaattgctgaattgttatctcccgactattcaaatatccaagatgaacgtcctatttttgactgggaatcaattattcgtaaacgtggtattgtttatattggattggatgctctttctgatgcaactgttgcggcagctgtaggaaatagtatgtttgccgatctcgtttctatggctggtcatttatataaatttggcattaatgagggactccccgaaaaattaggggggaaagtaaaacaagtaaaaatcaatctacattgtgatgaatttaatgaattgatgggagatgagtttattccccttatcaataaaggcggcggtgctggagttcaagtaacagcgtatacacagacgctctcagatattgaagctagaattggaagtaaagctaaatcaggacaagttgtgggtaactttaataccctatacatgttccgtgtgaaagaaccggcaaccgccgagttactcacaaaacagctccatgatgtgactattctacgcagtactgttacgtcagcaacgacggattcaagcaatcccgatgatgataaagccttcagttctaatacaggacaacgtatttctgaaaccactgtaccaatgcttgtgcctgcaaatatcactaatttacccaaagggcaagcctttgctttaatggaaggcagcaagttatggaaaattcgtatgccattacctgcagtggataaggatgatgacatgcctcattcattgaaggaattaacagagaaaatgaagaaaaattatcatgtaattgataattggtgggaaccagcatttacggaatatacgccttcaaaagcaatcgctgaagcctttgaaactatggctggtgaaaatagaatcaatcacccagatcatgctaattatgattttgatatagatgtaccaaatgacaatgacattgaagaagaggaactccaagatgacgatgaataatttacccagtaaaaatggaattaatttattagatttaccgaataaacgtatcaaatttgatggcccattttttatttcttgtgcgttaccacagtctgatgatttgttgatacattgccaaccttatattaatgatttatttgagaatcgtttctcgcttcatcagttcgctgaaaagtgggagacagatggtatttctttatggttggctcaagatgttgaacaatctgaattggaacaagaaggaaagatatttgccttttatttgatgttttcaaaaggaatggaaggctatgttcttatccaatgccaacttgaatcacaggatttattacaatgagtgagaaatctccacctaaaccacgaaataaaggcatatttagtcgaatatgctcacgcatcaacatgatgattgcaacattagtactttcacttttgttaagtatcttattagaatgggttggtattactttttggtggccagaacaaggacatttacatagccaaaatatgatgctgactgaaatgcaatggttatctgatgatttcacccagagtattttcacgcattcatctgctgatttagcgacaaatattatcggaaatatgcatcattgggtatttgtagagaccggaatccaaggttggttagcaaatcctggttcaaatcaatgggaacaattgatttatcattatggtagagcttatatagaatcacttatctacgtttttatcatattcttgatccgattaattatcattgtttttacaagcccattatttctttttgccggtgcagccggactcacagaaggattaatgatgcgagatatacgtaaatttggtgctggtcgagaatcggcattcatttatcaccatgctcgtcgatatgtgatgccgttaatgattacttcatgggtagtatatttatcattaccattttcgattcatcctaatattattttagtaccttccgcactgttatttggtctggtcatctgtattacctgcgcaacatttaagaagtttttataattataaggagaataaaatgactgcaaaaagatcaaatccattgttttttattacatctgacggcggaatacaaagagttatagatgtaaggaaaataatatatatagattataacaataataaattggtaataaaaaccgtttcagaaaacggagacatggacatggggaatatacccgaagaaagttataaagcactcatcaacttctggagtgaaacgctcagttgtcgtgactaagtaaattatttctatacaataatatcgcatattaaataggtatcttgctatagatacctattttttattcttctatgatgataaatatactctcatcagtcttagtttcatttctctgatattcattcaagtcatgttcttggcccaaatcgcttccttgttcatattcatcaaaaatgacttctccatactcgttaaggtgagcttcaatgatacttcgctccttttcacctaaaaattgccaataattgcaaataggttgcccaaacgtattcatttcccatattccagcatagttataaggcgcatcttgagcatggcaaatctgcccttctctttgagcataactaaccgatgggaaaatgaaaaagcctaaccatagataaccgtattttttcatttcaatagtaagcccaagacattcagtatggttaatttacaccaatttatctaactcaagcacgcctatttattctccaaaccctgagagtttaatgcacagaatctcttttaatttccaatagagttttccattaaatttttactgtgattttggcaatcttagctaggagttaaattaaaacatgaggagctattatgtttgctaaaaagcatcttgggaaatggatagtaattgttttagcctcaagcagtataactgcttatgcctcaacagaaaaagagcaactcgctcaagctatcaaacaattggaagcagctgaattatctttaaaaagagctgaacaactttctaaaacttcacccaaaacacgtgaattcttcaattacactgcaattcaccgtgatataagcacgataaaaagtggaatttctcagtacatcaatcctgctcgagcgataccaagagatccacaagcattacgtacattaactgaagattacaccaaattacgggggaaataatgacaacccctaattattcctccgctagtgctttttcagcagcaagtggtatcgatcctactcaacttcgtgttcttttatccattattttcgtcgctgctcttttactcgcttatgcttgggcaacacatagtggtttcaaaggatttgcaaagtgggacggagatgtcctctcttttttaatttttctcttaaagggtgcagttctcatcatgtgtgttgttacctttttcatttattagtctaatcaagaggttttactatgaaaatcatcaaatcattctatcaatcttgttcttctcgatatttagcttttatgctctttttctggggcagtattcaaaatgcccttgctgcgccagcaggagggggtggaggtggcactcttgacccaagtaaaattcctgactttaaaattccaggggttgatagcggtacaaaagatcctacggaaattattgcgcttgttgctaaagctgtcgctacattaatcgctgtattgcttgccgccgctgctatttttgtggtggtgaaagccctaatcagtatctataacgaagccacttctgacaatggtaaaaaaggttgggggcatttcattcttgcacttattgttggttttatcgtgatcttcttctccttatggttagttaaacttgcagtaggtctcttctaatatcaatgtaatccatataaggagccaatatggctgataatgaaaaaacaattccctttttaccaattcgtttaaacaaagaagctacagtatttggtggaatgactgtatcagaatttggaatttctgctgcgattgggtttgtcatcggtttaattattggtctcctcttatgggttttaacagattggtggctacttataccggcattaggaatgttgctatgcatattaacggtattaatcggaaaaggaattgtagctgcattaaaacgaggaaaaccagaatcctatttaaatcgtaagattgaagaaaaattggatgaaatattaatgggtaacaaatttattcgacgtgaaggtgtttggtccattcgtagacaaaaaggaaaccaaaaatgagtcatttaaaaagtcaattacatgaaaaagatcgccatattcgaacagcacaattttttgccggattattttttatcgtaatactggtgctttcatttgttatctataccttcccaaaccgcttaaatatttatattccacctgatataagagctgctagccaacgcccttggtgggatgtacctaattcaacagtctatgcctttgcttaccaagtattccaacaattaaatcgttggaatgtgaatggtgaagaagattatgaaaagaatattaccgcattaaaaccgttacttacaccgaactgcgaagcatttctacgacaagattataaagatcgcttacgccataatgaattacgcgatcgtactcgtggtgtttacgaaatcgtaggacgaggttttagtgaagataaagtaactatctatagcaaagatagttggggagttaatttagatctaagtgttgatgaatacttcgaagatgagccagtaaaacgtgtctttacgcgttttccaattagtattgtgagaatggatattgattcacaacgaaacccttggggattaggatttaattgctatacatctattcctcaacgtttagaaggtattgaaaatacagaggggaataaataatgaaacgcttatctctatgcctattatctattttagctgtaggtacaactgaacaggcttttgccgatattttgcaaaaatgggaaagaaaaccgattccagttgctttacaagtaaaagctgaacgtatcatttttatggataaaaatgtcaaagtaggttatcccgcagagcttgaaggcaaagttcgtattcaatctaccggcggcgcagtgtatttaaaagcactcgaaacatttccagcaacacgttttgaatttcgtgatgtggtcaccggtgaaatttttctttttgatataggggcacacagtaaagtcaataatcctacggaagcgattaaagtaatatctgatagtattgttgaaaaacagtcaggttcattaaatcaagatgattatatagccaatgatgaagtagataacaaaataccacaacttccaattcctgcagcattgacacgctatgctgcacaatcactttacgcaccattacgcactgtagaacctttagatggagtaagacgcgttgcacatcgtctacctgaaaaaattaccacattacttcctgcttatccgattacagccaatcctttaatgagctggcaattggataactatgtagtaactgctatccgtttacaaaatcgtggtgtttcacggattatacttgacccaagagagttacaaggtcgcttttatgcagcaacttttcagcataattggttaggtggctatggtagtacggaagacacaacgactgtctatttagtaacggaaggacatgcaaataatgctgttattcctgaaacaaaaatctacaaagcccctaaaaaggtgaaaaaaacgacggtaacaacaagaaaaacagttacccctcaatcaactaaataggaggaactatgcaagcaaacaaagctctttatgtcattgtttccattgtagttaccgcagttggtgcaatgggatggtttttattctctccctctaaatctgaagtcgaacaacctaaacgtgacgtacttgatatttctattaatgatcttacaccggaagaaattagagcaatgggtattcaaggcgatactccgcaagataccttacgtacgctcgtagctacggcaaaaaataatcagaaaaaattcgatcaaaccttaaatgaattagataaatataaacgtgaaaatgaacgtttaacacgtaaagaagaagacacgaattatcaaatcaatgaagctatccgtaatgaaacacagccattattagctgaaattgctgagttaaaacgtcaattagtagaatcagtagagaacgctaataacataacaggaaatagccaaaataatgatagtactcaaaaaggttttggtcaggcaaataataatttacctgttaataatggtacttatgccaataatggtgaagtgatattagaacctggtattcgatgggtggaacctagcgatcaaattggattggattcaaatgggaaacctgttgcagacggcgcaagagcaaacagttttggtttcccatctcagttgaaatctgatgaacaatcaacaggacaaaaaaaaggattaccatttcttaatggtacggatgaaacgacaggtagtgctaataaatcaaatataaaagcaacagaaaagccattttatacattaccagaaaattcgactttattaggttctatttcaatgacggctttaattggtcgtgtaccaataggtaataatgtgacggatccttatccatttaaagtcattattggacgtgagaatcttattgcaaatggtcttgaactacccgatgttgaaggtgcaattgtatcagggacagcttccggtgattggacattatcttgtgtacgcggtgatataaaaagtatgacatttgttttctctgacggtcgaattgtgacttcatcacaatcaagtaacaagagtgatgaaggcattggttggatttcagatgatagaggggttccttgtgtacctggagaacgtaaaactaatgcacctgaatatttaggttctaatttcttacttgctggagcgagtgctgctgcgcaaggactctctcaagcacaaacgaccaccgtagtagatggtaatagcgttgtcggtgccgtaacaggcgataatagcaaatatattttagggcaagcattaggtggaggattaaaagaaaccgcagactggtttagagaacgctacggtcaaatgtttgatgcaatctatgtgccaccgggtcatcctgttgcaattcatttaaataaagagatagcaattgattacaacaaattaggccgcaaagtgaaatatcgtgtatcacaatcaacaccacgcctagattaggagaaatataatgaaagcacgtattggtattctatttttaactgctttacttactggttgttcaacatcatctgaagatttacttcctacaaatggacattctatacgtgatgtttgggataaaaatgcaggaagtgggcaattacaacaatatcgttcacaagatagccgtttaatcgatcctgtagattatatctctaataccgagcagcgcagttatacgcgtacagctgaaaatgaaattgataatttatttcctagactacctaaccctgatttagtgatgtatgtatatccgcacctttctccttctggtgaaccaatgcctatccccggttattctacggtaattcccttttacagtcgggtgcaatatgcacaaccgggtgaacgaacaagaggactataacaatgtcttttttaagtgaagtactctcatcatttaaacctagcaaggctgttcaaggtgtacaacacgtagatcttgaacccgagatgaataaccaagtacaagaatctaatactatacaaatgcctagaccaattcagcgcagtggcaagatttctattaatcagcacaatcagaaactatatgggcaagctccctcttttgtggatcatttaccttgggctgaatttctcgatgctgaaggcgtaatgttacttgatgatgcgagaagtgtgggagctgtttttgaaattaaacctattggtacagcaggacgtgatgaaaattatcttagccgtatcagaaatttagttaaagatgctctacaggatagctttgatgaattagatacaaatccttatgttgtgcaattcttctgtcaggatgatgacgatttacaaccttatattgagaacctacgtaattatgtcacaaaagaggcaaaaggaagtgaatttactgaagaatggttacgcattcaagaaaagcattttaatgatattggtaagccaggaggcttgtttattgatgatcgtgtaacgaatacagcttggtctggccgtattcgtcgaacccgcatggttatttatcgttatgtagataaaaacgatgaatataattccattgagttactcaataatgcttgtgaacgagctaatggtgctttaactactgccggattacaagtttccagattgaaggaaaatgcaattaaagaatggcttttacgctggtttaatccaaatccctcagtaaattttgaagggttaagtaacaatgaatgttatcgttatttaaatagcaaccaagtcaataatgacattcctcttgcgtttactgattttagtgagaatttattttattcccaaccagaaaataaaggggaatattggtattttgacggtcagcctcatgaagtcatcgtagtaaataatttacgccgtcagcctgatatagggcttatgacgggagaaattacgcgtggacgcaatattaatgcgctttttgatttgttgccagaatcaaccattatggctattacaatagtagtacatccacaagacaaattagaagcacatttagaaaaacttagcagccgtgctgtaggtgaaaacttcgaatcacgttatttaaaacaagactgtttgaccgttcaacaatacctaaaggaaaaccataaattataccaagcaagtattgccttttatgtacgaggggaaaacgaagcacaattacgcatgcgatcacgtaaattacgcacaattctattaagtaataaccttgatcctgtaaaagaaaatgcagaagttgccccgctaaatagttatttgcgctggttaccaatgaacttcaatccccagcttgataccaaacattactatactaaatactattttgtgcaacatttagcgaacttattacctgtttttgggcgagataccggtacgggtaatcctggtattacctattttaacagaggcggcgcaccatttgattttgatccattaaatcgaaaagacagaactaaaaatgcacataaattattacttggtccaacgggttcgggtaaatctgcaacactttgtgcacaaatgtcacaagtaatggcaatacaccgccctcgtctctttattgtggaggctggtaattcctttgggttatttgctgattatgctgagcgatttggtttaaccgttaatcgtattacattatcacccaatagtggcattgtattaccccttttttctgaagctcataaattattagatatggaacttaatcctgaagacgttccagatgattctgaagatgacgaagatgagggagaagaacaacgagatctactcgctgaaatggaattaactacacgtctaatgattacaggtggcgaaagtaaagaagatgagcgaatgacccgggcagatcgtgccgcaattcgtaaagccattattaatgccgcacgtaaagcaaaaaatgaaagtcgtcaaaccttaactgaagacgtaaaaaatgccctggatgaattaagcaaatcggatgaagttcgaaaagaacgacgttctcgtttagctgaaatggctgaatccttagaaatgttttgtaccggagtaaatggacaattctttaaccgtgagggggaaatttggccagaagctgatattacgctggtcgatttagccatgtttgcacgcgatgggtatgaagccgaattatctatttcatatatttcattaattaatcacattaatagtttaggtgaaaaataccaacatagctatcgcccaatagtgaatgtgaccgacgaatctcatattattacggtcaatccattattgtcaaagttccttgtaaaaggttctaaaatgtggcgtaaattaggtatttggttatggcttgcaacacaaaacgtagatgactttccaaatgaagcaagtaagttactcagtatgttggaatggtgggaactattgaatgtgacaaccaaagaaatcgaagatgtggatcgtttccggaaactaactgatgcgcaaaaaatcatgttatcttcggccaaaaaatctgaccggaaatacactgaaggcgtggtgttatcaaccaatatggaagcattattccgagttgtgccagcaagtattttccttgcacttggcatgacggaaaaagaagaaaaggcagaacgtagacaattaatgcttaagcataactttagtgaagttgatgccgctttggttgtagctaaacgaattgatgctgcgagaggaatcctatcatgaatactacactacaaccggtctatttatttgatgctggtcctcaaaaagaaacattaaatatctcatcaccggaaatattagagatgctccaagcattcagccaaacaattacgaacaaaatagggcaaggaaaatcaatcgttgtttatccgcaccgtgtggttcgtcattactgggggctggagcttgaaggagataaggataaattacctattctactaaatattactgggcgttttcgattaccacaaattaatgagaaacaatggcccgctcggctgactattgatgtagctgatcatgtggatgcctattggcttactatgtttttagcagaaagccttcatttaacgatgtccgttttgtctacattaaatgggcataatacggtgtgtaatgtggaggaacaaaataatgaacccggttaaattaagcattaagcgtcaatggctaaaaaacacactaaaagtattatccattattattatcaatattctagttattttgtttaccagtagcctgataatgaataataccggtatgtttaatgtagattttcaatcgtggttttatgatacccgtttaggctggtttttatggcgaatagtgctttataccatagtgttagctcttatgtttgcggtaaataaatatgtgcatttatctctcaaagctaaactactcattgcatccagcattatcctgattgaaggattaaatctattttatcttctgggctaatttaacgggagaatcacatgacatttacggttgatagttatttagaatattttcttacgctacttgcgtggattatcaataacaatatttttgcggtattaattcagacaggcatattcttaattccactcattgtaattctgtttaagacttttattgatgtgaaaaaacaaggtgatgatgaaggaaataaaggtgacttacttatccggtggctagggttacaattctttccgacgatgtttgttattgtcattgtactagctccaacgcttccgattcaattaaacaatattgaattgaacgtagaacaatcgaaagcttgcggttaccgggtgccacaagctcctcaagatagtggctacggtgatttaacctctgagttaagtggtaaacaagctaaggtacccctatggtggggatttttccatcaacttaataaagggataacacacgcattagttgccgcaattccgtgtaaaccggatctacgtcaaatccgtttcgaagtacaacacgagaaaattaatgaccccgcattgcttactgaattacgtcagtttgtgcagcaatgttatattccggcgcgtcaaaaactacagacgagtcaaatttcattaagccctgctcaagttcgtgaagtaagttggctaggaggtaatatattagttactaatagtgaactatatcctcgttatcgcgcacaacaacctaataatctatgggcgtatgatgccaaacgagactcgggattgcccaatacagggaatggagggtttccagcgtgtaatgaatggtgggctgaaaataccattggactaaaatatcgattgcttgctgatatgagacaaaatttctcagttaatgtccaagaattctttagtaagaaaaatggtgcagaagaatcattactacgtactctagtaaggcctgaaaatttgaatgtatcttcagggaaaatctatcctggatatggaggtaatttagatcctacatttactggtgcagttaatcgtttagttgcatcagctgggtcagcagtaggaagtattggtattttcccagcattagattcgatgcgacaagctctaccaatggttcatgcgtttgcattaatgtcagtggttattctactaccacttgtcattgtaatgagtggatattcattaaaaaccgtgatcacattaacctttgtacattttgcattagtagctttaacattttggtgggaactagctcgatggctagattcttggttattagatgttctgtataactcagcaacccataatagtcttaatccatacttcttagaaaatacagaagatgactttattgtgaattttgtaatgggttctctattcttagttctaccggcgatttggtttggggctatttcatgggcgggaatacatataggagatatggctcagcaaattgctaatggaaccagaacatctcaaacggcaggagcccaaggtggtaacttggtaaataaagttaaataaacgctaatgagatagagatatttctctatctcattttataaccaatccttatctgtattttcaggcattttaaatccgttagcgtagaacccttctccttcaggaccagccgaataaaaaccatccttaataaactgataagattcttcatcgtcatgatttacaaagttattgcctagttccaattttagggactcatctctacatccatcaaactcatctaattcatgagcatggggatttatatctgaagtagatgaccaatctcttaatagtaaaactgcaataacaagaaatggaatcccgataatacacacggcagaaagaagtatttttctcggcaataccggtaagaaatcaagtttattatcaataaatttagctactttagcaaagttagcacctaaatcttggaatgtcatatagacctccttattcgctatatatgactaacaatgttgattaaatataagcctaaattaaagataaaatcaacaaaatttactcaaacgtaaaaaggctaagtaagaaacttagcccattattacctataattatagaatgttcattttactgtattcaaaatgttgtccaacttttttattggtatcacattttatttcagttgtattattaccttttgtaatatacaacattggtgagtcaattacattggttcctctaggttgtacgaactcaatagtataagaatgactcttacttttcatttctaaggcacttgttgtaaaaccagagcctgtcgccacataagaaccttcgtttttcagtacttgtttagctggattcttaaataagattttcccatatgaaaattgatagtctgcgccagttttttggatcagaatttgattaccgtcttctgcagtacaagaaaaaattgagatattttctgctaaaaccggtaaagatataaacgagcatactgctaatgttgttaatttacgcataatgtattccttctaccataattatgaaccacttaagatataatccgcttcttgatttctacgctttgcattaatgccgttattgttagtttgacgtttcctgacagtattagctaacactgacatatctcccgagcttgcagaaactcttgcagccttaataacatcactagtcaaagaaccgtagttataagcataagaagttagagctgcttgaacacttggagaaagagagtcccaagtggatgacgatacttgctttcttgccgtgtctgcaaatacttgcgtgcggcgtactaaatcacgttcagcatcctcttttgtaataatagtatcttttgtcacttttacaactgttccatctgcacgtgtaatagtatctgaaccatacccagaacgataagcattcacgtcccaatatgcctttgaactaaaaccttcaaaatgtttaagtaactctgttgcttgttgtagagcagttcctgaaattgaattaattttagagtacgaacttcctaaattcgcactactggagttagtattgagtgatggtataaatggagccacgttgcttgtacttggaatacctaaagtaatcatttttcgtggcaaagaaatattattttcttgttctccgtcagctggcgatggagttccgtactctaattctttaacacgtttatccaagctatctttcggtaaactatacgaaccagcatgtgcttctctttcagctttattttgtaatatagttgcagcagtattactagtaatcgccttttgcatatccatttcaagttttacttgggatatttctcggtcgataatgtttaaaatgcgctctaactctacctgtgcatctgcattattggccacattgggttcacgcataccagctaaaattgcacgtcgagatagcatcattttttccatgactttcgaggttgcaatctccccagagagtcgttggcttaatacttccacatcaggatcttcacgtaatgcctctattaacccgcgtgtaacaggtacagtatttgagctaagttcagcaagaaattccgatgtgggtgtactcatattaagtactttttccaatttaccgatagtaagtacatgttcctcttcaatttccggacttaatcctacacctgctttcgcgctcgttttcgttccacaatctgttttacaagtcgaaattgattgttcaccgatcacttttgttaaaaagtcagcagcagtctgtgggttatcccacgtcttacataaattaccgtcacataaagattctgaaatttttcctgtatctaagacattgcgtttatttagcaagttataaccagcttttaccacgtcgcccactaaattgattggctcttggttttgtcctccttttttctgccctccaatccaagcacgcccttctttaccctgtttgtcttcaagatcttttttagcttgcttagcatcaggctgggttgaggtaatatctttaaaactttctaaatctgcagcttgcccccatttcccgcctaacgtatagtcagctaacttttgcgacatatcttcacagctagttttaagacgattgaagtctaatttcccttgatatacaccattagtaattaaatcataaagttgtggattggcgcgttgaagcaccattgccggcatacttgcaacagcacctttcgcagaatcaataacatttcctaataaatctttaaagccatctttaagtccatttaaatcatttttaattgtggttttaatatcaaaattgccacacattaaattagatttccaaccaacacctaattcgactgcattagtttttccacgactaggtggagccatataacctgcaccaccaccgatttgataaaatactttatccgacaaaatagcatctgatttgctaaattctaacttatctgtaatggaattcgcatttgaagtattaaggcataaacagcctaatactaaaagagtaatatgattgagtgaaaatctttttgtcatatttgtttctccttcctaattatcgttgccagtcaatactatataaaaatttctgacctcttcgcttacagcaactataaggtcgccaaagtgcccaagaataatcacctttcactgacatttttctagagtgtgtttctacagaacttccatgaggaaatacagaacaagatctttccatcttaggatggagcatctgccatttatgtgtacgggaattactttcttctactgctccaggaggccattcgccggcacctccttttttagctgcaggtaaataaatgtggggttgtgccattcgactaacaatatctgcaacacgttgagcaataactgctgaggctttgtagtcatgaacttgattaatcgcaccggaacgagggtagatatttccccaatgatctcctgcttgattaacttctctcataccaggaaccatcgcctccggataaaacatttctggtaaattctctttccaagcaaagaaatctaatccacttaagaagtaaggaacaaaaggtgtagtttgacttttgcaataatatcctgtgctatttagcacctgagatattgctccttgcggatgaccaattgcatcggcattcttaaaagtaaactgagtgtattgtttatgtggagaacgatattccccacctttaacagccgttttattgaacgaagaaacctctgaccagggattctgaccatcatggttgtagctagagacaaccatttctggaatgtagtgttttactttagtagatgtacgaatcgtacaaccaaactttgtgcaaaatagccaaaaacatgtacctaccactttataatccaaacaactttttgaagcactcgaagccataattgatgcggtattaatagaggcttgagcaggaataaacgaggtaataattgctgccgaaagtaatttaactaataaagtacggttaaatttcattgtccctcctttctattttggaaccattgttcccacaacttttttgctttcgctatattcgtttctccataaataacagaggtttctccagtagaattctgaaatagaacagcaggtacttttttaataccgttttgccaagcactaattacatcagtataagcatctttgataagggcttccttttcagcccattgtggcgaattaaataatgctttagcttgctgttcagccataacaggatcatgactaagcccttgactaatgacattttctatattcgttactttatcaagataatagacctgagtagccagttcttgatgggtgagatgatatgatgatgtggtgtagacagaaataataggttcaatatttgccatacttagtggggatattccactcccaatcaataatgccaaataggaataaaagttatatcttttgttcacactatagacctctcttagatagccaatataaatgtgaaagttagcgatattttaaccaacgatacagaaaaaactctgttcaaaaataggagatttttttgtaaaacatcttaatttcttaagcaaaaaatatttccctttttataaaaaaaatcgtatattgtcattattaagtcgctgggaacagctcttaaaaaagtcgcaagaactcttgagaagcgacggttacccttgaggtaaaggagttcaatgccaaaatgtcttccagcattctgaaaggaaacactgtaattttgcaggaatgccacctaaacctatcaccttccaagggaaaacgcttccctggaagtgttctcctgaggatttttttattaacttaggagaataactatgactctcaaatctcaccctgaatgggatattatcccatttgactctcaacctgccgcagcacaaacatcatctgtattttggaaaatagggaataaacttggtaatctttttgtatctgcgagaagacgagttacctcaaaatatcgcgaggttacaagcggtatcaaccaaaaactagatgaagaatatgaacatttaagggctgaatttgaagcagatctctttgctcaaaccgaagcattcgaatgtgaactcaaagcacagcgcaaacattggattggtatttctattattaccactctagttggctttttaattggcatgttgataacctttaatctcatgtaatttctattaacttatcccatagggaatactatatctctatgggattagcattccctttttttggagaaatgcaatggaagttcaaattaacctcaacactgtatcaggttttatccctaaacattggactaggaataatcacgtgatgctatctcaattacataaagatattactcgtaatgcaattcaatcttggcaaaagcgtaaagaaggcgaacagaaagtacgttttcttcaagctatgccagcaactcatggagcacacttccgctttatgaatgtgcagcaaaaagatgaaaagacattattagttactattgattaaacttttaccccataagggaaacacctaattcccttatggatgtagtgtttcccttttattttggagaaacactatgaacgttttaaccgcttattttaatactcaattagtaaatgctggttttccagatgattttgaaatcaattggtccttaggttatagccagggcgatggtatggctttttatggaaacatggaacatacctattggttaggattgtttcaacgcatttacccaaaccaaaaacgcaaataccagaaatttgaaagactaacaagatcattgattgagtggcaaaactacggggataacttgataagcataagacgaaatcactttggttatcgttattctcactttaacacgatggatttgcatgcaccaagtgccgcagattttcgtttctttgatgaagatgcaaaaaaagattggtatttcccaacctataaagtcggagaatatcaagcactatgggatgaatttgttgcggatttagcggaatatattcggacttgtcgaagcaattagcacaagaaggttatcgaattattgaagcaacgccgtatcagaaagaagtcgcttatcaattcgaaacacagcattatcgaattgaatttgtaactgagcctcatgaattttatgcaaatcattttgaaacctatatgtatgattgcgattttgaagatgttgaaagcctttgcaaagcagcattaaaaggtatcaaaattgctaatgtctatgctcaagtattggacaaagcaacaggaatcgctttaggggaagattactttggttatttagcttataacaaagaagataaaacctttggaggctaccgctatattttgattcgtgaagctattaaagcagctcgttcaaaagatggattgattagtcgtcaagcacaattaatgcaaaaatctctaccacacttacacttaaacacaaacgggaattaaacaccgtttcttacccattggggaatactttcctcaatgggagtgttctccatttttattttaggagaacacattatgaacactcaaactcaacataaacctgacttataccaagaaattactaatcgcattattaagtgccttgaagaaggaacggttccatggctaaaaccttggaataatcctgattataaccttgcactacctcaaaatgcggtatctagccgtcactattcaggaattaatattttattgctatggatagcaagtgctgaaaaaggttataaacaaagcaaatggatcacagcaaaagctgccaataaacttggtggtcgcgtgcgcaaaggagaaaaagcaacaattgttgtaaattacaatccgattgatcgtgaaaaatgtgatgatgaaggtaatccaatcttggataaagatggaaatccagaaatggaacattttgctgttttaaaaagacatcctctttttaatattgaacaatgtgatggacttccgaccacaatgtatgattctgtgtcagttcaaaatgataatgctggctcagcacaatacaccttatttgctgaaatccggcaaatgatcaaaggaatggatttggaagttaaagtcaagccaagttcgcgtgcattctatcatcctatagaggataaggtagtcatgccggaaatgaaacaatttcattcagaagcgggcttttatggaacattacttcatgaaatgacccacgcaacaggccattcaaaacgcttacatcgtgaaggtattacttccggcaaagcaaaatttggtaataaaatttatgctttcgaagaactaatcgcagaaatgggtagtgcgtttgtttgtgctcatttaggtttcaatgaagttccgcaaaatgcagcctatattgaaagctggattaaagtattgaaggaagacaaacgagcaatatttaaagcctcaggatttgcacgtaatgcgtgtgaatacatgatggatgcactcaatgttcagcagcaatacgaaaaattctttgctgaagcagcataataaaaaacaaaatgccctagattaatatctagggcatttttagttagcgaactttacttcttcatctgttctgcaaaagttgatagttaaattttccatattgtactcctattcaaaacttataaataatcgcataaatcatacctgctacgcacatatattctaccaataactatgttctttttatgcagagttttcaagccgtttcgaaagtccaaaaaacgaacgtttttttgacttttttcgaaaaacaaaaaagtcttcattttcccctctattttaagttcaataactcagttcaaaaatcaatgttcaagaatttatctgtaaattgggtttttatactatatggatgttattttatgttaattggctatgctcgagtttcaacagaagatcaaaatttagagcttcaaattgatgccctcactaaagtagggtgtgaaaagatttttaatgataaagactctcgtacttcatttaatcgcccaggattattagaggccctcgaatatttaagagaaggcgatacattagttatatggaagctagaccgcttaggtggtaaaactaagaatttacttgaactttttgattctctgcaacaaagaaatatcaatttaaaaagcattaaagattcaattgatacaggttcagcaattggtaaattattttttcatttcagttctgcattagcagagtttgaagttgatatccttagagaaagaactcgggcaggcttagccgctgctcgtgcgcgcggacgattaggtggaagaccaaagtctcttaatgaaaaccaaaaacaacaagcctttgacttgtattacagtaaaaagcataccgtaaatagcatatgtaaaacgctcaacatttctaaaggaacattttataactacctgaaacaggaaaaagacttaaacggcaaaaggataaaggaaagcccctaagggcttttaagggtaacctttccaaggggaaaggtcttacccaaaaaggcgaaaaggccaaagggcctattcttccactacatcatagagattatgttatgctaaaaatgttcactaaacttttaaaaaaagagccttcaccattacctacatcagagccagataatactcatctaatccaagacaaagatggttggatttatcctagaaatgccaatgaattacttagtactgatttacgaaaaaaataccttggattactttggcagcaagtttctatggatagaaaaatgtttaatacactttatcagaagccaatagaaaattacgctgagattgtacagttattacccgcttcagaagcccatcatcactcacatataggtggtatgcttgatcacggtttataagttattgccttctctgctaaattgcgccaaagctacgttttaccaccgaatgcagctccagaagatcaatctaaacaacgtgatgcttggactgcggcagctatttatattgccctagttcatgatattgggaaagttattacagacattgaaattattctaaaagatggtacacgatggtttgcatggaatggaataccatctcaaccttataaattcaaatatattaaaggtagagattatgagcttcaccctgttataggtagctttcttgcaaatcaattaatcccgaaatcagcatttgattggattgcacaattcccagaagtcttatcatcattaatgtacgcaatgtccggacattatgataaagcaggattattatctgaaattgttcaaaaagctgatcaacacagtgttacagttgccttgggaggtgatgtaaataaattggtacaacgccctgtcaattcactagcaaaacaactagtcatggcattacgctatttattggaacacaagattaaacttaatactcctaaaggaccggctgatggttggtttacagaagacggattatggttaatgagcaaaactactgctgatagtattcgggcttatttattgggacaagggatttcagtacctaaagataatggaaaattatttgatgaaatgcaatccctagggattgtagaggcaacgactgagggaactgcaatatggcattgtcgaattcaggctgattcgggttggactccgccgtcatcatttaccttattaaaaataaagcctgaagttgcttgggaaaatgtcagtgttagaccacaatattttgcgggtaaagtcaaaatagatactaattcacatgtaggcgaaaatttatctatgtcgaagcaagaaattgtggtgccggaaaatatccctccagcacctgagataagcaatatacaacaagaaactgaaacagcccataaaattgaagaaactgtatctacagctgaaatagaaaatgatttgacagaacagttgctgaatatgtttgatgcaaacattaattctgaatcagcacaaaataatatatctgctgcaccagtaattgataatgtagagccaaatgaaccttatattgaaccagtaaataaagtagagcaagtacatccccagaaatgtaaccatacaacgacagcccctattgaagattctcacttgggtaaacagtttgttgattggttaaaacaaggaattgctcagaataaatttgcaattagcaaaaatacagcaaagctacatattgttgatggggcactatttatcgtatctccaacaatatttgaacaatttctacaagaagcaggattaccttacgataaagatgccattacaaatttacagtatcgatttcaagacctaggattgcatactcctaaaaatgtaatgagaaaaggtaagcctgatagtataaatttctggcgttgtgctgtcgcaggaccaagaaaaacttcatatttaacaggatatttgataaaagatactcgtctcttttttggagataaaatcttgttaaataatttatgcctaactttacaagaaaaggagtaagtacatggaaaagttagtatcttttaataagctattagaacaatttttttttctaccgcagttatttacgtccagatactaaacgtagttacaaaaacataataaatattatccagcaaagatttccagatagatctgcagacagtattaataatattgatttaattacctggagaaatgaaattctagatgtcaaaattaaaccagttacatggaataattatgtgagacatctaaaagctatatacaatgttggtattaaatacaatatcctccagatttcaaataatccgttttatgggctttttattaaagaatctaagcgcaagaagaagactttgtcgaaagaacagttggataaattaagttatgcattaaatgggaatatcgtattaccagaaatgctaaagccaagttggtttattaattgcttggtaatgacgttacgttgcaccggcataagacgttctcaattagtacaactacaaatacaagatgtagacctcaaccgtagaattatttatatttcgccagagattaataaaaatcacgactatcatattgtgccaatttccgataatttatatccccacatagagctattagttgaagaactaagaaaacagaagcagcctttagatagtcaattatttaacttcaatctcttttctaaagtaacccgtagaaaaggaaagcctatgagtgtagatcaggttactcatatatttagacgtatatctgaagttgttggatttacctcatctcctcatcgctttagacatacagttgcaacatcattaatgaagaatccggaaaacgtttatgttgttcagaaattactagggcacaaagatattagcgttacattaggatatatagaacatgacgtggaaatgttaagagattcagtaaacttattatagctactgaggaaaggagttagaaaaatgatggggaactaagttccccattaatgttagccgctgcctaacgcatcaatattgctcattataagctggccttgatgccggcccctacggatccctgctttgttttaagaccggggggacatttgccctgtctactaagaattctactatattaattctaaaaatcaaatatatttttctgatattgggctaaataacgttaatgcagaaatactttttacttgaggtgaccactgttcaatcaatcctcttgcactctttaaggttgttccagatgcccaaatatcatcaattagtaaaacatttctagtatttacaggaagccaacctacattcttgactaaaagcggtacgtacttcctatcttttgtatttaacgccttaattgttaagttgtccatatttcgattaatagctgtttttattcgttgtttaatatctgaccgaatatcagggttatgtataaccttatcaatagcagattggggagtatttttcattaaatagtctgtaataatatgaactttatatagttcccctataatctgtgctaattcatatcctatactatgcttagaaggcattacaattacagcgtcaaatggaaaattcgatttaaaacaatcttttatgctatttcggacatacaaaaataatttttttactgtttcatcatcggtagataatccatcactgttctttaatgcatataacattggacaattatctcccaaagggcgacctgctcttcttttttctttttgtcttttaataattgagtaaagatatgtggtatcccatttatatttcaacatttgttggggctggtcagattcaatttttacacaattatttttatcaataataaacttcatattcaaatatttgttttaaaagactaaacccacaaaatttcgtggcttaagaaattagatgctagttcgtatgatatgtgctgactcacattataatgtcaaggacatactacatttaacaatatattgggaatgttacagaataatgtcaagtttttccttgattctattgtagaacacctacattcaggctttacaaacataaaaaagctgtgtaggatcgacagtgttgattaagtgatcaatacccattttgggatgtattggctaggtacacccagacaataggaagtattttagcggttttgactagaatatattcctacgcacttgattcaaaatcctttgcgtagaaccactaaaaaatttggtaaaatctagaaaaccactcttagcctgagtgacgaaattggtagacgtagcggattcaaaatccgccgttgaataaacgtgtcggttcgagtccgaccctaggcaccaaatcttataaatttccttttattgattaaaataaacctttcttattattctctttttataaacttactacacacagcaagcggtttaatttgcggctttttttgcaaattaaaccgcttgttatttctgcttggtaacaattggatataaaaaatgcagccctaaggctgcatttttactatgtgcttatttaagcttcaattaccactgataaccaacacctacagagccacctaagtctccgcgagtatttgcattaccttgtaatttaagaatcactttgccgttatcgcttgagcgagagtagcccactgctaatgcactttcacctttgaaagtacccgctgctgccgctaccatcgatttaccaggtacatacacttgtggtaaacctgctgctgcatttgcacctgcaatacctgcacgtaactctttatttaccttattgatacggttatgaacattacctgtagccgctttcaattgacttacattgactgcatcagtatctgcttcacccgcttttacattggtgattttgttacctgccgcatcaataccagatttagttacgctcggaccatttgcaaccttcacgccgtcagaatcaattgtcgtatcacctgcttttaccgtatttgcggttacttgtttagcatttactgagtcaacattgatgtctttcgccaatttcaccgttaaagtaccgttaccgtcagaaactacgccgatattattatccgcaagtttagcttcatcgctaacaccgcctttaactgtgacggtagaacctaatttacgttctgaagccgtaccggtatcacctgcaaatgttagtggcttaacaacttcattattgagattgttaatcgcttctcctacattatttgcagttgcagtagaaccgtcagtcttcgtaatcgtatatgtcggcgctgtaacattgcctttgtcatcaactgttgagttaccaccaaggtaattagcaatattttggttcgctgcataaagctgagaaccattaaccgcttgtgtgctagccggtgaaatatcaccgtctgctacaccggttactttattatcgccagcattaatgccatccgctttaacagttacgttaccgatcgttaagctacccttatcggttaaatcaaggtcgtttgataatgttacgttaaactcggtgttattgccggttgtcgtattggtgacaacaagattgttattacctgataccactgttgaagttaactcagaatctgtaattgcttttgctacatcttctgcagtcgcaaatgtatcacctgactgatttgccgtaaccgtgacattaccattaccgtctttatttacagttaaacctgatttgtttacgttaaatgtaacatccgttttcgtaccatcagaatttacttctgcggttgtacctgcaccattcacaaagttaacttggttacccgctgtcactttatctttatcagcaccgttgccttggattgtccaagatacgttgttgagaacatttaccatatcacctacagttgcaaagctattattcgctttatctcctgctgctgaagtttccgctacacccgttgtactattgatagtcactggtgctttgtttacctcaaccgtgtaaatggtttggccattatcacctgtttttggtgtaacggtcgtggtattaccgtttgctaactcggttttcgccgctgctgttttcgcatctaattgtgatacgtttactgcatcggttgcattcgtaccgtttgcaacattggtaatcttattaccgccggcatcaattccgtcattgttaatggttacattacccactttcacgccatccgctgtcactgaagtattacctacagttaaaccatcgttgtttagcgttgtgttaccaatcttcacgctacctttatccgttagggtgagattgtttgataatgtaactttaaactcggtgttattgccggttgtcgtattggtgacaacaaggttgctattacctgatactactgttgaagttagctcagagtctgtaattgcttttgctacatcttctgcggtcgcaaatgcatcacctgactgatttgccgttactttaccgttattcgcagttaagcctgatttgtttacgttgaatgtaacatccgttttcgtaccatcagaacttacctctgcggttgtacctgcaccattcacaaagttaacttggttacccgctgtcactttatcttcgtcaacaccgttgccttggattgtccaagatacgttgttgagggcatttaccacatccgttaccgtagcaaatgaatcacttgaatccggtgttgacactgtgccatcgttatttactgtgacgtcacctttatttacttccaccttgtaaatatcttgaccatcggcacctttctcacgtgtaaccgttgtggtattgctgttcgctaattcggttttcgcagccgctgtcgttctatttagctgatctaagttaaccgcatccgttccttttttaccttctgcaacgttcgtaatttgtttattacctgcgtcaatgccgttattggtaatacttgggccgtctttaatggttaagcctttgtcatttaaagttgtgttgcccgtggttaccgtggtaaatgttgggttttcactaatcttaatcactaatttgtcgttctctgtatcgacacgaacgttcttcgcacttgctgctgcatctgttgctaactcgcccacaatcgataatgtatcagttaagtttttgtgaattacaccgcttgcgttgttacccacaaagtttaaacccgcattagttaagttagtcgttgcgttaaataactggccgccatttaccgcttctttgctacctgcctcaactttgccgtcttttacattgctgatagtagtattcgctgcatcaataccatttttcgtcacactagggccattattaatggttacaccatcattattgatcttcgtatcacccaccgtcacattactgaaggttgggttatcgctggttgcaatcgagatcttacctgccgtttgtgtgatattgatgtttttacctgcatcaatcgttaccgtatcgcccatcttcacattcgttaagctggtaccttctgccgaaccgttggatgctgaagtcgtaatattccagcctttatttacagtattcgtcacattcgttacgttttggtttgtcgtatacaactgactaccatttactgcatctttgctggttgccgatacttcgccatcttttacgttgctaatcgtattattcgcagcgttaatgcctttatctgtaacagatacgccacctacagttacgttattatctgtgattgtggtattgcctaacttaatcgaacctttatccgttaagtctaaagtattcgataacgagtaagtaaagttttgaccgtcttgtgctaaaacaagattattgccggctttaaacgtcaccgtttcacctgctttaacttgttcagccgttgtaccacttaccttaccgctatctacgctacctgaggtcacattaaagcttgtattgttcagcacgtttacaaggttatcacccgttacaaacgtattgcctgctttattatttgcagtcgtgccattcgggttagttaccacttccgcttgtgctacagagatatcgtaaatacgaccgttcgttaaattctctttaaccgtaattgacttatcatccgatgtcactgttgttgtgatcgcggctttcgtttcatttaactggttaagatttaccgcatctgtaccgtttacaccgtttgctacgttcgtaatcggtttatctgccgcatcaataccttcattagtaatgcttgggccattattaatggttaagccattaccattaattgtcgtattacctaacttaatatcatcgccgtttaagctcgtattacccacagctgccgtcgtaaatgtcggtttatcgctagttgcaatcgagatcttacctgccgtttgtgtgatattgatgtttttacccgcatcaatcgtaacaagctcgcccatattgatttgttcagtgctattacccgttaccgaaccttgcgatgcgcttgttgtaatattccagcctttagcaacttcattacttacattgttaatgttatttgtaacattcgtaacgttatccgttagctgttttacattcactgcgtctgttggtttggtacctgccgccacattagagattactttatctcccgcattaataccgtctttggtcatacttggaccattgttaatggttactccatcagtatcgatcttcgtatcacctaccgtcacattagtaaaggttggcgttttgctagttgcaatcttaatgccttcattatctgccgttagcacaatgttatcacccgtaataaagtttgctttattactatctttagtgatcgttttaacatctgtaccatcaatttgagttacaactgtttgcaatgccgtattagccgtagtgttagcttgattcgccacactatttgctgtcgtaatattgttcttcgcactatcagacagatcaattgtgtaatcaatcgtgtttgttgtgctatttacttcagaagttacattcacttctgtcgaaccagctttagccgtcgtattccatgcatttacggtgtaatcagtgccgcctgtggttgcatttgtcgacgttgtcacagctgtatttaagccttttaatacggcagctttacttgcatttaattgctgtacatttactgcatctgtagcatttgtaccattcgctacatttgtaattggtttatctgcggcatcaatgccattattagtaatacttggaccgttattaatggttataccatcattattgatcttcgtgtcacctaccgtcacattagtaaaggttggcgttttgctggttgcaatagagattttcgtgccttcttgtgtgatttgaatattctcaccaccatcaattgtcactttatcacccatttgaacattcttatcttcagtccctgttgcattacctgaagtagtgatattccagcctttatttactgttgtatttgcagtattcgccgtgctattagcttgattcgccacactatttgctgtcgtaatattgttcttcgcactgtcagatagatcaattgtgtaatcaatcgtgtttgttgtgctatttacttcagaagttacattcacttctgtcgaaccagctttagccgtcgtattccatgcatcaatcgaataagtagtaccggtattatttactttggtatttttcccatcttgtaaatttactgtcggtacaacatctacagctaaatcataggtattacttgcttgatcataaacaacttttaccgaattattatcggatttaaccttagtgcgtccattatcgacatactgtttatttgcggcatctgtatcatttactggcgctgcaacattagttacaacattaccacccatattgatattgccattcggcttcgcattaaagttttgggtcgttactgttgtaaatgttggcgtagcgcttgtcgcaattgaaattttatttgctgactgagtaatattaatattatctccggcttcaactgttaccgtttcacctagttgaatattatcaactaatgttccaacaacattacctgaacctacttttgcagttgtgatattccagcctttatttgctgttgcattagccgcatttgcagtgttattcgctgtattcgcagtattatttgctatcttaattgcatctgtcaggttatttgctactacatacagttgcgaaccattaatcgcatcagttgatgttgcactgattctaccggcagcaacattttggatttggcgcttttgattgccattacctacagatacaactgaatgagctgtattaccagcaaaaccagagtaagtaataccatttactgtcgctgagtctgtattcacggctgcttctgttgttgtccctgaaccaagagccacagaattatcttgtgttgcagtagcattatcaccaattgcggctgttgaagcattaattgcttttgaatcaataccaaatgctactgagcgatcacctgttgcgtttgaagtatcaccaactgctgttgcataagtaccggttgcatttgaactttcaccgattgcaactgagctatcacccattgcgtttgaatcattaccgattgcaacggcactatctgctgttgctgttgcaccaacacccacagctaatgcgcttgtcgcattcgcaatagaatctgaacctaatgcaacagtattctgtgctgatgccgtagagttataacccaatgctgttgattctgtgcctgacgcaagtgaagatgtccctactgctacggtattattattagaagctgttgcttcaaagcccatggcattcgcaccatctgcggttgctttagctagtacaccgattgaagtcgcagctaagccggttgatgttgctgaggtaccaattgcagttgaaagaccaccagatgctaatgaactatcacccatcgctgttgcacttactgatgaagccgttgaattatagccgatagcaattgattcatttccggttgctgatgctttcgggcctgccgccattgcattcgcagcggtcgcacctttattatctttattttcagcaacggttgaatttacagaataatattcaatacctgctgcagtacttgcggtatttaatgccgaaataactacatcataaatacctgttgtaccatttgcttttacttcaacattggtattggcattaccagctaaaaagttaacttgattattcagtttaacatcaccaacttttgtaccgttagcgattacccagccttcacttaatttatttgctactacataaagttgtgaaccattaattgcatctgttgaagtctcagaaattttaccagccgctacattgattaattgacgttcagctccctcttgaccaatacttacaataccattacctgaacgaccttgccccgcaaagttttcataagtaataccattaatagtagctgaattttctgttgttgctgcacggtctttggatagtgagcctaaaattacactatttgcttgagtagaaacaatattagtaccaagcacatatgtttcttcttgaactaccttattattactaccaatcgcaacagagtaacatgctgtaacattattatttgtaccaatcgcaattgcatctcgagcagtagcatttgtggtactaccgatagcaaccgtatcatttgctgttgcttttgaaagttcaccaattgcaatcgcttgatctgctgtcgcatttgattttaaaccaattgaaacagcaccttgcttatctgcatttgcacgagtacccaacgcaatcgcactaacaccggtagttgctacatttgcactttcaccgatagcaatacttgatacgccacttgaattcgcttgtaaaccaaatgccatcgcagaagatgcatttgcaatagcttgacggccagctgcaattgtgtccgcatttaaagccttactttgattacctattgcgatagaattatctttttctgtttttgaatttacaccaagagcaaatgatgagcctccggttgcattcgcgttatagccaatagcagtagaattcgatgcgcctgattttgcaatcgtacctatagcaatggaataatcacctgatgaatccgtatggttagtagaatagttcgaagcataagcagtacctccacgtccatcagttgtcgctgttgctgcaacatctgcgctaccaattgcaatagattgtttacctttagatgttgctgattgtcctactgccaaacttgataccccatcagcccaagatgctgtaccaatcgccattgcataagctgatgtagctgctgattgacgcataattgacaatgagttgaagcccgatgcacgagatgctgtaccttgagccatagccccagtaccactcgcaatagaaaaatgacctaacgcagtagataatgggccacttgctttagcgtaatcaccaattgcaatacctgaagcaagattctgataatttgcagctaatgctgagctttggttaccaattgcaatacctgtagcttcaacatcccctatgttatctattggggaatatagatcactacctgttcgcgtacgattcgggttatcatacgataaacttcctggattattataatttaccgctgcatctccactaatagctgctgcataggcaccagctgtactagcactaccaattgcaaccgcagcttccgctattgtaggaattaatgcgctacctaatacaacagatcctagggttcctagtgctaataaattcttagtatttgttctttcatccgtagatgatgatttaccctttgctttagacagctctgaagtaaccacaaacgtctgtgttgtatggttccagatgaccttaaaaattttattcatattctttccttttgatttctaaattgaataacaattaattcaagatagaagtgcgaagacaactaataaacaacgcactaattacatacattttgggttttccagaccaaaactttcttattctagcccagttgatataccttagtcctctgattagaagctaatatacatttatttacacacatacacttctgtataaaccttctgtaataaagtgtagaataaactaaattattctccattcatttattgacccaaaaaagactgaacaattattttaaagttcaaaaaaattttatttttagaaaaaattttttaataattttgcaacaaaaccccaaatagtaaaatttaaaagcacattaacttcaaaaagaaataaattttatttcgaatcataacaattaacataaatacaaagcattatcattaataaaaacatcccaagtaacaaaaagataacgattatcattttatttaaataaacagttattagaaaaaagccgattaaagtcagcaggactttaatcggctttaattaaattaaataaatagtcaattcaaataaaaaatacaatagcttttatattctttaaaaaataaaaacatccaaactctaaataaataatatatatttatgttattttgctaatttcctcactaagtgcaaagggcattttgcgggggccccgaacagctgaaatgccaaaactttgtaacaaagtttttggtaataacgccttatgataaacgtttaagcactgcaaacgcatcaccctgtcaatacgtaaatctgttctctctgatttatatggcaaattaacttctaatgcctcacatttacacctaatggcggcggttggggcagtaacataaatatataccgtatcgcctaccgcaatattattgctctgtttccataacaattccgcaccgactttaagcgcttgttctacatcatagtatttcagatttgccggaacaatccattctgtatggcttgcaatacctaatttttgcttacgttgtcgggtagcagtgagatcaaagctgctatttaataagaataggattgtttctttatctaccgaaccgtctagcaatatactcagccaattggctttattcatatgataagccggaaaaaagcccggctgagttaaaaatgaatttaagagatcgggtgagcatttaacattcatcaccggaacatttttctctcccgataaaccaaaaactgaagatgctacatccatcaaaatcgcataccattttcgattatccggatgacataataccgcataggttggatgctttttccataaaaattccggttccgtaccgtattgttgtaaaacatataatagtacctcgtcccgaaaatttagttttttattttgcatacgtatcccttcttatttaaaaaagacaagcggtaagattttatcaactttttgcatttgcaaaaaaatctcaaaatcttaccgcttgtttagttattcattcttttcagacacaatcaccggctcaaattccgcttttttaagaaagttttgttctctaaagttaatcgggaaatgacaagcgaattcatgttgtttaaatttacgcaatggcggtttttgaatacatttcttctgtgcaaacggacagcgaggccctaatcgacagcctattggcatattttgcaacatcggtactgtgccttttaaagtatttaagtggcttttaaaggcgagaggctgagaaaaatccggaataccatttaataaaacggaagtataagggtgataaggtgattccataattgtttctttgctaccgatttcaaccgtttgcccacagtacagtacattaaacgaatccacccatttctcaatactacgaatatcgtttgctaccaacaaaattgaggtaccgaggtttttattcatactagagagtaaacgataaatttgcaattgtgtagtcggttctagcatatgagtcggctcatccgctaccaataaacgaggctgattagcaaccgccatagcaataataactttctgagcttccccttccgtaatatcaaacggataacttcgcataatggttttatgatctcgaatccctactcgatgcagcaattcaatcgcctttttctttttccagccaaaccattgccaccatttgcctttaaagttaatcgtttgaattaattgctcccctactcttcggcttggatccagactagaaagcgggtcttggaagatcatagaaatttgttcaccaacaacctttctacgttgagttgatgaaagcttcaataattcaacatcattaaaacgaaaacgatctgcagtgacaatccattcgtccttcattaccccgcaaatgactttagcaatcaagctcttacctgagccggattcccctactaagccgcatatttcgccttcatccagagtaagatttacattatctaccatttttactcgtccattcggcgtatcaatctcaatacttaaatgacgaatatctaataaagccataatttattccaattcactaataacgatatttctctaacacgcggctgataccgttacccaacatgctaataattaaaatcaccaataccgttgccatccccggtagaatcaccgtccaaggcgctaaataaattaattccaaagaatctctgatcattgcaccccattctggagtcgggctttgcgcccccaacccaataaaactcagcgaactgatatctaatactgcaatcataaaaatatgtgccgactcttttactgcaacagaagttaaattcggcagcaccacttctttaattaaatcccaacgtgttgcaccatctaaacgtaatgtggtgacatactctcgtttcagttcttgttccgtcgcttgataaattttatggataaaatgcggaagcatagctaatgaaatcgccaacatcgcattgattaaactcgcttccattaaggtggcgataataatcgcaataatcaaaatcgggataaataagaatgtatcaaataagtgtccgataaaggaaaatgacttgcgacttgtaccggcaacaacaccgataatcccaccaataacaccgattacgatactaataaccaatgcggaaccaaccgtataataaaagccatataacatacggctaaaaatatcacgccccaaatcgtctgtgccgaaaaaatggctaatttgtcctctatcatcccaagatggcggcattaattcaaaaccaacaaattgcgtgtcagcctgataaggtgatactgcatgaccaaaaaaaactaacaacaatagtgctataaaaagatatacactggttaaagctaatttatctttgcgtagctgaaatagaaactgtctaaagtaatccgattctctaaattgttccggctcttctctatttaacataccaatcctttttctgtgaagggtctaacacggttgtaatcacgccaaccaatagatccataacaagcacaaacaacccgattgccattacacctgccgaaattgcattataatcttgtgccgaaagcgcattaatcagccataacccaatgccaccccagctgaaaatattttcaattaacatagaaaacgcaaaaattaaggtgaaatttctcgcactcatcggaataagtgctggcaacgtattatgcagaatatgtgcacgccaaattttgaaaggcgaccatccccgagtttgagctactttaatatagttttgcttcatcacatattcagcacgttgacgggtaaaacgaattacctccaacgtcgcgggcacggataaaattaaagccggtaatgccaaatgatgtaatacactttgcatcatttttaatttatacggcgaatcagcaagaaaaatatccaataatcggaagccggtaaccggtgaaatttcataaataggatgcaattctcccactgccgaaattgcccactggttgcttgaggcataataaagaaccactatcgccaaccaatacattggtaacgccaaactgagcgaaccgagtgttgcaagtacttttccggataaatgatcacgaaaagccgcagaaaataaacccagtggcaaaccaataattagcgaaaccaatagtgctgcgatacataaagatattgttgcaggaaatacgttcaaaatttggttggcaattgcttcaccattactataactgataccgagatcaccttgcgcaagcccttccacatagctcatataagcattaatgccttgtaaatccataaagtgattaagcggatctcttaacaaaatgttataactgattagtgttaagataaacaaggtaatcaaggttaaaaataaacgacgaattaacgctaataacacggctatttctcttcatgttttaattttaaatctgccaaacgaacctgaccaaacggtgtaacttgtgcattctcaacacgagaattcaccagtaaaacacggttaccgtttactagcggtaagacaggtaattgctgttccagaatattttgtgctaagcgatacaataaatgacgtacataaggcagctcgtttccttttgccatttctagccaacggtcaaattccggattacaccagttggctaagtttgtcagttcattttgtgaacgacacgccaagattggtgtaagaaaagcattcgggtcaagattattcgctaaccaaccggttaaaatcatatcgtagtctgcctttcctacttcagcaaattgtgcaacatacgctcgactaaccggttttatctccacctcaatgccaatcttggctaaatccgcactgatcaattccgccattttttgtggatgtaaattataaactcggctttcatccagcacccaaagctgcaagcggtcaaatttctcgctattttcacccgttatttcaggctgttgataagggtaaccgtcatgatttttcgctgggtacaaaagcggcggtaaagtattttgtgcaacttgagctgagccataaaaaagaacatcggcaatccgctctcgattaatcgcttgtgcgatcttacggcgaaattgaatatcttgcatacgaggtttctgcgtattgaacgctaaaaacgctaaattagcccctgaagtttcaacaatttcctctttagctacgacagaaagttgactaggttcaggcaatgccaccacatcacattcacgattaaggtatttagcaattcgccccgcactattggtcgaaacatcgatcaccatattcggtatatgcgcttttttaccccaatatttattatgcggttttaggcgaacatattcatttgcaacgtaatcattcagttgatatacccctgtcccaaccggcaataaatcaagttgcgctaaattctcgtcagcatttaattgcaaagcgtattctttagacaaaatcaccgcatattgactagctaaatgggccaaaaccgaattgtccgcttccactaaatggatcttaacagtgtaatcattaggtgcagtaatttttttaatcttattttttaatgctacgctttcaaaataaggataatgcgctaagttcgctttaaattgataggcatagtgttgattttgctgaaactctgctcttcccccttcagtaaaatccaacgccggtaactcttcaacatagccaataatacggttaagagagaaaaccacatcttccgcattaaaattacgtgtcggcgtaaaccatgatgtggtatgaaacgcaactttacggcgtaaatgtaatgtaatcaccttcccatcatcgctaatactaaaacgctctgccaatgccggtttgagggaattcgatttcgcatcaaattcaaataacttatcgtaaatttgttcggtaacgacattcatattggtaccgacatccgccttttgcggattaaatgaaaaccccaacacaccggtacaataaacaaggctttcattacgcaactctttaggcactctcggggctgcaaaagcggtcgaatttaatccgaaaattgcaaaaatcatccctaattttaccgctgtaccgataaaagatttcataatacttacaccttgttacttactgataccgtaggctcgtaatttattcgctaccgccgtatgcgaaattcccaaacgttgtgcaagctttcgcgtacttggatattgcgcataaaacttgcgtaataatgttgcttcaaagcggttgaccaattcttctaatgtctcaccattatccgcaatttgaatatcgtctgatttcggttgatgatgcggtaaattgagatccttcacagctaaacggtagctatgcgcaagggtacaagctcgataaatggcgttgtataactcacgtaaattgcccggccaatggtagtctttgagcgcttgtaaaaaatcattatcatattctaatttgctaatgcctagttgctcactgacttgggtaataaaacgatccgctaaaagcgagatatccgcatgacgttcacgtaacggcggtaaatctaatgtcagcacatttaaacgatgatataggtcctctcgaactttaccttccgccactaataacgaaagtgctttttgcgaagtacagatcacacgaacatcaacatgaacctctttgtcttcacctacacggcgaaacgagccgtcatttaaaaaacgcaacaatttcgcctgcatttcaagtgaaagttctgctattgaatcaagcaaaaccgttccaccattagcatactcaaaaaagcctatgttttctttgccgttgccacgatgaccgaacatttcagtttccgcttcatctgccggcagccctgcacagttgaccgcaataaacttatgcgctctgcgatcactcagctcatgacaagctttggcaaacacatctttgccggtaccggtttccccctgaatcaataaaggtgcatctaacaatgcgaatttcttcgcctgagcaatcacagctttcatattttcactttccgcaatcaaatgagaaaaacctgccgtattttcggtaaattcagccttagtcacccctgcaagcggtctaatttcagctaaaatttgcgcctgttgctgatctgataacaaatcaaacttggcttgcattcctgattcagtgaatgtgatattttgaatcgattgattctgtttagccgataaatgcatcaaagattcggcaaccgttagtttttctgtacattcaatcaataattgcataagaaactcgccttgtatccactagggttaacaaataattgtgcgtaatcatactctgaaaaagcttttttggaaacttttgtttacaaatcgtttcggaaaaattcagtgcatttttatttactttatatcaacaatcccctacacttttatgaacttcactccatggcaaacaccaaaaatgagtgatttagtttacaaatttttaataagggaccttttatgtacttagaacaaattaaagcagagctacaagaagcggctgacgtactcgataaatttatgaatgatgaaaataacattaaactcattcaagaagcagcacttttaatctcaaatagctttaagcaaggtggtaaagtgttgtcttgcggtaatggcggttcacattgtgatgcaatgcattttgcagaagagctaaccggtcgctaccgtgaaaaccgtccgggttatccggctattgcgatttcggacgtaagccacttaagctgtgtaagtaacgattttggttatgaatatgtattttctcgctacttagaagcggtaggtcaaaaaggcgatgtattatttggcttatcaacttcaggcaattctaaaaacgtacttaatgcgatcaaagttgcaaaagaaaaaggtatgaaagtaattgcgatgaccggtaaagacggtggtcaaatggcgggtttagcggatgtagaaattcgtgtcccgcacttccgttatgctgaccgtactcaagaaatccatattaaagttattcatattttaatgatgttaattgaattcgagatggcaaaagcagcttaatttccatacttaaaaaggcgttcaaatgaacgccttttctcttactaaaagcggtcaaatttcactatttttttacaaaccgcttgagttgaatatcattatgttacttaagatcgtttttctcaatcattttataaggtactcttaacacccgatcttttagctgccatgctgttccttcatctacttttttccctttcactaaattctcactaaaagtaaggatcgccttgctctgactcacccagtcattttgaattgtaccggctaacgctcccattttaattaaatttaatgcagcagggattccgtcaacaccatagatcggtacaagttttccctgcgttgcggcggcttccaatgcaccgatagccattgcatcattattcgcaataattacctcaattttttctttatgcggtgtcgcaaaccatgcactcactttttcttttgccataccggtttgccattgtgccgactctaacgctagcatttgcgaaccgggaatgagttgctctaattgttgcgataccactctggttcgtaattctgcatcgggatgcccattttccccttttagcagtgcatattgaatttttccgtctttattcaaatcatattgagggttgactttccactgtttagcaaccatttccgcttgtaattttgcaatttcactcggatctgaaccaatatagtaggcatggtcatagctctccaatgcctgacgtcccggatctttattgaataaaataatcggtacattacgatctatcgccttaccgataacagttcgccaagcattttgatctactaaatttaccgctaaaactttcactttctgctcgagtaaagtttcaacctgattattttgtgcaaactgtgaattttgtgcatcgttcattaatacggaaagttggtgtttagcagcgtttctttctaattcactacgcattagctggataaaattatcgtcatagcgataaagtgttaccccaattttatcttgcgccataccggtatttattaaaccgatacctaaacttgcaattaaagaataaaccattacatttttcataatatgctccccgtattttacaactacgactttttatgccgtttaaaacgtaatttgatactacaccgattatcctagaaataatgtgagctagttcacaaaatatagaatttaatcgtttgcgctgtacaaaatttcaagaaaatagcaataaaaaaagcggtgtaatttacaaaaaattttgtaaattacaccgcttaattctgattgtttaaactattttactgactttcttgataataaaatcagaactaacatcatcatacccgttgctataaacccgaataatgctgattcagtaaaaccaaccactaaataaccgacaattgccgccgtcgcaactaataatgcgtaaggtaactgtgaagttacatggtcaatatgattacactgcgcaccggttgaagataagattgtcgtatctgaaattggcgagcagtgatcaccacaaaccgcacccgccatcaccgctgacatacatggaattagtaaaccggtatccacattgattgccatacctgctgcaatcggtaacataataccgaatgttccccaactggttcctgtcgcgaatgccattactgtggctaatacaaataaaatcgctggtaaaaatgccggatcaatattgcctgctactaatgtagaaaggtaatcaccggtgtgcatatcttttacaacgctactaatcaaccatgcaagtgctaaaattgcgattgcaccgaacatcgacttacaaccgctccaaatagcttttggataatcagccaaatcaattaaacctaatgtacataatattactgctactacacctgctgaaccaccgatcactaatgaaagattaacattcgtgttttcaaatgcacccagtaaactaaatgtgtctaatgcttgcgcaccagtataaatcattgatgaaacggtcgttaccatcaatactaaaatagggacaattaatgcataaactcgacctttgctttcaacaacttcatcttgcgtatgatgctccgaagtttgagctgaacgctcaaaacgagccattgagccaatatcaaatgaactataagaaacgaaaaatactagcagtaatgcaaaaatcgcataaaagttcatcgcactcattgagataaatgcactcattgccgtatattcagtaatattataagtaactaataaaccgccaatggttgcaataatagatgcaccccaacttgataccggcattaatacacacatcggtgctgcggtagaatctaaaatataagcaagtttagctcgtgatactttaaatttatcagtaacaggacgagcaattgcaccaaccgctaaactatggaaataatcatcaataaacgtaacgaacactaaacaagccgtcagtaattttgccccacgtctattcttaatatgctttctcgcccaattagcaaaagcttggttacttcccgaataagttaataatgaagtaaatatacctaataatagtaagaaaataataatttgtaatttacctaatgaccatttaccctctgaataaactaaaccgactgctatattctttaaataagcgaagccgtccataaattccggtgcgagcataaatgcgccgactaaaattccgactcctaaagaaaataaaactttacgagtagcgatagctaaaattagcgcaagtgctgcaggtgcaattgaccatatagaacttgaataatcaactaaattcataaaacctctaaaaatataactttgtaatgaaattgcaagtcaaacaaagaagaggatctactgaaatgatttatgcgaactgcataataatataaaggtgggcaatatgaataagaaaaatatgaaccaaccctaacagtagcactccgtaacagttgatgttacgacagtgtcgtccctttcggtaacgaccccaaccaattaagatgacgcttaactgatttcggcaaatacgcctttccttcttcctcatcgttttccactcagaaaaaatacttatcggatttgcacctctacaatttgtaggactctgtaagattaccttaatattgacggcttgccaatagctaaattcaactatttaagcaagattaatagtcgaatcattcaaatagaggtcttatctcaatcaattagattatattcaataaattatttgtttaccttaaaaatatattccgttaatatatgttcaattctggagtatttcttctttctagaattcacacaataactaaattattatattttaaatatggtctttatttggagatgaaaatgtctgatatcttaaaaacgttatcaaatattcgcagcttgcgtgtaatcgcacgtgaaacttcattagaacaattagaagctttacttgaaaaagttactattgttgttgaagaaaaacgtcaagcagtacaagcgcaagaacttgaacaagctaaatttatggaaggtctgaacaagtataaagaattacttgaaaaagacggtatttctgctgaagagcttgcagttttacttggtagcgtgtctgagcgtaaaaaacgcgaaccacgtccacctcgtcctgcgaaatataaattcgttgatgaaaacggtaatgaaaaaacttggacaggtcaaggtcgtacacctagcccaattcaaaaagcattagatgcgggtaaatcgttagaagattttgcaatctaatcactatctcgttattagggggctatttagccccctatttttttacctcaaaataagtatttttactcaaaaagtttcgttttgaaatatatttcgaaagcttataagaatttataatttcatttattaacacagatattatttttatttaataaattaaatacaaatttaattatttatacttcattctcactattataaagttattaataattatttattcactcagaatctcataaccttccctttagccaccaaaccgctctctcatacgctgcaaagttaactcttttaggttatatttaaaaacaatgttaaattttgttattttttgttgatttatttttaagcaattaagcaacaaaagtgtgatcctggtcataatttgaaacaaacctactattcttttacaaaaactcacataaaatgcatacacccaaaaagttaacatttttttaacttataacatcattatcgctctgcgaggtttttatggctcttttccttagtatattcccgattgttttacttatttacttaatggtaaaacgtaatgcattaccatcatatgttgctctcccttgggttgccgtggtggttttaattattcatcttttattcttcgcgacagatattactgttatcagtgcaaatatcgcttcagcgataatgtcagtattaacccctattaccgttatttttggtgcgattttatttaatcgtttctctgaagcatcaggtgtaacaaatacattacgtaaatggttaggtacgattaacccaaatccggttgcacaacttatgattatcggttgggcatttgcatttatgattgaaggtgcgagtggtttcggtacgccagcagcgattgcagcaccaatccttgtaggcttaggctttaatccaattaaagtcgcaatattggcattaattatgaactctgtgccggtatcattcggtgcagtaggtacaccaacttggtttggtttcggctctctcaatttagctgaagcacaaattcttgaaatcggttcaatgacagcgcttatccatgcctttgccgcattagttattccggtgattgcattaagttttatcgtaagctggaaagaaatccgtcaaaatatagtctttatttacttaagcgtatttgcttgtgtagtaccttacttcttacttgctcaaataaactatgaattcccatcattagtcggtggtgcaatcggcatgtttatttcgattttccttgcgaataaaggcgtaggtttagctaaagttgaaaatacactagatagcgcagtatcaatgaaagatgtagcaaaagcattgcttccaaccggtttattaatcggcttcttaattgtaactcgtattcagcagttaccatttaaagcaatgatgaatgacacaacaacttggattgcaactcaattaggctcattaggtcaatttgaaatcagtcacggtttagtctttagcttaaaaaatatttttggcacagctgtaaacgcaagctataaactactttatgtgcctgcactgattccgtttgtcgtaaccgtattaatctgtattccgctatttgcattaaacggttcaaaagtaaaagaagtgtttgccggtagttttaaacaaaccaaaaatccatttatcgcattaatcggtgcattaatcatggttaacttaatgttagtcggcaatgacggttcaatggtaaaaattatcggtaaaagctttgctgaagcaaccggtgaatactggacaatctttgcttcgtacttaggtgcggtaggtgcattcttctccggttctaatactgtatctaacttaactttcggtagcgtacagttatcaaccgcagaaattaccggtttatcaacttcattagtacttgcgctacaatctgtaggtggtgcaatgggtaacatggtatgtattaataatatcgttgcggttaactctgtattgaatattcaaaatcaagaaggtgcaatccttaagaaaaccgtagtaccaatgtttatctatggtgttattgcagccgttgttgcattaacgattattcctctcttctttaacgtttaacattaaagtagtagagcaaaaagttaacaaggcgtgctacactacgccttgttcaagcggttaaatttaacctcttttttacaaattattaatcaaaaggaagtccaacggcttccttttgtcatttatagctttctaaatacgattatttcttatttttatttaagtgggagttctttatgaacgtaaatttctatgtcacctgtattgcggatatcgtcaaagcaggtgtggcaaaaaacagtgtattattacttgaaaaacttggctgtaatgtcattttcttagaaaaacaaggctgttgcgggcaaccagcgattaacagtggttatgcaaaagaagcgattagcggtatgaaaacattggtagaaacctttgaagtcaatgactaccctatcgttgcaccggcaggttcttgtgtttatgcaattaagaactatcctgagtatttcaatcgctttggcgaaacagaatgggcaaaacgtgctgaaaaagtcgctgcacgtttttatgatctcactgattttattgttaacgttttaaaagtagaaaacgttggcgctcgtcttaccggtaaagcggtttaccatccttcttgtagcttaactcgcaaacttggtgttgtgaatgagcccctcacacttctacaaaatgttaaaggtttagagcttttacctattcataaccaacaaacctgttgcggtttcggcggaacattctcagtaaaaatggctgaaatctcaggcgaaatggtgactgaaaaagttgtaaatattaccgaagtagaacctgaatatttagtgggtgcggatgttagctgcttaatgaatattgccggccgtttaagccgtgaaggtaaaaacgtaaaagttatgcatattgcagaagtattaatgcaagaataaaaggggaattaccaatgtcacatttacaaacaagtacactcccgtttaaacaacgtgttgaacaacaagtacataatgaagtaatgcgtaaagcggttgtgaaagcacaagaaacaatcggcgcaaaccgccaaaaaatggtggatgaattaggtcattgggaagaatggcgtgatctttcaaaacaattccgtaatcacgtgcttgcgaacctagacgcttatttatatcaattaagtgaaaaagtaacacaaaacggcggtaaagtattcttcgcagaaacagcggaagaagcaagtgagtatatccgcaaagttgcgcttgagaaaaaagcgaaaactatcgttaaatcaaaatcaatggtaaccgaagaaatcggcttaaaccacgtgttagaagcggaaggcatgaaagtggttgaaaccgacttaggtgaatatttattacaaatcgtaggtgacaaaccttcacatatcgttgtgcctgcgatccacaaagatcgtcaccgtatccgtaaagaattacatgaagtattaggttacgaaggcaccgagcaaccggaagagatgaacgcttttgtgcgtaaaacattacgtaaagatttcctagaagctgacattggtatctcaggttgtaactttgccgtaccggaaaccggttctgtttgtttagtcaccaatgaaggtaacttacgtttagcgacaaccttacccaaaacgcatattgcagtaatggggatggaacgtttagcaccaaccttcaaagaagtagatgtgctaatgacaatgctttgccgtagtgcggtaggcgcaaaactcaccgcatataatacgtggttaaccggccctcgtcttgaaggcgaaacggatggaccggaagatttccaccttgttattgtagataacggtcgttcaaaaatcttagaaagcgaattccaagaagttttacgctgtatccgttgtggtgcgtgtttaaatacttgtccggcttaccgccaaatcggtggtcacggctacggttctatctatccgggcccaatcggtgcggttatttcaccacttttaggcggatacgatgagtttaaagaattaccttacgcttgttcattatgtactgcgtgtaacagtgtatgtccggtgaaaattcctttagcacaattaattctcaaacatcgtgagaaaattgccgatgccggcttaacaccacttacagagcgtctttcaattaaaggtttcacttttgccaactcaaatccgggcatttggaatatgggcgtgaaaatcggtgctaaagttgctggtaaatttatccgaaacggtaaagcaccggtcaattttggcgcgttagcggaatggaccaaagcacgtgatttaccgagtgctgaaggcgaaagtttccgtgaatggtttgcaaatcgtaaataatttaaattacaccacataaaatagcacgtaactaggtaaacaagcggtcattttcaaccaaaaatttgtaaaaaattagcaaaattacaccgcttgttcttcctataatagctaacgtggtcaacacaggacagagcaatggacttacaaaatcgtgaaaactttttaaatagattggcgcagcgtatgggcagagaacgtaaactcgttccggatcaaatggatacgccagtaaacgatcaccctacaacccgtttaacccatctttctcaacaagagctttgtgatgagtttatgaatttcgctaaggtgttattagtggatgtggttgaaacgaaagaagcggacgtagcacaagcagtattagacgtttgtgaaaaatacggtggcggaagcatcgtgttaaataatgatactcgcttagaaagcttaggcattaccgaagcggtgaaagctaaatttgatagctatgtgtgggattttaccaaccgtgaagcgaatatttctcacgcagaaaaagcgaatatcggtatcgtacatggcgaatacggcttagcggaatccggcggtatcgtgctatttgctagcaaagataacggccgttcaaccagtcttttacctacaacctctatcgtggtggtacgtaaaagtgccgtgttaccacgtgtagcacaactggcgcaactgctacgtcaaaaagcgcaagccggcgaacgtatgccttcttgcgtgaatattatttcaggtccaagtgcaaccgctgatattgagttaatcaaagtagtgggggttcacggccctgtgtcaaaaatctatgtggtcattgatgacttagcataaataaacaagcggtctatttctgcaatttttttgcaaaattagaccgcttattttttagttcttgtcatactaagacttaatttctcgagaagcaacttgctcgagcgtttcgggtttggtatccataagaaaatcccaaagcatacctaaacgcgcaaaaaactctctaatccgtacttttatatgtccttctggatatttagccgcaaagcacaccgcatcaatatggtgatatttcgcaataaataacgccctttcacaatggaattgttgagtgacaataacaaacggttctagcttatacacttcgcgcgctcttacaatggaatctaacgttcgataaccagcaaaatcttgcttaatttgttccttccgtgctcccattcgacgtaaatcattttgcatcactttaggttcattatagtaaggtgttttattatcaccgctcaccaacaaatggcttactttgccatgttttagtaatgacatcgccgcttctaagcgatatttatagtataaattaggtgaacctttagcataatattttgatgtgcctaacacgaccgcatcattgtatttaggtaatttatcaatatcggtataaatgcgatcttttacataaatgccagtggcaccatcaattaccaatacgaataatgtcaaaatcacgctgacccaagctgcacataccatactctttgcaaaaaagcgcccacaccttttatagaaaggcgtttttacgatctcttttgctgtatgttgctgggttaattccattttctgtctattcaatgctaaagccaattaatatattcgtctgaaagcagacaaatttttcaaacaaatgttcaagttattagcataacctagcaagttaaaattgcaagtataacctcacccagaattctagacgtttagacgtctaaaattccttgacaaatagcttgcctatcgctaccttacgcatattagagacgtttagacgtctaaatacaataatgacaagcggtcggatttctaccgtaatttgcaaaccttaggaatatcaatggctcatagcattactctctttcaagattcgcccttaactctcgcacttggcggtgaattatcacctattgaggttgcttatcagacttatggaaagctgaatgcagacaaaagcaatgccgtattgctttgtcatgccttaaccggtgatgcggagccttataaaaatgtgccggaacaaggctggtggcaagattttatcggtgccggtttagcctttgatacggatcgttatttctttatctgttcaaacgtattaggcggttgtaaagggacaaccgggccttcgtcgattaacccacaaaccaataagccttacggtagcctatttccggtaattacggtacaagatatcgttcaagtacaaaaagctttgttagatgcgttaggtatttcccatttgcatgcggttgtcggcggctcattcggcggaatgcaagcaacacaatggggcattacatatccagactcggtcgataatattattaacctttgttcttcacttactttcagtgcagaagccattggctttaatcatgtgatgcgccaagcgatcatcaatgatcccaactttaacaatggggactactatgaaggtttgccgccggataacggtttgaaaatcgcacgaatgcttggaatgttaacttatcgtaccgatgtacagcttgcccgagcatttggacgagaaaccaagcaacaaagcgaaatttggggcgactacttccaagtcgagtcttatttgagttatcaaggggtaaaatttttagaccgctttgatgcgaatagttatttacgcttattacgagcattggatttatatgaccctgctctcggttatgcaaatgaacaagaagcgctacagcgcattaaagcaaaatatacgttagtcggtgttaccagcgatcaactgtttaagcagattgatctgcataaaagtaaacaacgtcttgagaatgccggtgtacaagtgaattattacgaattccactcgaactttgggcatgatgcttttttagtggattatgcgttctttgaaccgatgctcaaaaaaggattagccggctaaaaataattcaaacgcctttcgttatcctatcttatagagggatttctctatccctctttaatttcatatcactacttcagtctctgcctctacattgctttaactaaatatgctgattttttacatatttagttgccgatttttagctatttacgtataaatttagctataatagtcactatttttattctaagagaaacgattatggctaccattaaagatgttgctaaattagcgggtgtatcgacaacgactgtctctcacgtaattaataaaacccgttttgtagcagaagataccagtaaagcagtttgggatgctgttcaacagttaaactattctccaagtgcagttgcccgcagcttaaaagtgaatactactaaatccatcgggatgattatcaccaccagtgaagcgccttattttgctgaaattgtgctagcggtagaagattactgctatcaacaaggctattcgctgttcttatgtaatacacaaaatgagccggaaaaaatccaaaaccatttggatatgttaatcaaaaaacgtgtggatggcgtattagttatgtgttcggaatatacccgtgactcacttgagctatttaacggcacaaatattccaatggtagttatggactggggtaaaaccgatgagaaaagtggtgttattttagataacagctttgaaggcggttaccttgcgactcgtcatttaattgaaaacggtcataccgagattggtgtgattgccggccaactcaccaagactaccgctaaagagcgttatgaaggttttgtaaaagcaatgcaagaagcaaacttaccgattcgccaagaatgggtacttgaaggtgatttcgaacctgaaggcggctttgagcaaatgaataacttgcttcgtttagataaattgccaaccgcagttttctgctttagtgatacaattgcacttggtgcaatctctgcgttaagtgaaaaaggtctcaccgtgccacacgatatgtctattatcggctatgataatattcattcgtcacgtttctattcaccgccgctgacaacgattcaccaatcaaaatctcgtttaggcgtaaaagcattaaacttattgttggaacgaattaaagcagataaatcacaatatcagccacaaactatcgaattccatccggaattagttttacgtcgttctgttcgtaatttaaataaataaaatcaattaaaaaggagttgtatgcatggaatttttaattagctttttcagtagctacggttactgggctgtatttttagttctccttgcgtgcggatttggtgtgccgattccggaggatataaccttagtctccggcggcgttatttcaggtttaggttataccaatgtacattggatgctggttgtcagtatgctaggcgtactggttggtgatagtacgatgtattggttaggacgtatttatggtgaaaaaattcgtcaatttccattaattcgtaatattgtcaccgaagaacgttatcaaatggtacaggaacgttttgaaaaacaaggcaatcgcctgttgtttcttgctcgtttcttaccggggttacgtgcggtagtttatctggtatcaggtattactcgtcgtgtgagttttactcgttttgtgctggttgacttctgtgcggcaattatttcagtgccgatttgggtttacttaggtgattacggcgcccaaaatcttgattggctacacgaacagattaaaaatggccaacatattatttttgcaggcttaggcgtgattgcaatctatgtaggttggaagtggcataaaggtcgtaaaaagaaacaagcttaatttgatttagaaaagaccgcttacaagcggtctttttttgcttagaatttgcaaaaagaaaccccaaagcaaaaactttggggtttgatttagtttatttacaaattaaatatctaactgagcatataatgcattgctttcgataaagtcacgacgaggttcgacttcatcgcccattaaggtgctaaacaatttgtctgctgcaatcgcatcggtgatatttacttgtaacatcttacgtgccaccggatccattgtggtttcccataattgttccggattcatctcacctaatcctttatagcgttgaatagttaaacctttacgtgattcacgtactaaccaatctaatgcttcagcaaagctgctcacttcttgacggcgttcgccacgcattacataagcacttggcgataataagtcatttaactcgttgcctaatgcagtaatttttgcgtattcgttactgctgataaagttaaaatcaagacgataagtcgtgtccataccgtgagtcgttaccacaatttccggctcatacacttgacgctcgctattaaagaacacttcagtacgatagaaactaccgccggtttctttttccattaacttcgccacaaactgctcattccaagcggtcacttttgcctgatcttttgcaaattcagccgaaagcgccgggctataaatcaattcgtttaataacgcaaccggataacggcggcttaagcgatcaaataatttttgcacgccattatattgtgaaatgaggctttcaagtgctacaccgcttaacgctggcgcaccttcactcacaaataaacctgcgccttctaacgcaatatcaatctcatattgcgacatttcatcattatcttgaatataacgctcttgtttgcctttcttcactttataaagtggcggctgagcgatataaatataaccgttctcaattaattccggcatttgacggtagaagaaggttaataataacgtacgaatatgtgcaccatccacgtccgcatcggtcatgataatgattttgtgataacgtaatttctcaatattgtaatcatcacgaccaatacctgtacctaacgccgtaatcaaggttgccacttcttgtgaagacagcattttgtcgaaacgtgctttttcaacgtttaagattttaccttttaacggcagaatcgcttggtttttacgatcacgaccttgttttgccgagccacccgcagagtcaccctccactaagtaaagttctgataaggctgggtctttttcttggcagtccgctaatttacccggtaagccacctaaatccaacgcacctttacgacgtgtcatttcacgcgctttacgcgctgcttcacgcgcacgcgccgcatcaataattttggttacgatatttttcgcatcgtccggattttccgctaagtactccgctaacgcttcgttcattgaactttcaaccgcgccacgcacttccgatgaaactaatttatctttcgtttgtgatgagaatttcggatccggtacttttaccgaaattactgcaaccaagccttcacgagcatcgtcacctgacgcatcaatattcgcatccgctttcttcaccacaccgctgttatccatatagttttttaacgcacgggttaatgcaccacgaaaaccggctaagtgcgtaccgccatcacgttgcggaatattgttagtaaagcagtaaacattttcgttatagctgtcgttccactgtaatgacacttcaacaccgatgccatctttctcggttgaaagatagaacggcgtgttatgaatatgggttttaccttcgtttaaatactcaacgtacgctttaataccgccttcatatttgaagtgttcttctttgccgtcacgctcatccactaaacggatcgacacgcctgagtttaagaaagaaagctcacgtaaacgttttgacagaattttatattcgaattcggttttatttttgaagatatctaagcttggccaaaaacgcaccatcgtacctgttttgtcggtatcaccaatgatcgttaatggcgcatccggctcacctaagctataaaattgctcgtgaacatggccttcacggcgaatggttagctgtaattttgatgaaagcgcatttaccaccgatacgcccacaccatgtaaaccacccgatactttatatgagttatcgtcaaatttaccgccggcgtgcaataccgtcataatcacttccgctgcagatacaccttcttccgggtgaataccaaccggaataccacgtccgtcatcttgtacagaaaccgaattatctgaatgaatggttacaataatatctttacagtgtcctgctaacgcttcatcgatcgcattatctacaacctcaaacaccatatggtgtaaacctgtaccatcatcggtatcaccgatatacatacccggacgtttacgtaccgcatctaagccacgtaagactttaatgctcgaagaatcataactatttgtttgattttgttcagacattcgttattcctatactttatgaaatggaaaaaggctctatttctcatcaaaaaatttaaagccaaaaaattgtgaagattatagcagaaaaatgcggaaaagtattgaaaacaagcggttaaaaagcgggaaaaatttgtaaacctagcgaaagaaaggattcgcttgatgaatataaaagcggctaaattttctggtaaaaagatccgaaaatttaaccgcttgtataagtactacattaggcataaatcccgactaaaatcgctaaaaatacgcctaaaccgaagtaatgattatttaagaacgctttgaagcactgctctcttactcgatgcttcgttaaccagcactgatagctaaataaacaagcactcaagctaagtacgataaaatagccccagtgatattcacttatccagccaaaaacaactaacagcactaacgcaataaattgcaataaagcaatgattttattgtcgtattgcgcaaataaaattgccgtggattttactccgatacgaagatcatcatcacgatcaaccatcgcatattgcgtatcataagcgaccgtccaaaaaatattggcgaaaaacaataaccaacattccaacggcagcgattcacttactgcgccatacgccatcggaatcgcccaaccgaacgccatacccaacaccacctgcggtaaatgggtaaagcgtttcataaacggataaataatcgctaacactaccgcaacaaatgacaataagaaagtatatcggttaagtaataaatccaaaacaaaagcgatacacaacaataatacaaacagtatttttgcttccgttgtcgtcacccgtccggtagcaagcgggcgctgagaagtacgttttacttcaccgtcaatatgacgatcggcataatcattaatcacacagcccgccgctcgcataacgattacgcctaatacaaaaatcactaacacggacagaggcggaataccgtcggctgcggcaaataatgcccatagtgtcgggtgaagtaaaagcaatgtaccgattggcttatcaaaacgcattaattgcgcatatgccagccatttattccgagaaaaatgttgttgaaaaaaagttgtcattaattaccgcagatttgtactgccactttggttgagactaatcgttgttgtaattctagcggtaacggcaaatctgtaaacaaataatttacttcagcaatatcgcctaggcgaacaattgcactgcggctgaattttgaatgatcggttaccaaaatcacttggcgcgaactttgcattaatgctcgtttcacttgcacttcgtgatagtcataatcgagcattgaaccgtcactatcaatcgcactaatgcctaaaatgccgaaatctaaacggaattggctaataaaattcaccgttgcttcaccaattaaaccaccatcagtccgtaaattaccaccggctaccgtaatgtgaaaatcttccttctgcatcaaaatatacgcagcattcagattattggtcacaatgcgcaaattctggtgagacaacaacgcataagcaaccgcctcagaggtagtaccgatatctagaaataaggaagcaccgttcgggatcatagctgctacgtgacgagcaatttcatttttttgttctgagaaaaactgcttacgttcagtataatcgctgttttcactgttagatggcattccggcaccaccgtgatggcgacgaatcaaattcttttcggctaattcatttaagtcacggcgaatcgtctgggaactgacatttaactgagcaactaattcttctgtactgacataacctaactgattaaccagttcaataattttattgtggcgaatagattgtttcatttgcttattcctccgcaaagttttttaaaaaaatgaccgcttacaagcggtcattttcaactcaaatcttacaatttttcaacaagttctaccgcataaccgatgtagcttgccggcgtcatttcttttaagcgggctttttcttctgccggaatctcaagtttctcaataaactcacgcattgcagcttcatctacacgcttaccacgagttaattccttgagtttctcgtatggtttttcgataccataacggcgcattacggtttgaatcggctctgctaatacttcccagttttgatttaactcatcacgtaaatgctgctcgttaacttctaatttacttacgccttttaaggttgctgcataagcaattaagcaataacctaaacccacgcctaagttacgtaatacggttgagtcggttaagtcacgctgccaacgagaaatcggtagtttttgacctaaatgattcattactgcattcgctaaccctaagttaccttctgagttttcaaagtcgatcgggttcactttgtgcggcatggttgatgaaccgatttcaccggcaatcgtgcgttgtttgaagtgatttaacgcaatataaccccacatatcacggtcaaaatcgatcacaatcgtattaaaacgcgccacacaatcaaagaattccgcaatgtaatcatgcggttcaatttgcgtggtgtacgggttccaagttacgcctagcgattctacaaactcttggctgaacgtatgccaatccacatcaggataagccgataaatgcgcattatagttacctaccgcaccattgattttcgctaagatctctaaattttcgagttgtttgtattgacgtttgagacgatatgctacgtttgccatctctttaccgatggttgtcgggcttgccggctgaccgtgcgtacgagaaagtaacggaatatgttgataacgttttgccaattccaccaccgcatcaatcacttttttccattccggcaataatacttcttcacgtgccgtttttagcattaatgcatgtgaagtattgttaatatcttccgaggtacaagcaaaatgaataaattcatttactgcttgtaattcaggtaacgcttcacatttttcttttaagaaatattccaccgcttttacgtcgtggttagtggtacgttcaatcgttttgatgcggtttgcatcttcaattgagaaatttgcgacgatctgatttaagtaatcgtttgctttttcagaaaaagctggaacttctttgatttgtgcctgagaagccaatttttgcaaccaacgaacctctaccgtcacacggaattttagtaaaccgaattcactaaaaatcggacgtaatgcggcagctttgtcttggtaacgaccatcgattggggataatgctgttaaagcggtaagttccattgttttctccaaataaataaatgttcggaacaggttctccattacggagaacttatttaaatacttttgtaaaactgttgtgcttgattaagaatctttctacggaaaaataagaattgccagcgagttccgcctacttgttgccataagataccggcacgaataccggctaataaacttgctctgattttttgctgaatatcaggacgcacaaggtagtcttgtaaacctaatacgtggatttttgaaccgagcgggctaatcacatcgctgtaaatcgccgctaaattcgcaatcatttgatccgccataatatcattttcatagagcggtaattgacgttcaatttgctgtaaacgctctgccaattttgctttggcttcaggatttttatttagcttttgacttaaggcgaggacgttaatccaataacgaccaatttcggtatccaatttaccgtttggactacccatttgcgcttgagctgtttccaaaccggtttttaagtggctaagttgatcgccaaatacagctaatgtggattctggctgagtgacgagtaggcttttaattgaatggctaaaaacatcgcgatccgcactgcctcggtgggcaaattgttgaactaagctaaccgcttggcaaacaccggcgaaagcgagcgtaatatcgtgataatttgtagacataatagacaattatttaaaccaaacaaaattggttctcaatataacattttttacatctgttttgaatggcaaagcacaatttatcttgctgaaaacaaaaaaggaaatctctctaagatttccttttgttaaaaatactaggtaattttcacaaattccgccttaaaatagccgatcggttgagccattacttcacgccaatcaagctgaaaataatgccaatatatcgaacggtaatacagttgcggtacatcatgccatggttttatttcaccggtaaaatggtaaatcaatggctcgccataagcaattgcggggttatacatatgcatacattggtaattatatgccatagggagcgcttgccattgcttaccaactactgcatttaaaacgtcttgatcaccaaaacgtagtgccgattgatgctcgagagtaaaagcaattaatttagcttccatccccttccaatgctctgcattgatatacagaacccctgcattaaaataatcaccttgcataaatgggtggcttgcaaggttcatcacataaggatctcgtatagctagcagcatattttgcgaaaatgcttccatttcaaacggctcgcctagatagccgttaaccaccacatccgaatccaaatataaccacttatttccgtttccataaggaaagaggcgttctatgtagtaacgtaaataggtactgtttgaaatatagtcattgcctttaaacgcttgtaacatctctgccgaaacatttgccagtgtgactttaattcctctccctcccacaatttgatttaattgctctacccaagtatgcgagacctgatctgcatgcagcacaaaaatattaatattctggtgatgggcaaccagtgattttatcgtcacctccgcatgtactaaataattgctgtccgttgcaagtacaatattcatatttcaccttaaatgaaacgcccgttatcaatatgatagagtttatcaaatttatctaagccatgtaggcggtgtgtaatcatcaataacgttcgattttggcaatgagtgaaaataagcgccaaaatttgttgttcggtttctcgatccagtccttcggtcggttcgtctaataacacgatttccgcttggcttactaataaacgtgctaagcctaaacggcgttgttcaccaccggaaagcggacgcccgccctcacccaaccataaatccaaaccctgttcatctaataaatagcttaatccaacttgatccaacacattaactaactgcggatctgttgcttgattattaccaagtaacaagttatcacgtaaactgctgttaaaaatatgaactcgctgactgagtgtcacaatatgctgtcgtaagcttgattctgtataatcggcaatattgcaagaatttagccaaatttgaccgcttgtcgggtcatagttgcgattaatcagttggaaaatcgtactcttaccactaccagttttacctaaaatcgctactttttgtccagcaaagatctcaaatgaaatattctgcaacaccggctcaacacgatttggataagcgaaggtcaccgattcgaatttaacaagcggtcgattttggtccgttttttgccaatcgtttttattgccgaaattcaccagtggttgctgctcggtaatttcatttaagcgttccgctgcggtgatcacttgccccaaatgtaaaaatgccaagccaatcggcattaaaatctctgccgacgccatcacacaaaataccacaagtgcaattaacgcttcgggataatcggcagaagggacattaattgctgtagaagccaaataaatcaccacacaaaccaatataccgttcgcaaagttcaataaagcattggataaaccggttaactggctttccttactctgtgcatttagccactctttttccgtttgattcagtttattacttgcttgagtcactactccgaacaataaaaactcagcgtgcatttggatccattcaataaactggctgcgatagtttgctcgagcttgaatcacttttgtccctgatttttgccctaaacggtaaaacaaggctgggaaaatcattaataaagcggttaacgccccacaaataatgagtgcaagcaacggcgatacaaaagataaaccgatacccataaatgcaatcagcataatagcgctgacaaatggcgaaatcagatttaaatacagcgtatccaaagtatccacatccgccaccaagcgattgagtaactcgctgtttctaaagcgatttaaaccgctcgggctcagcggaatcaatttacggaatacagtaacacgtaaatttgctaatacgcgaaatgtggcatcatgggtgactaaacgttcaaaataacgagaaatggtacgtccaattgccaagcctcttacccccgatgacgggtaaaagaaattaaagataactgctgacccggctaaaaaagatgccgataaaaaccaaccggataaacttaataaaccaatgctcgcggttaagctggtaatagctaacacaatacctagtagcaaatgcccccaatgggtacgataaagagaaagaaaaggaaaaattgatttcatgtatcacccattagtgttgttgtaattctgcaaaataaccttctttttcgaccgcttcaaagcaacctttttgcacgatttcaccttgtttcatcacccaaatttcatcacattgtttaagatcttcaatacggtgtgtgatcatcaatgtggtttgtgtttggctcaaatgctgtaatgcgttcaatacctgttgttccgattgcatatctaaactggcggtcggctcatctaacagaagcaattcataatctcgtaataatgcacgtgcaattgcaatacgctgtgcctgtccgccggaaattccggcattcgcatcttgtacttggctgtctaagcctaaacggtaaacaaattcatccgcttttgataaagctaacgcttgttcgagttgtgcttccgttgcattcggattacccaataaaatattttctttcagcgatcctttaatcaactgcggattctgcccaacccatgcgagtttttggcgatattgcgctaaattgagctcatgcaattccactccgtttactgtgaccgaaccttgataaggcaagaaacctaatagcatattcatcaacgaagtcttgcctgcaccgctttgtccaaccaaagcgatatgttggcgagcagcaagggtaaagtttaacggtttggttaacgctttaccttgtggtgaaagaatgacacaatctttcgcaatgattgcaagcgggcgatttgataaatctttttgcaaatcggtttgcacctgcgttacttgttgatttaaaaaggcttctatcccatctgccgcaccgattgccgctgccttatcatgataaaacacgcctaactcacgcagcggttgataaaattccggtgctaacattaaacagaagaaaccaataaacagacttacacccgttccgtaatagccgaaatccaattcacctaaatagataaaaccgaaataaaccgccataaccgcaatagaaattgcagtaaaaaactctaatactgctgaagacagaaatgccattttcagtacgtccatcgtacttaaacgaaactcttcggtactttgataaatttgttcggtttgcttttccgcttgaccaaataaacgaatcgtttctaggcctcttagcttatctaaaaactgaccgctgatacgagaaagcacaccaatattgcgttggttcgcttccaccgctttaatgccggctaacgccataaagaccggtaacaacggtaaggttgcaaataaaatagcccctgctgcccagttaattgggaacacaaaacagagaataatcatcggtactaacaacgataaaaattgctgcggcagataacgcgcgtagaaattatgtaaattctccacttgctctaacattaatgtcgcccaacttcccgctggcttttgttgcatactcattggcccgatttcagcgagtttcgccataatctgttcacgtaaatgtaaacgcaatgtttgtcctgccttaaacccggtacgttcacgcaaccaaatcagcaatgcacgtccgctaaaacaggcaagtaataagccaagctcaaataagaaagtttgcgggctttgatgctcaataatcattttatgtaacatcgttgccaacaatgccatttgcccgatcattaatacagcacttaagctaccgagtaaaacattaaggtacatccattttttgatgattttttgctgccctcgaagccatttttgcaactgtttttgtcgttgtttttccatgtttgatcaatttctgtttaatttagataacactttgaattaaattgaattttagcacgttatccgccactattgggcagaatttatagaaaaaataagcggtctattttgcaaaaaaattcacaaaatagaccgcttgcttacaagtttttgatgaaaattactcaaacatttcatcgaattcaaagcgatacatcaaatccaccgcttgattcacgcttgaaacccattgcaaataaagccttggcgctaaattatagcgtagggttaactcggtcagtgccgcaaaaatacctaccccgtatttcactttaaatttaggggttaaactcgcactcacttctactttcgtgttatcgccaataccggctgttgtcacatttaaatcatttagaccaaaagtactacctactgcgccaaccgttttactgcttttcgataaactcataccgattaatgccgctgccatagagttactcgagccggtatcgccgctattatcgagcgagcgtccggttagcacgtatgaaagcgcttcattctgcgacatagacggttcggaaaacactttgacttcagggctatcggctaaaccaattacttttacccctgcggtaacacttgggtcttccatcgcttcagggttacgaatcgcttcaatatttagcgtaggctgtgacggcaatcccgcaaagctgatcacccctttacgaatcagtagatcctgtccaaacgaagcatagcgaccgtttttcaagtttacttgcccgtgtaagcctaatccctgtttaccctgacgtactgcaattgtgccattgatatggcttttcaaaccataagcattaatactcacatcattaccgatgttgatattaatatttgacttaatcgccataccgcttgcagtcttttgcggaatttggcgttgagctaacggcactttttgttttacagaaccgtccataatcacttcatcactgctcacactcaccgcactttccggcaatgactcaaccgcaattcgagcccaaggaatatcaatattaccgcctagaatgagttctctcggcgttgccgtgacttcaatattcgggctaaattccacttttgccatattcggtacattcactcggaagcggttcgcttgcgcatgtactctggttttccacgcatctaaacggcgccaatcggcatcaccgtccaaacgcaattcgctttccgtagtttgcacacggccggcaagcgttgaggttgcgccatggaaattcagcgctaactgaccaccggtaacatcaaacggcatagctgtcgctttagcacgcaattcggtaagatttaaagttccgtgtaataatggagctgttactgcgccacctactgtaaggcgtgcattgatattaccgtcaaccgactcaccgccacttaataacggtttgatcaacttaagcgtcaattgatcaatttgaatattaccagataacttacgagcattcgccacatcattcatcactaaatccgtactaaggcgaccgttattttctaccttaatatcagttttcagctttaaattattatccgctaaagtcgcattcacgctaaccggtgctaacgttaatggaaaactgttaccgccctctaatttttgcaccaattttaatgcttttgaatcaagctcaacattcacttgcggttgtttgtttttaaaccaagcagcatcaccctttgcgtttacaatacctgataattgcgtatttttatctaaaaactgctgaactgctgctaaatcaaattgcttaatttcaaatggcactttgccttcttgtccagcattaaatgcctgtgggaaacacaaattaacgttgggattgtgccaacaatgagcagaaacattcgcattaatttgcttgttatcgtaactgatattcactgcttggttagttttaaacgacccgaactctttgctatcaatcgcaacttggcttaattgacctcgccaaacttgttgcaagcggtcaaattttccagaaagttgcaaattagcaccgataggattgcctttcgcattcagttttaaactatggttagcctcgctgccacttgccacaaggctcgcattttccactttaacatcaccataaactaattgtgctaagctgatatccacattaccttgaattgttttttccgtggttactttaccttttgcgattaagttttgcagattgagctgatcataacttaggcttttagcggttaaatccagatctaagttaggctcagcgactttgccggtcaacttcacatttccttgaatatttgccgccaatttaggtaataaaccggttaaattcggtgcattaatttgcgcagaaaaatccgatttatcacttaagatccccttaagcgcaatattattttcgccataaatcagcgttgcggaaggcacatctaataaggtgtgactatttgatttaatctcacctttaagttgtaaatttttttgcaacagcgaaccgttcagatctaaattcgcaacttcaacatgccaatctgaaccggtttcaccccgccccgcatagcctttcgattgcaagccaccggaaagcactgccgcccattccggtgcaagagatttggtattgagcgtattcagctcagttttcgcatcccatgcaacaccgttttcccaatttacattcccgtttagatttgctttcccttctaaagcattgagcgcaagttgctcaatattaaattgagtcagttcaccctgtccttttaaatgcgcacgacttgccggaatgcccatccctgccgcactcacttgcgtatctaactgataattgagtaaatcaccgcgaagcgatagatcaatttgctctaatttcagcggttcttgacccttttccggtataaatggataagaaatcgcatcactggttaaatgcagattcaatggtgttttcggctcggcaagctgaacttcaccctttaaatttgctttcaccgcaccgcttgtttgaatatccagagaagttttaccgaacaattcacctcttagctccgcttttacttggcttgccggaatttttagatccgccaataaaggtgattttgcatttaccgaccactgaagcggataattttctgcgagtgttaacaagccactgccattgacattgcctcgatcacttttaagtgataattgcgataattcgaccgattgttgatccgctttggcttgtaataaaagcgattccaccttcacaatagattgaggtgtaataaattttccatctttatctttaactttctgctcaatacgaatatttttggcttccaattgtggaattgccgcatctaaaggcaatttaatcggtgcttgtttagtcaataacggctgcgctaacttctctttaatttccgtccagttaatggtagaagcggtctgttttgctgatttttttgcaatttcttgtgctttttcgaccgcttgttccgcgcttgccggtgcaagtgaaagagttaagccgtccaattcagtcggcgctaaattcaccattctgcctttacctgaaatgcctgaatggaaatgcgttaaggcaatatccatctcatcgactttgacttggatattgtctaaagcaatctttttagccgatatgcctaacggtaaattcaattcggtaaaaggctcgctttccttatccgattgagaagggggtaatttggcagtatccactacaacggttgtatcctttaatgcgagattttcgatacaggtttctcgattcaataaacaaccaaagccaatatgtaaatccgcttgtccgacagaaacatccacgccatccattacaaatttagcatcggataaagttaatccatcttgcaggctaccgcttacactgccgatagttaatggttcgagaaatttatctgccagttcaaaagcggttcgttgcccttttcccgtcattaaaaacacaataggaattaaaattaggcataacaaaccacaaccgacataatggaaccaatgccatttgcgctttttaatggttgtttgtgtttgttgttccgattgaacactttctatttgttgcttatgctgttcactcatggcaatcccatttatccaatacaaataaagcggataaatttatccgcttaaatcattataattctgaacctaaaccaatataaaattgtacacctttgtcattatttggtgctcttaccggtgtagctaaatcaaatttgattgcaccgattggcgaagcccaacgtacaccaatccccgcaccggaatgcagatcttttgctttaaatttattcgatgctaagcccgtatcataaaatagcgcagcccaccaatccggataaacttggtattgatattcaaccgttgcggtagcaaggtgggatgcaccgagcaacttaccgtttttaggatctctcggtgaaatatccttataaccgaatccacgtacactcatatcaccaccggcaaaataacgtaatgtcggaggaatgcgagtgaagtcctttgaatgaatatgaccgacttcgccacgtaagaagaaacggtgatgatcaaaataagttcttacccaggcacttgatgctttccagctatagaaattcacatctgaagctaatgcttttgccccccagttaaccgttaatttttggctatcgccccaaagtgggaaacgattaccatccgaacgggtacggtttaatgacgcggtcggataaactaacagggtacgatgagactcattcgcttgtgtaaatgagtcgtaacgcgcttttactccggcagaaaaagaccagccggtttcatgtgtccaaaagcgctgaaaacctaatgtcgcagcggttgactttgtatcattttgatcttcattttctaatgcgcctgaaaactgataataataatggagcggatcttctcttaacggaatgttataaccgaattcaaagcgttgctccggcgcggaaatataggtacgagattcaatactgtgtccacggctattaatccacggctttttccagtttaactgaaaacgaggccccacatcggttgcgaaaccaataccgacttccacgtcatttttctttttaggctgaaatagcacatttaaatcaactactttctctttttcatttaaatgaggctcaaccaataccgaggtaaaccaatcgcttgaagagtaatccgaagtcatttgtgaaagatcattggcataataaggctcaccggacttcacttttaagatattacgcaaatattcttctttaatttgattatcggtaaacgtaatttcaccataacgataacgaataccactgtcataacctaaacgccaatccgccgaatgttctttcggataaatttctaaacgatgatacaaccaatgcccgtcaaaataccctttcttaaacgctaagctttcaatattacttttaaagccatcatattgttcatggtctaaattcgtgttttttttcggtacggattcaactaatttcgtaaagtcttcatctttacctgcctcgccaataatccgaatatccgtttcgtcaatttttactttttgactatcaagttcaacatttaacgtaagtaaaggttttttacctgcacgaggcgtttgaacaaattgatattgcgtattgtaataaccttttgctctcaaggccttatcaacagcagtttgcaccagatattgatgtcgctcggaaccatccgcatactcctttgcaatttgcccgaggtataccttcacattcgcccaagcatctttatcttttttctcaataccttttacttcaagatcaactaacgcttccgctttttccgaagcctccgcatgctcagcagactgttcttcaggtgaatcagcctcagaaacttgcagctcagtcgtttctgctaaagtaaattgagtaaaagcaagcaaacagcttgtcgttaatagacctaatttaaaattcacgtcgttattatcctaaacatttaatctttcggaatacctcttaacaaaggaaccgcattaaacggcgcaattgaagtcggtgccggaggattatcaaataccataatcaatgttctttctggtactaccgtttcatttcgccacaggcttcccatactcacaagttgaatatcttgaggtaaattagcaattccttgctcaagaacagcaacgctattctttcttgggtgtccaattaaaatcgcactaccgtgcttacgagcatattcaattgcggcattaaattggcgctgaacatcacttagcgcatcactgtcatctaaaaataaatttcgttctaatgcttttaccccgtattcccttgccactttagccgccacactcggaccggttttactgtctagaaaaaacaactgttgctgcgccatcactttcatcaaatgactcatcgtggttctgtctgccgttgctccactgcccatatggttattcagcccaattgcataaggtacttgattacgtgctgcctgtataagctgagcgactttcgcctcactagccccaatcatcaatgcgcccgactctatcggttgctgcttattcttcggctgcatcggtaaatgaatcagcacatctcgtttttgctcataagctttctttgcacgtgctgttgcgtaaggtgcgacaggaataatggcaacactcacttctttcggcaatgcataaatcgcgttatcttctttcattcgataaccgatatcatcaatcacaatcgctaactttcctgcatgggcaagcggtgtaattagcagtaaactttgcaaaaaaatcgctaaaatagaccgcttatttccaaataaattccacattatttcacccaacccattggatttttcggatttcccttacgacgaatttcaaaatacagcgctgagcgattttgtccgcccgaattaccaacactcgcaatctgctgaccggctgagacacggctgcctttacgaacggaaacagattggttatatccgtataacgacatatcaccattaccatgatccaccaccacaacttgcccataaccttgtagccagtccgccaaaattactcgcccaccggcaattgctcgtaccggtgatcctgcgcttgctgcaattactacaccatgccaagtgacttcgcccatttgacgagaaccaaaactattcaccactttacccgccaccggcatattaaattgtttatttggtgcacctaaaccgctaccggctctaacttgttgtttttcttgctcggtcgccttacgcttctcctcgctgttttttttctgctccagcttggcgatctcttgtttttcttgttgcgcagattccgctgctgcttttgctaattggttacgtaatgccgattcattattcttcaacgactctaagcggctttcatctcgctctaatgttttatcaattgaacgtagtgtcgtttcacgctcgctttggactttctttaaatctttttcctgcttcttttgctcggttaattgcgtttgctgacctttttgctgaccttttaattcatcacgacgtgctttaagttcttcttgggtgcgacgtaattcattaatcgtatcaatacgcacctgattaatatgttcgtaataagcacccattctatcggcatttttagcttgctcagacattaagcgctccaatacggacggatgaatgcccgaacgatacgccgagtcgagctgctccttgagtttttctttctgctctttctcttgcttttctaatctctgaatttcttgttcagtacgtttaatcgcttgacgtgtttccgacagcgacatttccgtttcttttaatttatccagcacttttcccatttcaacttcttgtgtttttaatgtggactggagtgcattacgcttttggcgctgttcattaattttgctttgttgctgcttaattttttgctgaatatttgacaattccgtagccatcacagacggaaaagaaaaagaggcaacgcccaaaaaggttagcgttaaataaaggggtcggagcgctttcacaaaaatatacctatattcaagaaacaatagtcgattacaaaatgacttattctaataaaatatttgagtaaaatcagcttttctgtgccttttgtaaaaagaaatcatctaactatttcaaagtaagccgatttttgctataaatactgcgttttcaaatcaacttaaaaacataggagtctttatggaattagtatttattcgccacggtttcagtgagtggaatgctaaaaacttatttacaggttggcgtgatgttaacttaacagaacgtggtattgaagaagcaaaagctgcaggtcaaaaattaaaagcagctggttatgagttcgatatcgctttcacttctgttttaactcgtgcaatcaaaacttgtaacatcgtattagaagagtctaatcaattatggattccacaagttaaaaactggcgtttaaacgagcgtcactacggtgcgttacaaggtttagacaaaaaagcaaccgctgaacaatacggtgacgaacaagttcacatttggcgccgttcttacgacatttctccaccagatttagatgcagcagatccaaattctgcacataacgaccgtcgttatgctcacttaccaaaagatgtgattccaaatgcagaaaacctcaaaatcactttagaacgtgttttaccattctgggaagatcaaattgcaccagcattattatctggtaaacgtgtacttgtaactgcacacggtaactctcttcgtgcattggcaaaacacatcatcggtatttctgatgaagaaatcatggatttcgaaatccctaccggtcaaccgttagtattaaaattagatgacaaattaaacttcgtagaaaaattctacttataatttagtttgttactcaaaacaaaaacgctcgggaaatcccgagcgtttcttttttgcaaaaaattctgtaaatttaaccgcttaccaagcaaaaatttgcttagctaactggaaggcatatattgccaggctgatcgcaattgcatacataatcaccccggtaagaaaatccaagatttgccatgttctacgctttccaaaataaggtgatagaaaacccgcaccataccccacgccgaaaaaccataacaaagaacagcttaacgctccggcaagaaactccattttaccgataaagtccaaattgccaccgattccacctaaaatcaccaccgtatcaatataaacgtgtggatttaaaaaggtaatcgcaaaagtaatcattaaagcttttttcaaacttgtcgcattttcattactggctgttaaggcttcactactcttaaaaatactaataaacgaacgactaccataggtaaatagaaaaaatgccccgagtaatgcaatgaataagcttaaagtaggcaaattcgccacaatagaacctagccctaacacacctaatgtcattaaaaatacatcacctaaaaagcaaagtgatgctacccaaaaaacgtgttgctttaagattccttgtttaagtagaaaagcgttttgtgcaccgattgacacgatcaatccgaaacaaacaatgaatccctgaataaaaatgtccatttttccctcaaattaagtcaatatgcagtcaattatacgcaaatttttacaaaaatgcggtataatctcccgaattttttgtccctttcttaacgactagtatttaggatccgattatgtctgaaacaattgaaaaccaagcttgcattgtcattgcaatcgccggcgcttccgcttccggaaaaagccttattgcatcaactatctataaagaattaaaagaagaattaggttcggatgacatcggtatcatttctgaagatgcgtattataaagatcaaacgcatttaaccatggatgagcgtattaaaaccaactatgaccatcctaattcaatggatcatcatttactggtagaacacttacgccaactgaaacaaggtcaagcgattgaaattccagaatacgactacgcagaacataaccgtaaaaccaccactaaacattttgcaccgaagaagatcattatcttagaaggtattttattactaacggacgaagaaattcgtaacgaaatcaacgtctctattttcgtggatgcgccgttagatatttgtttcattcgccgtttacagcgtgacttggtggaacgcggccgctcaatggaatcggtaattacccaataccgtaaaaccgtgcgtccaatgttcttacaatttattgaaccgtcaaaacaatatgccgatattatcgtaccgaaaggtggtaaaaaccgtattgcgatcaatatcttaaaagcgcaaattaaacaattattggcggtaaaaaaataggataaacaattatgcgtttatgtgacacagatatagaacattatttagatgaaggcaaaattgcgattgagcctcgtccatcaaatgataaaatctcaggggcgactgttgatgttcgcttaggtaattcattccgtgtatttcgtgaacacgcaacgccttatattgatttaagcggccctcgtgaacaagtcaccgcccagctgaataaagtgatgagcgatgaaattattatcgctgacggtgatgcgtttttcctacaccccggcgaactcgctcttgcgaccacattagagtcggtgacattaccggataatattgtaggttggttagacgggcgttcttctttagctcgcttaggcttgatggtacacgtaacggcacaccgaatcgatccgggttggcatggtaaaatcgtattagaatttttcaatgccggtaaattaccgcttgctttacgtcctaatatggcaatcggcgcattaagttttgaagtgttaagcggtcatgcggcaaaaccttataatgcccgtaaagacgcaaaatataaaaaccaacaaagtgcggtttccagccgtatcaatcaagacgattaatgcgataagcggttaaattttccaatttttttgcaaaagattaacaaaatctgaccgcttgttatcttataattataaaaaaagagatccgaagatctcttttttatgtcgctagattagctatttaatgctcttaaaatgtcatccacacgctctttcgcgtcaccgaataacatttgggtattttctttaaagaatagtgggttttgaacgcctgcgtaaccaaccgccattgaacgtttgaatacgataacgttttgtgctttccacacttctaataccggcatacctgcgattgggcttgacggatcatctaatgctgctgggtttaccgtgtcatttgcaccgataaccaatactacatcagtttcttcgaaatcatcattgatttcatccatttcaagtaccacatcgtaaggtactttcgcttctgccaataatacgttcatatggcctggtaaacgacccgcaacagggtgaataccaaaacgcacattaacacctttctcacgtaatttcgcagtgatttccgctaccggatattgtgcttgcgcaaccgccataccgtatcccggagtgatgatcacagaacttgcatttttcagcatttccgccacttcttctgccgtagtttcacggtgttcaccttgttcttcatcacctgagcttgctttaacttctgtgccgaagccgcctgcaatcacactgataaatgaacggttcattgctttacacatgatgtaagacagaatcgcacctgatgaacccactaacgcaccggttacaattaataagtcattgcttaacataaaaccggctgccgctgctgcccaacctgaatacgagttcagcattgaaaccactaccggcatatccgcaccaccgatagatgacactaaatgccaaccgaagactaatgcgattgcagtcataatcaacacagggaaaatattgtgcggattatttaggaataccaccattaataatgcagaaacgattaatgccgctaagttccatttgtgtttgtgcgggatatttaatgccgccgaagacactttacgaccgaatagtttgccgcttaatttaccgaatgctactaatgaaccagagaaagtcaccgcaccgataaagataccaaggaacacttcaacattatgaatgttagctagtgttgcttgttctgcgtggaatgccgctagtgcaacttcatctaagtttgccggtggaatcgcatctacgtgtaaaccgtagctgttaaaaccaactaataccgcagctaaacctacaaagctgtgcagaatcgccactaactccggcatttccgtcatttcaacttttaacgcttttttgacaccgataaagccaccgattgccattgcgattaagatccaaagcgtaccgtgcgattgtggaccaaagatagttgcgactaacgcaatcgccataccgacaataccgtaccaacaacctgcttttgccgtttcgtgtttagaaagtcctgctaaactcataataaagagaatcgcagcaataatatatgcagctgttacaaatccaaaagacatgagtttctccttaaccttttctaaacattgcaagcatacgttgcgtgactttgaaaccaccgaagatattaatgcttgccactaaaatcgcaataaacgcaagaatatccacgaagaaattaccggtcggttgcgcaatttgtaataccgcacctacaatgataatgcccgaaaccgcattggttacagccattaacggagtgtgtaatgcgtgactaacgttccaaaccacataataacccaccacacaggctaagacgaatacggtgaagtgtgataagaatgccgcaggagccacagaggctaaccataagaataacgcaccgacacctgccattacgccgtatttaatacgtggatcggtcggtttttcttcttttttctcaaccggtgccgcagccgctggtttttgcggttgagcagaaacttgaattggtggtgccggccaagttaattcgccgtcacgtactacagttacaccacgtaataccacgtcttcaaaattgatatcgatttgaccgtctttattcggaacaagtaacttgagtaagttaactaagtttgtaccataaagttgtgaagattgggttggtaaacgtgctgggaaatccgtataaccaattactttcacttggttttcagtaacaaccacttcacccgctttagtgtaatcacagttaccgccagttgccgccgctaaatcaacaatcactgaacctggtttcattgaatcaaccatttctttagtgattaaacgaggtgctggtttacccggaatcgctgctgtggtgataataatatcgacttcttttgcttgttcagcataaagttccatcgcacgacggttaaactcttctgacatcactttcgcatagccatcgcctgagccgccttcttcttcaaaatcgatttctaagaagtctgcgcccatggatttaacttgttcttttacttccggacgagagtcaaacgcacgaacaatcgcacctaagctgtttgccgcaccgattgccgctaaaccggcaacacccgcaccgataaccagcacttttgccggtggaactttaccagccgcagtaatttgaccggtaaagaagctcccgaatgcatttgccgcttcaataaccgcacgataaccggaaatatttgccattgaactcaatgcatcaagcgcttgcgcacgcgaaatacgaggcaccgcatccattgctaatacattgattttcttagcttgcaatttttccattaattgtggattttgcgcaggccaaatgaaactcactagcgttgcgccttctttaataagggcaatttcagcatcggttggcgcattcactttaaaaataatatctgaattccaaacctcttgttgcgtgccaacagccgcacctgcgtttacaaatgcgttgtcctcaaaactcgctttaaaacctgcatcgtgttcaacgagcacatcaaagccgagctttttgatctgttcaacggtttttggcgttgccgccacacgtgtttcaccgtctaacagctctcttggtacaccaataagcataaagactcctgtatggttgatgtttatatattgtgctaaaaatagcctatttcgaaaaaataagactaggcgtaatgtaccattaaataagtagaatttgtaaaaaaattacgcctcataaatcaattaattgcaaattctcagtttgcgacaaatctgctaaaatccagcataacaaaaatgtaataaatagaaccagaatgaatagcttagaccaaattcaaattatcctgatcgaaacttccctccccgccaatattggctctgccgctcgtgcgatgaaaaccatggggctaacaaatttacgtttagttgctccgcttaacccgattgacgaacaagctcaagctctcgctgccggtgcaaaagatgtgttggataacgcccaagttttccactcgtttgaacaagcggttgcagattgccaattagtaatcggcaccagtgctcgattacgtcatctacaaaatactcttattgagccgagagattgcggtaaattagcggttgaacgtgccgaaagaggtaaagtggcgattgtatttggtcgggaacgagtcggattaactaacgaagaattactaaaatgccattatcatttaaatttcccgactaaccccgattacggctcgttaaatttagcgatggcggtgcaattggcaagttacgaagtgcgtatggcgtggttggatttgcaaaaaaatccgcaaattcgaccgcttgcggaagaaaaggattacccgaataccgaagctttggaacatttcttcaaccacaccgagcgactgtataaacaattaggttttatccgtaatgatgcggtcatgctcaagctccgccgtttatatcaacgtgccgaactggaaaccaacgaattgaatttattgcaaggaatgctgacttccgttgagaagcagatagagcataaataaaaaaatccccagagattcttatcattcttctggggctttttctcactgtcttgccattcttaaattttgcggaacagcctcaaaatttgagcggaatgggttaatgtctaaaccgcctcggcgggtataacgtgcatagaccgtcagcttttccggttgtgcaaattgcataaggtcggtaaagatacgttctacgcattgttcgtggaactcgttatgttcgcggaacgagactaaatagcgtaataatttttctcgatttaattttttacccacatagcgaatttgcacactaccccagtccggttgtgaggtaatcaaacagtttgatttcagcaaatggctgactaaagtttcttcaactatctcaccttctgccacgcttgctaaatgttcgttagaaaattcgtaactgtcaatttgaatatcttgttcatcaatacattcaccggcaaaatcaacaatcggttgccgggtgtaagcggataatttgtaaacttttaccgaaacttgaccgcttgcacattggcttaggtctttagccaatgtttgttccacttgttccaatgaggcaaatttggtttggttaaagctgtttagatagagcttaaaactttttgattcgattaaattttcactgcgaaaatcaatcgccacatcagcaatcgctacctgtggtaaaccgttttcgtttaaccaagacaattcataacaggtccaaacatctgcacctcgatcaaacggttgttgttcggtaatccctaaaccgtcacggtttaatttacgtggaacaggctgtaaaagcgtaggatcatactcgcttttatactcggttttttgccctaatttcaggacagataatgatttatcgttgtagttcatatttattctcatcatttatatacagataacttataactgtctactattctatagttacgaaaattctaacagatttaatcacttatagttgatataattttacaaatatgactaacgaaagaaatatggtaactaaacgatacgttactcaccaattttttatattcagtgaacatgctagaaaaagttcacctaggaagctgtatgaacgaaaaacacttaaaatcattaaatgaaatctataaactccttgaatcccatcgtatagaaagcaccaaaaccgaattatacgatgctaatcgattcaatccctttcaatttatcacaacagatgaaaatggcttatctcgcataatgtcattttttcttgaccccttagaaactcatgggcaacaagatttatttcttaactcatttttaaagtacttaaagttacataaatttttatcttatgataaagcttctatttattgtgaaaaattaactactaataaaagaagacatgatatttttttagaaggttggatgaacaataaattaacttgggttatttcgattgaaaataaattaaaagatgctaaagatcaggctgaacaattaacagactattataaggacttaaaaaactttggagttccttttttcctaatttatttaccaagatttaaacgcttaccaagcaaagaatccattccagaaatcgactgggaacaactaagtaatgaacacaaagcaatcgtattagaagcaaaagatattattaaatggcttgaacaaacgcctattttagctcctaagataaagaatttcactcaagatttcatacgatttttaaaggaggaaattatgcatgaaacacatgatagtaataaatttttagatcaaataataaaaaattctaattggatttatacggctacttctctaattgaaaactctaataacttatatgaaaaattagataatttattaatccagcagcttcagcaaaagctagagaatgagttcccaataatagttagctttggctggcactttaatactaatggacattcaacaggcttttatctagataagggtgatgtcgatatacaaccttggggagtcggtattgaatttgaatcatctaactgcaaaaatgcttattatggcatttgggctcataaattggatttatctgaagaaaaatataaacaattagatgctatttttacatatagtgactttagaaatagtaaatggtggcttaattggaaatggtgcgataagaatctacaaaattgggatgccgaaacgtggaaaaatgtcataactggcgagttgtctaatcaaatatttgacttattaaaaccatttatcatcgatataaatcatcatataaatgaactagaaaaattatcctgtaaatagaaaatagccgttgtctaattttttaggataacggctatttcatattaatcatttaatataacggactaaatccactaagctgtctaatacgagatcggcttttgcttcgccctctgcggtaaccggtttaccggtacgcactaatactttggttttcacgccggcagcttcagcggctaacagatcttctaatttatcgccgaccatatacgattgtgcaggatcaatatccaaatcagcaatcgcttgagtgaacattccggctttcggtttacggcaatcgcaatcttctttatattcgcctttgccttccggatgatgcggacaataataaataccgtctaacacaacgccgtaatcttcatccagcgaccaatccatccattccgttaattgattaaattgctcttcactgaaatagccgcgcgcaataccggattggttggtgaccaataccaatagataacctttatcttgtaactgctttaacgctttgccgacaccttcaataaattggaagtcgtcaatttgatgtacataaccgtgatcaatattgatcgtaccgtcacgatctaaaaatatcgcctttttcgccattacttcattccttttacaaaatcgactaccatttgatgatgttcactcgttttaaatttatcaaatacctgctcgatcacaccttgttcattaattaaaaaactaattcggtgaatgccatcataggttctgcccataaattttttctcgccccatacaccgaatgcttcggcaacttggtgatccgcatcagacaatagcgtgaaattcagtgcttttttctcgacaaattgcgctaattttttcggtaaatccgggctaatgcctaacactaccacatttaattcctccaattccgacttactgtcacgtaagccgcaagcttgtgtagtgcagcccggggttaaggctttcggataaaaataaaccagcacttttttgccggcaaattggctaagtgaaaccggttgttcgtgctgatctaacaaagtaaattgaggcgctttatcgcctgctttaagtgtactcattgcaaaaaattcctaaaaaaagaccgcttgtattctactacaagcggttaaatctttgaatttttttgcaaaagctattctaaaaaaccttccaataattcatttaaaaatagcttaccgtgctgagtgatccgccaatgcttttcggtttccgtgatgtaatttttgcttaatgcccaatccatggtcggtctaacgatttcacgatcaagaccggtgtacagttcaaattcttgtttcggagtcgcttccaataagcggaaacgattcataaaaaattcaaacggacgatcagcaagctcaatcaaatcttggctgtaacgatactcacctcgcatatagcctttcgggtgtttagttttgctgaagcggtaaatttcgccggtcggataactaatcttaccgtgcgcaccacaaccaattgccaaatagtcaccaaagcgccaataattaagattatgacggcattgataaccttttttcgcatacgctgaggtttcatattgctcataacctgctgatgtaagaagctgatgaccttgctcgaaaatatcccataattcgtcatcgtccggtaaagtcggttggcgataataaaacattgtgttcggctcaatggttaattgataccacgataaatgtggtggtgcgagcgcaatcccctgtcgtaaatcgtccagtgcttgtgccaccgattgattcggtaagccgtgcattaagtcgatattaaaactttgcaaaccggattttgcagaattttgcgcaaaaatgaccgcttgtttcgcctcattcgaatcatggattcgcccaagtttgagcagtttttccggttcgaaactttggatccccattgaaatacgtgtcacaccgccctgtgcatagccaagaaaacgttccgcttccgccgtaccaggattcgcctctagggtaatttcgatattctcttcaaacggaatacgcttttcgacttctgccaacagataagcaatcccctctgccgaaaacagacttggtgtgccgccgccaataaaaatcgaatgaattttgcgattgccgattgcagcctgataagcggtcaaatcttgcgataaatctgtaagtaaatgttgaatatattccgcttccggaatcacacctttttgcgcatgtgaattgaaatcgcaatacggacatttttgtacgcaccacggaatatggatataaaggcttaagggaggaagggttaaattcacgttctaactactatcattaaataaaaatgatgataacgaaaactcttcacgctgaaaagcaaagttttctgtgagagagatcacaaatctaatattcttacctttaccgtcggaactaaactgttatgattaattcaatccatttttacaagtaaatttgacaaattcacttcacaaaaatttgtaaaaaagaatttccgtgatcgttcggcgaaaagttttaccgaacaatttaattatcctattactaacgaggtgttttatggcttctcattttgattatagtgaatctcgccgccattttatgaaactcatggctggagttggagccggttttgcgttttccggtacattaggcactttttcaaatagcgcttttgctgctacaggtaaaagtattgaagcgggaatcgcttatccaatttctaccggattcgatcctctcacatcaagtggtgcatcatcattagcggctaacttacatattttcgaaggcttagtggatttacatccggcaactcgccagccttatttagctttagcggcaaaagaacctgaacagaaagatgaggtaacttatcacattgctttacgtgaaggcgcgactttccacgatggtaaaccggtcaccaccgaagatgtggtttactctttcgaacgtgtattagatccggccaaagcctcattattcgcccaatttattccgtttatcgcttcggtaaaagcgcttgacgataaagtggttgaattcaaattaaaatatccgtttgctttatttaaagaacgtttaaccattgtcaaaatcgtaccgaagcatattgtagaagcaggtcaatctgcatttgatgccaaacctgtcggttccggtccttataaatttgtttctgcaaccaaagacgaccgcattgtctttgaggccaataccgcttataacggtatttatccggctaaagtagataaaatgacgtggttcttattatcagacgatgcagctcgtgtgaccgcacaagaatccggacgtgtacaagcgattgaatccgtaccgtatctcgatgcggaacgcctaaaacgtaaaggaaaagtggaatcggtgcaatcattcggattactgttcttaatgtttaactgtgaaaaagcaccatttgataatccgaaagtacgccaagcgttacattatggtttagatacgcaaaaattaatcgatattgtattcttaggcaatgccaaagcggcaagctcttacgtacaagacactcatcctgattatgtaaaagccgctagccaatatgattttgataaagcaaaagctgaagcgcttctagcagaagccggtataacctcattaaccttcgaattactggcaaccgaccacgcttgggtgaaagaatgcgcgccacttattcttgagtcttggaatgcgttaaaaggggtaaaagtcagcctgaaacacctacaatccggtgcgctttatggtgctcatgtggataaaggtgcatttgaagtagttatcgcaccgggcgatccgtctgtgttcggtaacgacttagatttattactcagttggtggtaccgtggtgatgtttggccgaaacgccgtttccgttgggcgaatacgccggaatataccgaagtgcaaaaattacttgatgatgccgtccgtgccaaaacgtcacttgatgcaaaagctgcatgggaaaaagcaatcaatattattgcacaacaagtgccgctttacccgattgtacaccgtaaattaccgaccgcatggagcgataaatctctcaccggtttccaaccgttaccgaccacaggcttatcattccttggcgtagaacgtaaataacactgacttattgcggcaacggatgttgccgccttcctcttagatttaagccattggtaaaaaaatgcttaaatttaaccgcttgtaccctttctaataaaaacggagaataaaatggaaattgtacttcgccttttactgcgccgtttaatggcattgcctatcatgattttaggtgttaccgccttagtttttttagtcttacaattcacccccggcgatcctgccacagttgccttaggtgaaagtgcaaccgaagcagccaaagagatctatcgagaacaacacggtttaaatgatccggtgattgttcaatatttccgttttctcgggaatttgttagtgctggatttcggtatgactacaccaccggaacagccgattattgatatgattgccaaagcatttccgctcacgctacagctcacttttatcggggtatttttagcagcaatcgtctctttttctttaggtattcttgccgcactttatcgtgatcgttggatagaccaagtaattcgcctagtttcggttgctgcggttgccacaccgtctttctggcttggtatcttattgattcaatacttttctttaaaactggattggttaccgtccggtggttttgtaccgtttaacgaagatccgaatgaatattttcgttcaataattttaccgtcacttgcgcttgccgtgccggtttgtgcctcattaattcgtgtcgtgcgtaccaccatggtggaagaaatggataaagattatgtacgtaccgccattggtaacggcgtaccttactcgaccgtaattcgtcataatgtcttacgcaacgcattaatcactccggtgactgtacttggtttacgggtcggctatttactcggtggtgcggtagtgattgaacaaatcttcgatcttccgggtatgggtaaacttatctttaacggtatcgtgaaccacgacttacacttagtgcaaggtgtggtgcttactatcgcctttaccttcgtattagttaatatcattgttgatattctctatttgctcatcaatccaaaaattcggagtctataatgtttcgtcaaggattagccgctcgactagctaacggtggcgctagatttagagcattatcaaccagttcaaaaattgcattgattttcattttatttgtagcttgcattgcaattttagccccgattgtcgccccgtatgatcccttacaaactcttcgaccggtacaatcaccaagcgatgactatctattcggtaccgatcgtttagggcgtgatattttctctcgtatggtatggggggcaagaacttcactctttattggtttaggtgcggtaggtgtcgccatcttatttggtggcattataggtgcaaccgctgcaaccgcagacaaatttggtaacgaagtgatcatgcggttaatggatattttgatggcgtttccgggcattgctcttgccgcagtattacttgcgacttttggtaactccgttccggtaattatcattacgatagcggtcgtttatacacctcaacttgcaagggtggtacgtgcgaatgtcgtgtcccaatgggaagaagattacgtgcgtgccgaacgcgtgttaggcggcagtcgtacttatattttagtaaaacacgttgtacgcaacactgctgcgccagtgttagtgtttgccacggtaatggtggcggatgcgatcgtatttgaagcgtcactttcattcttaggtgccggcgtacaaccgccgttcccgtcttggggcaatatcttatcggaaggacgtaaccttgtcctaagcggtttctggtgggcgacaacttttgcgggaatcatgattctacttaccgtattagcattaaatatcttggcggaaggtttaaccgatgcgttagtcaatccgaaactcaaaacatcgccgaaaaccaaagaggatgtggcaaaaccgctttctaccgatgtacaagaagcgatggcggaaacactcgctttaaaacgctatttgctgaaattacacgagaaagaaacaactcgcaccgatcgcatgcaattaaatccgaatgcgaaaccgattttacaagtgaaaaatttatcaattcgcttcccgaatcgttacggtgaaattccgctggttgataacatcagctttaccgtacatgaaggcgaaacaatgggcttagtcggtgaatccggttgtggtaaatcaattaccgccttctctatcatgggcttattaccgaaaacggctaaaatcaccggtgaaatcttatttaccgatcgtagtggtaaacaacacgatttacttaaatcggaacagctcaatgcgttgagaggtcatgaaatttcaatgatttaccaagatgcgttaagtgcgcttaacccgtctatgcgaatcaaagaccaaatgacacagctgattagccgaggtggaaaacaaagcgcagaaaccttattacaatgggtaaaactcgatccggaaaaaacgcttaaccgttatccgcacgagctttcaggcggacagcgccaacgtgtattgattgcaatggcactcgctcgtgagcctaaattattaatcgccgatgaaccgacaactgcgctcgatgttgtagtgcaagccgaagtgatcaaactcttaaatgaattacgtgaaaaactcggttttgcgatggtgttcgtcagtcacgatctcgcactcgttgcacaaatggcacaccacatcacggtcatgtatgccggccaagtagttgaagcggcaccgacgacaccgctcttagcaaatccgacccacgaatatacgcgtggtttactcggttcggttctctcaaccgaattacgtgccgaacgcttatatcaaattccgggtagcgtaccgtcaccattcgactttgcgaaaggtgaccgcttcgccagccgttcattacgtccggaagcggatccggagcaacatttacaactggttgccaccgatgatcacccgcaacatttttgggcatcacatttagcaacacaagaaaaacgcatggagggataaatcatgagtatgaaagtgttaaaagaacaaccgattcttgagttatccgatattgtgatgcaatttgcttctcgagacggaacgttgtttaatccgaaaaaattcacagcggtagataatgtcagtttatcgatctatgcaggggaaacggtcgggttagtcggtcaatccggctgcggtaaatcaactttagccagtattatgatcggtttgcaaaaaccgacttccggcacggtcaaatttaacggcttacaaatgaaatacggtagcaccgaggctcgtaaacagttcggtcgtcaagtttcggtaattttccaagatccggcaacagctctcaatcctcgtatgcgtgtattggatattttaaaagatccaatggatattcataacgtattgcaaccgcacgaacgagaaaaacgagtgtatgaattactctctcgagttggtttgcctcgttccgccgctttagttgagccgacccgtttatccggtggtcaaaaacaacgggtagctatcgccagagcattagcactcaatccgaaactgattgttgccgatgaaccaacttctgcacttgacgtatcggtacgggcgcaagtattaaatttacttgctgatcttaaaaaagagctgaatcttgcgatggtgtttatctcacacgatttacaaaccgtacatcaagtttcggatcgcattgtcgtgatgaacggcggtaaagtggtggaaaccggtagttcaagcgaagtattcaattcaccgaaagaggcatacactcgtacgctgattaatgctgcaccgtcattattgtaatttatctcatattcagggcaggtttatcctgcccttttatctatatccattatgcaatcaattcaaattactcaaacgatttatagcgacttacttatcgttggctccggtattgctgggcttgctgctgcggttgaagcggaacgacttgggttaaaaaccacgttaatcagcaaagcacccattggttcaggcgcaagtttctttccgttaaaagccacattaggtattcaagtgaccggtgaaaatgactcggaaaaattccaacaagatattgaacgtgtcggcaaaggtagagccaatccgaaagtagtcaaagcctatatcaaagattcgccccaagtgattgaattactcgaacaaatcggctttaagccttggctacgcaacgacaatcgcccagcctgtttcgctgagtattcacgccctatttatctgatcaataattggcgagaagccgctcaacgggcaaaacaaattcttgatagccaatccactaatgtttatgaacaagcgaccttactgcatattgttaccgaacaaaatcaagtgcaaggagcagtatttagcctgaacacaagcggtcaaatttgctatattttttgcaaaaccagccaaatcattttagccagcggcggtattgccggcttgtataaagacaatctttatccggcggatattatcggctcaacgcatttcattgctcaacaagccggtgcaaaattgaccaatcttgcctttattcaatttattccttcttttgtcgaaccgaaatataaagtgctatttggcgaacatacgctgaaatacgtcactaaaattactgatgaaaacgggcaagatctgtttccgcatttaaccgaaacacaatttcaacagatgatgttagcccgtagccattatgcgccgtttagtgtagatttcacttgtgtcgaatttgatttggtgatgatgaaacatttattggctaacccgcagcaaaaaggcatttacctacactacagcccagagctttatcaagataagcaagagttttatacggtttatcttaattggttacgccaagaagtcgggatagatttggttaaagataaaattgctatcgcaccttttgcccacagttgtaacggcggaattgagattaatgagcatggcgaatcttgtgtcgccggattatgtgcgattggtgaaatcgctcattgcattgagggagcaaaccgcttaggtggcaattcggtcggtggtggcttggttttcgccacacgggcagtggcacaagcggtcaaaaatttgcaaaaaattaccaaaattcaaccgcttgcaaatactgaaacttatcgtttacaggctgaaaaagtgcttaatcagttaaacaatccagcgggagataatgcgctgcttgcgagtacagtactcaaacaaattcgtgaacaaatggctcgttttgctaatgtgtatcgcaccaaagccaacttaaccttactgttgaacgaactgcaacagctcgaaaaacgttttaatccgcttgctcatcatcagcaacaaggcatcgaaatcttttatgcactaaaaaccgcacagcttgtcgtttcgcagatgctaaacgaaccgcacagtttaggcgcacattacttagttgatgagtagtaaaacaaaaaggcaagataacaatcttgcccttttgatcatccgtttagcgattatttaccccaaacttcttcgctgatttcacgaataaagttcagttttgcccattgttgttcttccgtcagaatattaccttcttcagttgatgcaaagccacattgcggacttaaacaaagctggttgatgtccacatactgtgccgcttcttgaatacgagcaatcacttcatcacgattttctaattgaccgtcttttgaagtaattaaacctaaaaccacttgctgatctttgataaaacgtaacggtttgaaatcacccgaacgatcagaatcgtactctaagaagaaaccgtcaatacggcaggtgccgaataaagtttccgccaccggctcataaccgcctgccgagaaccaggttgaacggaagttaccacggcaaatatgcattgtaatggcaatatcgtccgccggtttcgcatccacgattttattaatcatatagacgtaatctttggcaatttggtctaaatctaaaccgcgtgctttataagcggcacgtttgtcctcggcacaaaattcgccccagctggtatcatctaattgtaaattgcgacagcctaatttatagaacacgttcatcgctttgatatacgcatcggcaatatcgtctaataatagctggttgttattttcataacgtgcaatcggctgataatcttccgcacgtacattagtaattaaatgtaacattgacggcgaaggaatggtgaatttcacttccgtttcaccggcaattttttgtaacgaacggaaatgttctacaaacggatgtgattccgaaaaatccactttatcgacaatcttaatggttttcggacgtacgctgtggtgtttaaattgtaccgaaaacttctctgcgtccacttcctgaataccgtctaatgcggctaagaaatccatatgccagaacgtacggcgaaattcgccatcagttaccgcatgtaagcctactgctttttgatgttcaactaattttgcaatttccgcatcttctacttgagttaaatccgcacaggaaatatcgccgcatgaacattgctgacgagcttgtttaatcggatccgtacgtaaaaaactaccgacaatatcaaaacggtaaggcgcagaagtacgttgcgttgcagtagggaataattgagacattgtgtttccttgtaatcattaaaatataaactttactaaattctaacaaattttattttttaatcatctgaaaaaattttgagatgattatgaataatattcatatcgcgtttaatctgtcgtaacctaacaagcggtcaaatttgcataaaaatttgcaaatcatcccttgattattccgctaatgtgacggaataaaacgaagtgtaaccaaacggactttgtacaaaaccttgcacacgcttgctaaccggcacatagttaattgcatgagcaatcggaattatcggtgtatttttttggaaaatttcgaccgcttgttgatataactgctgacgttcagtggcattttgcgtttgtaccgctttttgtaataagccttcaaattcgttatccgtccaacgggaataattagtgcctggaatattttctttgcttaatagcggaaacaggaagttgtccggatcgccgttacggcttgtccagccgtaagtaccggctgaaaattcgccttcacgggttcgtttattaaaatccgcccattcgtggctgactaatttcgcttttaccccaattttcgcccaatccgcttgaataatttctgcggtacgtcttggattcggatttgacgggcgcaccaccggctgtacccagatttcggtttcaaaaccgttcggataacctgcctcagctaacaattttttggcttttgccaaatcaaattcatactgagctaagttttcattataaccaagtaccgaatttgggaacggattagtcgccaccgtaccgcctccttggaacaccgcatcaacaatcgcttttttatcggtagcgtgttgtagtgcttggcgcaccttcacattatctaatgccgcttttttggtattgagtccaagataagctaaatttaacccttcacgctcaaataacgtcactttcggatcttgtttcatttgtgcaatatcagcaatattcgggaaatcaattacatcacactcaccggctttcaatttggcatagcgtgtaccagcatcggaggtaatcgcaaaaatgagccgctcaaattttgctttaccctgccaataattcggattagctttataacgtaccgcctggtcagtttgataaacctgaaattcaaacggccctgtaccgatcggctgttgatccaataattccggcttgccttccgctaataatttatccgcatattcttttgaataaatcgataagaaatccattgccactgttgtaagaaacggactattcggctgatttagcgtcattttcaccgtatgttcatccactttctcaaccgattttaaaattttcggcagattcatccattgataatagaaataagtgccaccggaaacattgtagtaagggtgacttttatccgcctgacgctgaaacgaaaacaccacatcatccgcatttagattgcgacttggggtaaataacttgttgctgtgaaacgatacgtctttacgtagatggaaaatataggttaaaccgtcttcactcacgtcccacttttccgccaaacttggctcgacctcaattttgccggctttaaatgctaataaacgatcataaatctgctgtgagctggcgttaaagtcattggcatcattagtaattgcagggcttaatttttggggtgcggttgcaacacaattcaccaacgtagttgctggcgcagctgcaagcaatgatgaaaagctaataaaaggtagggctaaaaaaatcttagaaaaacgcataaaaaagtccttattcaaactcatttcgcgaacatagaatatttttagatgaatttgaaataacaaaatccacattcttataaccaaaccgctatatcttttacagatttgtaaatttattgtttttatcattttttaagcacaagttcaaaataatatcaaacaccatacaataaacatgattcagaattattcactaaataaataaaaaataatcacataactctctatctaaaaataaagttttagccagatcacaaaattgacattttttacttgtttcttataaccagaagattatgatccaacaaaatttttataattctgcaaattaaataggagagttttatggctacgccatctaatcgtttttccctcacttgggtactcaatctctttggtacggctgttggtgcgggtgttttatttttaccgatcaacgctggtatgagtggtttttacccattaattatcatgaccttattagttggaccaatgacttacctcgcacaccgagggcttgctcgttttgtactttcttcaagtaaaccgggtagtgatattaccaacgtagtacgtgaacatttcggtgaaaatgcaggcaaatttattactttactctatttctttgccatcttcccgatcctattaatttatggcgtaggtatcaccaatacggttggttcatttattgaaaaccaattgcatatggctgtaccgcctcgagctcttctatccggcgtattaattgcggtaatgattggcgtgatgttgcttagcgaacaagcgatgttaaaaatcaccacttacttagtttacccattagtactaattctattcggtttatctatttacctgattccagaatggaatggtgcggcattacaacaaatgccaagcacaggtgatttcttaactaccttatggttaacgattccggtattagtatttgcttttaaccattcaccggcaatttcatcatttgcgctttcacaacaaaaacattatcaagatccgcaaaaaactgaagttgaatcaagtaaagtattacgttcaacagcaatgatcttagtgttattcgtaatgttcttcgtattcagttgtgtattaacgctaacacctgaagaattagcacaagcgaaagcacaaaatatttcaattttgtcttacttagcgaataaattcgataacccgattatttcttacttcggacctttcgtagcattcttagcgatcggtagctctttcttcggtcactatttaggtgcgcgtgaaggtttagaaggtttagtaaaccagttacgtgataaaccgattgaatcagcaaaattcaaaaaaatcactgcagttgttttctttattacattatggattgtagcaaccatcaacccaagtatccttggtttcattgaaagcttaggcggtccgattattgcaatgattctatttattatgcctgtgtatgctatttataccgtaccggcattagctaaatataaaggtagcatcagcaatatttttattgcggtaatgggtacaatcgctatttcagcaatagtgtacggattactataatctctgtataattcgcccttcgaattttaaggcaacaaaccagatttgttctatgcgtttgttgcctccctctttttaacattgtgttgtgattttatgattagtgtatttgatatttttaaagtgggtatcggcccttcaagttcccatactgtaggtccaatgaaagcggctaaacaatttattgatgaattgctggctcgcaaacttttggcaaaaaccgaccgcttgcaagctgatatttatggttctctagccctaactggtcgaggccatagcaccgatattgcggtagttatgggcttaatgggttatttacccgataatgtggatattgaacgaattgacagtgttatcgaacaagtgaagcaagaaagcaaattagttgttgctgaagctgtacctgaaatggcaaaaaccatcacattcgatttctataaagatatgccttttcattacgatttcttacctcgtcatgaaaacgggatgattttaaaagccttcgaaggtgaaacgttattattcgaaaaaacgttctattctatcggtggcggttttattgttgatgatgaaaactttgacagccaagccgacgataccgtatccgtgccattcccttataaaaatgcggaagatttactcaagcactgtaaagaacaagggttaccgctttccagtttagtatggaaaaacgaaacggctctgcgtccgaaacaagaaatctctgattatctggcaaaaatttggaaaacaatggaagactgtatccaacacggtttacatacagaaggtttattaccgggtccattaaaagtagtacgccgcgcaccgtctttacgtagaacattagaagcaaccggcaaatttaataccgatccgatgcaaattatcgactgggtaaatatgtttgcgcttgcggtgaatgaagaaaatgcagcaggcggacgtgttgtcactgcaccgactaatggtgcttgcggtattgtaccggcagtattggcttactatcagcaatttatcgcaccgcttaatcaagaaacgattgagcgttatttactagcttgtagcgttgtcggtacactgtacaaaatgaatgcgtctatttccggtgcggaagtaggctgtcagggcgaagtcggcgtagcttgttcgatggcagctgccggtttaaccgaaattatgggcggaagtccggatcaagtttgtatcgccgctgaaattgcaatggaacataacctcggtttaacctgcgaccctgtgggcggacaagtacaagtgccttgtatcgaacgtaatgcgattgcttcggttaaggcgatcaatgcaagccgtatggctttacgcttaacctcacaacctcgcgtgactttagataaagtgatcgaaacaatgtacgaaaccggtaaagatatgaatgctaaataccgtgaaacttcaaccggtggtttagcaattaaaattttaccttgcgattaagcattgtatttgacaacaagtgattaaccacttatgatttgaagaactgagcggttcaaccgctcagttgagttatttcttattagtaggctggggagctaaggactaacaagaaaataactaggataatgaattaaaaaaacctcgaatatcattattcgaggttttgttttttttagctattctacttttgagcctttcaacaattttcgcatccaagtacgatttgggctgagtacatgccaaatatcttcgctgattggtagcggttcatgacaaatcaggctcgccaacagttcgcccaataacggtgcggtggttaagcctcgagaagctaaaccgtttaccatatataaatttgcaaaattttccgcattttcaaccgcttgtttacggcgtagctgattatacaaattctgatattgtactttttgagcgttaaaattcggcatttgcccaaccatcggcacacgatctcgcagtgcagctctcaccccttgtttagctaaattttgcgaaagatcgatattgcccgtccaatcacaagcggtcaaattttgctgaagttttgctacattctcgtgatgttcttccaaagagaaatctgtttcggcattatcacgcacatggctcgcaccgatacaatgagtattcgctttggaaaccggtgtcaaataaccgtcataacacaccacacattttagctgctgtaagaccggtgtggtcggaatctggctcacttgcccacgcaccggatacagtggaatcccctgtgcttgctggaattgcgtgagtgtatgcccatttgccaacactagaatctgatgactgaacgtttcaccattgtgctgccaatgccacttcccttcactaaattgaggctctttcacttcgtgatttagcacaatctgtaatcctttcgtttgtaaataagcaaacgtaccttgtacaaattgtatcggcgatagccaaccgctttgcggcataaatgcaccgccgttcggcactttcagcccgattttttcgcttaactcagccgcattacatagcttaaacaaactgtcatcattggtttgctgagccattttttccaatttcttcgccgttttatcgttataggcatataacgctacaccggttaaagcatgctcgaaatcaacaagcggttcaatttgtgccaaacgttgcaacgcataatcaaagcaatgcacataaaaacggatattacgctcgtcatcgtcactcagttgcggataaatcgcgccttgcaaattgccggaggcattttgtgccaacgcattgtctttgcaataaagcgtgacttttttgcctttttcaagtagtgataacgcgacaaacaagctggctacaccaccaccgacaatcgcaatatcatttgcttctgtttgtggctcgttataaaaatacggataatttaccggtgccgtttcgctttgttgcggtttttcaccccacagcatttctcgttttttgccgaagcctttgcgtttttttacctcaaatccgaccgcttgtaagccttttctcaccgcacttgcagcggtaaaagtggcaaaactgccgccatttttcgttaaacggaacatttggcgatataacgtttcattccacatttccggatttttatccggtgaaaaaccatctaaaaaccacgcatcaattcgattgctatataaatcgcctaattgcggtaagttatccaacatatcgccaaaccacacatcaagatagatttgctcgaaatgataacgctgacaacctgtttggcgaggttgccaacaagcggtcattttctgtgaaagttttacaaattgcgggtaatttttatgaacggtcgctaattgctcagaagtgaggggaaatttttcaaacgaaataaaatataaacgcttaagtttactattcgggaactcacttaaaaattgctggaacttatcagcaaccgccaaaaaattcagtccggtaccaaagccggtttcggcaatcacaaaagattcggcactatgtgcttgccatttttgccaaagttgattgccatcttggaaaacataatagctttcttcaagaccatcttgggtagaaaagtaaatatcgtcgaattgttcggaaacgggggtattatttgaattgaaagaaagagatgcaaaactgagtttgttcataacatttaccacagaatacacggaaagcacggaagttactgataacattctgtgctttccgtgcttttccgcagtaacagattagaagatattgtaagcgaaaactacgatcatacctaatgccgctacaacagtcatcattgaataacctaaagtacccattttgtcctctctttgttaaatattattgatcaaagtctatcacacttcttagactttgagaattttctctgcacaagcggtgatttttgctaaatcttttacgcctttatgctgctctacaccggaattgagatcgacacctaaacaaccttgcgcgagtgcctgctcaatattttcaaccgaaatcccaccggcaagtattgctttttgttttaattcatttggaatgcgctgccaattaaatactttgccagtccccccttgctgcgtaccgtttttgctatcaagaatataacgtgccactaacggattatcgtgatactcaactgtttccgcttgaacatctaccgaaattgcctgccagatttgcgtttttccggctaattttgctgaaagctcggcaatgtaggcctcatcttccgtgccgtgtaattgcaccgcatataactcaagctgttttgctattttttcgacaaattcgaccgcttgattttggaatacgccgacataacgtaacggtgcattcaccactaattcctgcgcttgacgtaacgataactgacgaggcgaattttcagcaaaaatcaatccgccatataaaaaaccattttcatacactgcttttacatcttgtgggcgagttaatccgcatactttattttcgccgaaaatcactgaacgtactgcattattcagatcgttactgcccatcaagctactgccgattaaaaatgcgtgcgcaaacggtttgattgctttcacttgcgtatgatcataaatacctgattctgaaatcaaacggacatctgccggaatttgatcctgatatttttccactaaacgcacaatgcgattcatatccaccgtcagcgtatgcaaatcacggttattcacgccaatcacttttgcgcccaatgctagcgctcgctcaaattcttgctcagtactggtttcggttaaaacgcccatacctaaagaatgtgctaagtccgccaatctgcgataagtttcgtcatctaataccgaaagcatcagcaaaattgcatccgcattcgaatagcgtgctaaatacacctgatacggcgaaatcataaaatctttgcataagatcggttgcgttgtttggtgtttaacttgatcaatataacgaaaatcgccttggaaatattgttcgtcggtcagcacagaaatgacagaagcgtaatgtttatagacttgcgcaatagcatctaaatcaaactcggcacgaattaatcctttggacggcgaggcttttttacattccaaaatataagcaggcacttgatgagaagctgtcgctaatgctgcataaaaatctcgatcagcagtaacaatttgctgttggaattgtgaaagtggaaatgctttttgtttgttttcgacccaaacggccttatcttgtacgattttttgcagaatagttggctgattttgcatattttctcttttatattatgaattggtggataacacagatgatgctagaatacggcacttatttttatttatcaataaattcactatgcttattaccaaacttcataaaatgcgtactttgcttgataagcatcgtcctctcaatatcgccataatgaaaaatattcaagcggatttaatgttgaaatataatcagcaatccaatgcgatagaaggaaatacattagatatatttgaaactcgcgtgttacttgaaagtggcattaccgctaacggaaaaccatttaaagatcatttagagattattaaccaccaagaagcgattggttacttaaccgatctcgtaaaagaaaatgcaccgctgacagaagtgacaataaaaaatttccactatttgttactacaaaaaaccgataatgcacgagaagccggacaataccgtaatgtacccgttattattaacggtgcagaacatcaaccgccacaaccttttttagttcatccgcaaatggaagaattaatgcattggaaccaagaaaatctcaatacattgaaaccgattgaacgcattgcgatgctacataacaaatttatagcaattcacccttttattgatggtaatggacgtaccggacgtttattgatgaatttagaattaatgaaagccggtttccaagtgacgattttaaaagctgagaatcgagctgactattatcgtgcattggcgttaggtgatttaggtaattatcaaccgatcacagaatttatcgcaaaagccgtttatgaaacaatggaacgtaccttaaaccttatttacccaaactggattaacgaactcaattaaatatgaaaaccaaagttagacaacatttaaccgatttagaaattgcattacgcactcataagcaatgggatgcggttgcaccgagcttggaagatttagcgaacgatcaaccgttttgtctcggcacgcttagcccgactcaatggttacaatggatttttattccccgtatgcacgcacttttagacgccggtgcagatttacctcgcaacttttcgattacgccttacttggaagaagccctaaaagacgaaagctatttaaaagcgattcatcagccggtgttattgattgaattattattaaaggactaaatggaacttgaaattttataccgtgatgatgaactgattgcaatcaacaaaccggctggaatgttagtccaccgctcatggctggataaacacgaaacgcaatttgcgatgcaaacattacgtgatcaaatcggtcaacacgtttttccgattcatcgcttagatcgcccgacttccggtgtgttattgtttgcattaaatagtgaaatggctcgcctaatgagcgagcaatttgaacagcatcaaatggaaaaaggttatttagcgatagtacgaggttatctgcttgataaaggcgagatcgattatccgctaaaagtgattttagacaagattgccgataagttttctcaaccgaaagaagcgcaacaagcggtcactttttaccaaaatcttgccagtgtcgaaatgccttatccggcgggcaaacatcaaaccgcacgttacagtttggttgaattattaccgaaaactgggcgtaaacatcaattgcgccgccatatgaagcatttatttcatccaattatgggcgatacaaaatacggtgacttacaccaaaatcgtaccttaaccgagaaaaccggttgcgaccgattaatgttacattcgcattttttaaaatttacacacccaaaaacagcgcaaaaaattgaagtttttgcaccgcttgatgagcaatggcaacgtttatttatacaatttaattggcaatttagccatttttattagacattaaggattctatatggataatgctctactttctttaacccatgaacagcaacaagctgctgtagaacaaattcaagaactgatggcacaaggcgtgggcagtggcgaagcgattcaaattattgctaatcgtctaagagaagcacatcaaaaaaatacttcggagaacaattcatgaaaaaattatttgcacttgcactcacagcggtgagcgtttcaagttatgcagaaactaaaccggcggttaacactcagccaatgctcagaatgcaagttttcgatatgagcagtaacgtgccaagccctgtggcaaacaatcagctttcactcagcaaaaaacaccaactttgttgggttgcattcaatatgccgtttaaagcatctaaccaagtggttgaagttttacaagctccttcaaccttaaaagtaacgtctgaagacggtaatgtggtttcaacatctgatcaacaaactcaccgcattactacattattaaaaagttcgaataacgaacgcttagataaatgttggggctttgaaaagactgacccgactgggaaatatagcctcacgattcaagtgaacgatgtagtattccctccacaaccgtttgaagttgtaaaataaataagcaaaacgccacttgtaccgtggcgttcttttttagttttttgctaaacgttgttcgatttttgctagattttcttcaaaataggttttgcttgttaaatattgctgcgcttctgtccaactgttcaactgcaaacctgataattggctaaagttgcctaatacttccaaatcttgttcaacggtacgaatataatccgctaattgttgcagtaacacctcgccggaactactctcgagcgctttgctaatttgttgcttaaatttaaccgcttgtccaactaaatagcctcgttgcgctttgcttaaattgctaaaccacataccgtcttggcgtggaatttgttttagtaaagccaatatatcagttaagctgccgcttttaagttccagctctaattcacaaattgcttcttcgccaaaaccgtttttgatcataccttgatccaacgccacttcaatttgcgattgattaagcccaattagccatttacggcgagtaaaatcggtactaaaagttggcgaaagttgctgcgcaatctgttccgcttgtgggatttgcaaattaaagtgcgaatttaaccgcttgaaatccggctgatagctttccaacggtaagttatattcggggcgaatatgcaacccatcgacaatttcacccttggtttttaaagtcatctcgtacttttgattatggttacgcactcgcaaccccattttttgctgggcaaaaaattgttccggcgtatcaaaataagtgttccctaatatatcagtcgcttgcgacaaaacattctgttgcgtaaaccaatccgccaatgtttctacattctccgcttttagcatgatttttagctcaatttcattttccattaaggtatcccgtttatttagttgtataatttgttttattttagcaatttacagcgtattcgagaaatgtttaacaaaatccaaaacaaactgcacaaatttgtgcaacgcggtttagataatcatcttcgccttgccgtgaccggtttaagtcgtagcggcaaaaccgcctttattaccagttttgtcgatcagctattgcatatcaataaagacagccatgcacacgtcaatttatttggtgcagcacgcaatgggcaaattctctcggtgaaacgagttgaacaaggcgatttaaccattcctcgttttgaatacgataaaaaccgtcaatgtttggaaaatgatccgccggtatgggcgccttctactaccggtatcagcgaaattcgcttagcgatccgctaccaacgccaagacggtttaatcaaacatttaaaagaaaccggtacgctctacttggatattttcgattatccgggcgaatggctgttagacttaccgctactcacacaatctttcaagcaatggtcgcaagctcagcaattagtgcataaaggaaaacgtatggaactggcacagccttggttacaagcagtcaaaaacttagatctttttgccaaagcagacgaaaaccaacttgccgaattaagcgaaatttacaccgcttatttgttggaatgtaaacaagccggtatgcaatatattcagccggggcgatttgtcttaccgactgaaaattcaaaaggtgcgccgatttttcaattcttcccgttattagatttaagcgaaaccgattgggaaaaactggaaaccgccccagcaaacagtacctttcaaatgctgaaaaagcgttatacgcaatatcagcaaaagattgttaaaccgttttatgaagactatttttcacaattcgaccgccaagtgattcttgccgattgtttaacgccgttaaatcacagcttagaggcatttttagaaatgaaaatcggcttgcaacaattattcaagcattttcattacggcaaccgttcgctgtttcaccgcctgttttcgtccaatatcgataagctattatttgtcgcaaccaaagcagatcatatcaccagcgatcagctaccaaatttagaaagcttgatgcgccagttagtgcaagaaggcggacgacacgccgcttttgacggtattgaaaccggctatcacgccatttcggcgatccgagcgaccgatccagtagttgttacccaaaacggtacacaaattaaagcgattcgaggcattcgttcaaccgataaaaaacaagtgacgctttaccccggtaccgtaccaagccgattacctgatgcaaactattggcaatttaaccgttttgagttcgaccagtttgaaccgaaaccgctcgcctacggtgagccaattccgcatttacgtatggatgcggtattacaattcttattggcggatatgttggaataaatcaattaacataaaaaagcacgtagctaactgaatagatacgtgctttttcattactttttacttcgcttataaactaaccatcctatcggtatcccaataagtcccaatccaaaacttttccaatcataactaaagatctcatgtcccgggtagcagaaagtaataatagaaaactgtactaaatgaataaaaatacctgtgaaataggtataaagcactacagaaagctttcttttccaccattgtaactgttttctacaagccaaaaatagataaataacaaatatccaagttatgaatgacacagaaatatactgaccagaaaccgctaagaatagatagtgtgtcgcaaaatataaatataaaaagatcgaatagaaaagccaaataatccccaaagtcatacttttatccttaaactttataaaatgcggtaagcccgatgaattgaataagtgctaaaaaagcttactcgctatagtatatataaaaatgtttgctcaaaatgcgaacaacaccgcaatttagggtaattcttatccattatgcaaaaattttcacaaatttaaccgcttgtcgcttgattttaaacggttactgttcactgttaggcagctttgcggtagaatcttataaatttttctcaatctttttaaattatggcaaaaaaaccaaaagtagcttcgaatacgattgcactaaataagcgtgctcgtcatgaatattttatcgaagaagaaattgaagccggcttagaattacaaggctgggaagtaaaatcgctgcgtgccggcaaggcgaatatcggcgacagttacgtgacatttcgtaacggcgaagcatttctattcggtgcaactatcaccccattaaatatggcttctactcacattgtttgtgatccgactcgcacccgtaaattactattgaataaacgtgaactggattcgctattcggtaaagtaaatcgagacggcatgacggttgtagcattatcgctctactggaaaaatgcgtgggcgaaagtgaaagtcggcgtggcaaaaggtaaaaaattacacgataaacgtgaagacattaaagaccgtgaatggcaagtagcgaaacagcgtattatgaaaaacgcaaatcgtggctaatttcaaaaactacggataacagcaagcacggaacaagcggttaaatttgacccgttttttgcctctccgagccatctgtgccgtccgtggtcacaattaaaaattaaggaataaaaaatgatcgaccaaaatcttcttcgtactaatttagacgatgttgcaaatgcacttaaagttaaacgtggctttacccttgatgtagagcgtgtaaaagcattggaagaacaacgcaaaacacttcaagtaaaaaccgaaaccttacaagcggaacgtaacgcccgttcaaaaaatatcggtgcggcaaaagctcgcggcgaagatatttctgcgttattagcggaagtagataatatgggtaacgaattaaacgaagcaaaagtcgctttagaccaagtacaagcagaaattcgtgagttactcttatctgtgccgaacttaccggctgacgaagtgcctttaggtaaagatgatacggaaaacttagaagtatcacgttggggcgagcctcgccaatttgattttgaagtaaaagatcacgtggcattaggcgaagcgttaaacggtttagattttgctgccggcgtaaaattaacggctagccgttttgtggtaatgaaaggtaaacttgctcgtttacaccgtgccttatcgcagtttatgttagatcttcacactgaacaacacggctatgtggaaacaaacgtaccgttcttagtcaaccacgatacgctgttcggtaccggtcaattgccaaaattcggcgaagatttattccatactcaaccattaaccggtcaagatccaaacgaaacgcaacgtccgtttagtttaattccaaccgcagaagtgcctgtaactaaccttgtgcgtgatgaaatcattgatgaagatacattaccattacgctatactgcacatacaccgtgcttccgttctgaagcaggttcttatggtcgtgatactcgtggtttaatccgtatgcaccaatttgaaaaagtagaaatggttcaaattgtagcacctgaaaaatcaatggaagcgttagaagaattaacaggccacgcagaaaaagtattacaacttttaggtttaccataccgtaaagttctgctttgcacaggcgatatgggcttcggttcagcaaaaacttacgatttagaagtttggttaccggcacaaaacacttaccgtgagatttcttcttgctcaaatatgtgggatttccaagctcgccgtatggctgcacgttgcaaagcaaaaagcgataagaaaactcgcttagttcacaccttaaacggctcaggtttagcggtgggtcgtactttagttgcagtacttgaaaactaccaaaatgctgacggctcgatcactgtgccagaagtattacgtccatatatgggcggtgtggaagtaattaccgcttaattactctactgaaataaacacaagcggtctgaatttgttcattttttgcaaattcagaccgcttatttttttattgctatattacagcataaacaacgctaaaaataatgttgctaaaatcataccgggtgcggtacgttttaccatttcgaccggactgaccatcgcaagccccgcacaaacaatcgttaccccggcaatcggtgacattgtacgaccgatagcaccggcaatcgctgccgccatccctaaattcacgtgggtataacctaattccactgcgtgtggtgttactgcagtattaaacgcaattgccgccgcatcacccgagccggtcacaattcccattaaaaatggcccgatagtcgccccccaacgcacaaattcatttgagtgcttaaggaattcaattgcagagtccaccgcaccggttgcttttaagcctgaaacaaacacacttgctgcaataataatacctaatacattggcatacgaattccccataccgttgaaaaattcttcggtaattttaaccggcgaaatacgtgtcacgataatcgcataaatcgcaccgattaacattgcttgcggcacgcccatttgggtccattctaagcccggtgtcttttgtaattccgtcccgccgataacaagaataattaacggcaataacggtgcaagtgcatataacggattaacgccgctaaatttagtttctgcattttgttgctcagctaaataagctttacggtgttcctcaccataatctttcaaaataattgccatgaccgtcaaagcaatcgctccgataacaccggcaatcgttgtataaggtgcatgggctaaattcacttcggtaatggttaaatttgacatttcacttaacattgccgaatgagaagaacccggactcatcattgaaccaaacgtaccggctaaaattgccgcccctgcggttgccggacgtacacctgcactttttaataccggaattaaagttgcccctaccgctgccgcacagcctgctgcggatggaattgcaatattgataaagaaagtcagaatcgttgcaatcggaatcaaaaagaatttcaaaccgcttaacggtttagtaagtaaatgcaccaaatgcgtatcgcattgggtatatttcatcacataagcaaaccccatactggcacaaatcgccataatcagaccgcttgaagtcattgatttagaaaaggcatctaatgctcccatcggattaagcgttacaatcgacataatcagaccgataccgattagcacggttcttgtttcatatttttttatcagtaggtaaactgtgactaaaatgccgataatggcaacaaaaggtttaagttcatacataacaaattccttagtaattaaatgttgaattaactgcttttctgacaagctgcattttttcactaaaacagagaatatcttgctcaccgagtacggtcgcttgttcaccttgaatatgtaatgctgtcccttccagcagcgcataaacctgagcttgggggttaacgatcaaaaattcttccaagcgctcttctcgactctcgccattatgtccttgcattttgccggaaataaaatgtggattaatttgatgtggaaagagatttaacgcattaaaagacggtgggtaagtaatcggcatatcattagtggtcataatagaactaccagcaacatttgcaccggcactccaaccgaaataaggtgtaccactatttactttggagcggataacatccagtaaattatgttcatacatttgctccaataagcagaaagtattaccgccaccaatcgcaatcacatccgcctgttcaataagatcacgatgttgtttacctcgatgtaccgatacgatttcaacctctaaagattgtaatgcgttttttacggttgcttcatactcatccaatgaacgacgtacgcctgcataaggaacaaaagcgactttcttacccttataatcagctaaaaattgtgccagccaaggcaaagtatgcactaaataagcggtatctttatattttgaaccgctcatcaacaacatatttttcatatgtgattctccttttgttagatctcttgcctcattatcttgtgatagaaataaaaagcaaaaataagatattactttttttgacgcttatcacaaaatgacttgagatttcgttatgtaaataattttttgtataaaaaacacaccactcaaaaagttctgtaaagttacataaattaattgatttaaatcaatatttataatataaaaacaagatagacttttatcgctgtcaaggcggaggtcttaccttaagggagtaaaataattttaatttatacctcctgcgccaaaaactgagaaattccgacttaataaatataattatttccattgtttttggcgcttattttatttttttagcttatataggaattaataatgctttcacttattttgtttgtcggaacattttggtacgcgtggtactatgtttctcaatcactacaaacaaaaggcaaaaataaacttattagtcatgcttgtggtggtttatttgggttttgtatggcaagtttgtcgttatttacaagcgggccagaaaaagctgagtctgaaaatccgcagattctaccgaccgttcctcgcgctatggtgtatacaccgacatcggcacaatctcttattcaagaaaacccaactcaagcctatttaagtaatagctttgcaactccgttacctaaaatggaagaaacggaagatgaagcccatatcacaattcgctcatcctattctccaaaacatctagaaaagattaataaagagcagtctgtttcccgtttagctacgcgccattcagaaaatactaaagaaaatgcgaaacctaaaaaaaataaccatttcgtagaaaaacaaaatcaaagcatgaaaaaaattgttcattcagaacatccaaaagcaaagccattgaaaaaacaagtaagtgaagagttatctttccaatgtggtaaacgtcgttgtggacaaatggataattgtgcagaagctaaatatcatttacgtcgttgtggcgtaagtagcttagatagagaccatgatggtgtcccttgtgagaatttatgcggctaatgagcttttatcattagaaaacataacataaattattgggaacttttctcattaatttgttgttaaaaaataagcatagtgcattttctatgtcgaaaaaaaccgctatctcttcaataaatttattaccacattatgaaggtgttatttctattcacctatacttataggaaatttcaatgtgttagttcttgattttatgtttttaggtgccctgagctactgtatctatttaacaataagccattaaataatttctgctttcgaatgttttgcctaaagcagaatattacgaaatcaaaaattaataagacaatgcctttttggttttcctaaaaggcattgtttttatacaaacttgcaaaaaatccctaaaatcccaccgctttccattcaaaaaaaggcatttttacggtatgctagatacaatttttttcgataagttttaaaggtcaaaatttatgcaacaacaatataacccaagtgcaattgagcctaaagttcagcaattctgggcagaaaataaagtttttaaagcagttaaagatgtaacaaaagagaaatactattgcctttcaatgttgccgtatccatcaggtaaattacatatggggcacgtgcgtaactacacaatcggtgatgtagtttctcgttatcaacgtatgatcggtaaaaatgtattacaaccaatgggttgggacgctttcggtttaccagcagaaggtgctgcagtaaaaaataacactgcaccggcaaaatggacatacgaaaatatcgaatatatgaaaggccagctcaaaatgttgggcttttcttacgactgggatcgtgaagtaaccacttgccgtccggaatactataaatgggaacaatggttctttactgagctttataaaaaaggtttagtctataaaaaaacctctacggtcaactggtgcccgaatgatgaaaccgtacttgcaaacgagcaagttcacgaaggttgttgctggcgttgtgatacacctgtggaacagcgcgaaatcccacaatggtttatcaaaattaccgactatgctgaagaattattaaatcacttagataatcttccacagtggcctgatcaagtaaaaactatgcaacgtaactggatcggtcgttctgaaggggttgaaattaccttcaaaatcgccggttcaaatgcagaattaccggtttacactactcgtccggatacgttcttcggtgtaagctatgtagcggttgctgcagctcacccattagccgaaatggcagcagaaaataatcctgcacttgcagaatttattcgtgaagcgaaaaacaccaaagttgccgaagcagaattagcaacaatggagaaaaaaggtatggcgacaggcctgttcgctatccacccgctaacaggtaaagaagtaccggtttgggttgctaacttcgtattaatgcactacggtacaggtgcagtaatggctgtgcctgcacacgatgaacgtgactttgaatttgctcaaaaatacggtttgcaaattaatcaagtaattcaaccgcttgacggtgctgaatgggatttcacaaaagcggcttataccgaacacggtaaattaatcaattctgctgaatttgacggtttagactttaataaagcgttcaatgcgattgctgataaattagaatcgatgaaagttggtaaacgccaagtaaacttccgtctgcgtgactggggtgtgtctcgtcagcgttactggggggctccaatcccaatgatgactaccgaagacggcgaagtggttaccgtaccaatgcaagatttaccggtgattctgcctgaagacgtagtaatgaatggcgtacaaagcccgatcaaagctgatcctgagtgggcgaaaaccacttacaacggcaaacctgcgttaaaagaaaccgatacattcgacacctttatggaatcgtcttggtactacgcacgctacacttgcccgcaatatcacgaagggatgttagattctgacgaggcaaactactggttaccggtggatcaatatatcggcggtatcgaacacgcgacaatgcacttgctctatttccgcttcttccacaaattgttacgtgatgcgggtatcttaaattctgacgaaccggcaactaaacttttatgtcaaggtatggtgcttgctgatgcgttctattacaccagcccgactaacgagcgtatttgggttagcccaacacaagtgacgttagaacgtgatgaaaaaggccgcattatcaaggcgactgatcctgaaggtcgtgagttagttcacagtggtatgaccaaaatgtcgaaatcgaaaaacaacggtatcgacccacaagaaatggtggaaaaatacggtgcggatacagtacgtttatttatgatgtttgcttcaccggcagaaatgacgcttgaatggcaagaatccggtgtggaaggtgcaaaacgcttcttaggtcgtgtgtggaatttagtgtatgaatacagccaaaatcctgcgacagcagcattagatgtagcagcattaagcaaagcacaaaaagagcttcgccgtgacgtacacaaaaccattgcgaaagtatctgatgatatcggtcgccgtcaaacattcaacaccgcaattgcggcgattatggaattgatgaacaaactgacaaaagcttcactcgacaatgatcaagataaagcggtaatggcggaagcactcagtgcagtagtacgtatgctttacccaattacgccacatatctgcttcgagttatggcaagcgctaggcaataacgatacgattgactttgcgccatgggtagttgcagatgaatcagcaatggttgaagacgaaaaattggttgtggtacaagtaaatggtaaagtacgtggtaaagttactgtttcagcaacagcaaccgaagatgaagttaaagcaattgcgaaagcggatgcaaacgtagcgaaattcttagaaggcgtagaaatcgtgaaagaaatctatgtaccgtataaaatgttaagttttgcggtaaaagcctaatagcaatgagggcgaactatgttcgccctttattgtgaatattacgaaaatgggtatatgtagcacttctctacaaccctattttgattggagttcccaatgttaaaaaaactctctcttttagccgttctcggtttaaccgcttgcggttggcacttcaaaaacaatgaagtgctaccgcaagatctgcgtacactgacatttgaaagtgccgatcagcatagcgatatgtcgcgtactttacgtcatcaactacaacttaacgatgtagaattagtttccgcaacggaaggcgtcgctaaattacgtcttgttggtgcttcaagcggcagtaaagtcgtttcggtgtttaaacaagcgcgtgaagcggaaaaattactcacgttaaatgtacaagcaatcgtggatgtaccgaaaaaaggcgcatatccgttagaagtttccgttcaccgtactttctttgatgactctcgtgccgcattagcaaaatcggcagagcaagaaatgattatgaaagatatgtatgagcaagcttctcgccagcttatcatcaaaatggccggtttacataaagaattaaatcaagctaaataattcattaaccacagataacacggatttcacgcaaacaagcggttaaattcttgcacttttttacaagcgggcaatccgtgtttatccgtgtaatccgtggttttcaatatgcaaaaagttttccctgaagcacttcctactgttttatccaaaagtctctcccctttttatctcttgaccgggaacgatctgttattactgaacgaaagcaaagatcatatcgtacaagctgctcgtttagccgatttcgatgagaaacaagaagtcagtattgcaaatgacacaaaatgggaagatctctttgaggccgcacaatcaaacggtttgttctttaatcgccaaattattattctcaacctgccggaaacgccaactgcagcacaaatgaaaaatgttgcggagttatgccgttttagccatccggatctattgttgattctctgcttgccgaaattcagtaaggcaatggaaaagcaagcatggttcacacaaatcgaagcacaaaccgtacaaatcaattgccaaacgccggaaatggctaaattaccgacttggatctcacatagagccaaagctatggaattgcagattgagccggaagccattcagttgctctgttatagctatgaaggaaatttattagcgctaaaacaagcgttacagatgctgcaactccgctttaacgacggaaaaatttcactggctcgcgctaaagaagtggtggaacaatccgctcaattttcaccatttcaatggattgatgccttattagaaggcaaaattgctcgtgcggaacgtattttaaaacatctacaaaacgaagaagttcaaccggttgtcttgctacgtattattcaaaaagaactactggtgctgctggaaattactcgttctccgcaaccagtgcaaaatagcaatcagccgttatatatgggtaatttacgtgcggaattcgaccgcttgaaggtctggcaaaatcgccgtcctttttatcaagccgcagtgcaacgcttaacgtataaaaaattgtatcaacttattcaacgcttagcggaattggaaaagcaagtaaaacaagaatttagtgatgaaatttggctggaattagagcgtttttccgcctattttgaatagaaaagtgagtacggaagctactacaagcggttaaattttatgataaatttgcaatagcttccgtcatagttattggttagtaatgcccttctaaatccgaagtcatcacatcattctcaactgccgcaatacgcttttcttcatttgcccattcacccaaatcgatcaattgacaacgttcgctacaaaacgggcgatatttactttccggcttccaaatcacttcttgatgacaagtcggacaatttacgatagtttctgacattcgctttccttatattttgctaaatctaaatactgttggtgtaaggtaaagacttgtgtttttatacgctcaagcccctgttccaacggcaaattattttcaatcacatcatcggcataacgcagtcgctctgttcggctaacttgtgatgccataatgcttttaatcgtttcaaccttactttgatctcgcttggttgctcgttccagctgaatggctggctctacatcaatgacgattactcggtcacaaaattcagtaaggttattttcaatcaataacggtaccacaaataataaatatggtgcggaacaggcttgtatttggcttaacatctcttgacgaatagccggatgcaacaagttatttaaccatattttctcttgttcttgatgaaaaataatttgacgtaacttggctcgatccagttcaccttgagaggttagaatctcatcgccaaaatgctcggcaattttactcaatagcggtgcccccttttcaaccacttggcgagcaacaatatccgcatcaattaatggtacgccgagttcggcaaataagtttgcgactgtcgttttgccacttccgattccgccggttaaaccaactacataggtcatttttaattcccatactaacaattaggcataaattttatcaataattagtacgaaagtcgaaaagctaataaaaggaataaaaggcaattttactaaagtacgcttcattatggcttgatagccgaaataataaatacaacctgaaacacaagccagtaagattaatttcaacatatcgtcaatgttaaacaaaggcgaaattgagctaatcactaagctatcacctataccaaatgcctctttcttccagaaccacaaaattccgtaatgaaggcaggtaaaaaataatatacaacccaataaggtttctatatgtgcagccattggttcatagaccagagccaaaacgaatatcgcaataacataacgaatatccgttaaatagtaacaagaatccaacacactcaaaaacagcaaaatcatcaataaaaatgcgagtgtcattgagggaatatgaaatgtaagtaatggaaaagcccagaagaaaaaattagccaaatagctttgtttgggttgtaattttgaatgctgactaaaatagtcataactatgtataggaggcaataagctactgtattcttgatatacttgttgattaatatgattagcaaataacttgatggctcgtttacaccaaaatgcaaataaaaatgctattagtgtcgcaaaaaattgattaaattcaaccgcttccattatacgagaatccccaaatcaaaaatcggcaaataaagcccaattaaaaccgtgccaataataatccccataagtagcattaaaatcggctcaagtaattgtgaaagcaaatctatttgataatctaatttcagctgataaatatcactaatctgcgtacacatcaccgctaaattagcacttttctctcctatcgtgatcatttgtaccatttgtggagtgaatactgccgggtttaatccttccgaaaatttatacccttgttgtaataaagataacgtaagtcgtacttgttcctgtaaaagtctatcgtgcattttctcagctaaaaaagcttttagagccacttctaaatgcagatgggcacttaacattagcgcaagattctgagtaaagaagataattctcgtataacgaataacttgattaaagaaggggatataagacaacagacgcatctgacaagcggtcaaatttccgaatttttttgcaaaacagagcaacactcccatcactactatactgccacaacatagaaatatcccattctgtcgtaaaaacgcagagagagaaaataataatgacgttaaccatggcaaattctgtgccttacccatatacaaatcggcaaattgaggcacaataaaaactaacaacccaagcgtcaatacacacgaaatgactaatacaatcagcggataaaatgtaatttttctgactttcttcgctaatttatctgcttgattacgtgttttagcaatattttccaaaaccacacttaatttaccactttgttcgcccatccgaattaattggatttcttgcttagaaagataaagatccaatttcgctaaactcgcagaaaagctatatcctgagcttatcgaagcatttaaagctaatagccattgatataacttaatattcgtacaattttcctgctgcatcattaacgcttgtttaaaaggaatggaagcattaatcaataatgctaattgcgcaagaaattgagtaacttcatctgctttaggctgtcgagaaaaagtaaaattgcgttgaatatgaatatattgataaccttttgccaagagcttttgttctgcctcagcatgattttgggctaataaaataccactttgtttttgttgaaaacgattcttcgctttccagtgaaattcaaaaatactaaccatcacctaacacccgctttacttcgtctactgttgttatgttagccgctaacttttgttcagcactggctcgtaaattgtcataatccaaataagcggtcgatttttcaaaaaatttaccttgttttgcaagtaattggtaaattcccgttcgccctttataaccgtgataacagttatcacatccttttccgccacattgcggacaacgtttacgtaataaacgctgtgcgataatcagttgcagcgaattcttaatctcatactctttaatccctaattgtagtaaacgctcaatcgcagacggtgcatcattcgtatgtaatgtagaaagcactagatgccctgtttgtgctgctcttaatgcaatttcagcactttcttgatcacgaatttctcctaacataataatgtccggatcttgtcgtaaaaatgttctgagtaattggctaaagtctaattgaattgcacgatttacttgagtttggataatcccttctatctcaatttcaatcgggtcttctgccgtcagaatatgccgttcgctattatttaaataatttaacgcactatataacgtaatacttttaccactgcccgttggtcctgtcaccagaatcagcccttgtggttgatgtagtgccgtaagtagtaattgtttttgttccggtgagaaacctaattccaaaaaatcgaaatgagtaggtttattcttttgtaaacgtaaaacgattttttcaccaaagctcgtgggtaaactggacactcgaaaatctaatgtctcagccgttaccgtcttaaaattaaattggccatcttgtggtaaacgtgtttcgctaatatctaatttagctaacaatttaagcctcgtgataatacgattagctaaactaaacgataaacttttatagatatgcaataccccatcaatacgcaatctaatctgtagcttctctttttgcggttcaaagtgaatgtccgaagcattttgctttaagcagaatttaaataaattatctaaaatctgaataatgggatcattttgattgagtagatctaaattatccggcgattgataatttaactcagtttcctcgtatagtgattgctgttccggtgaaagttgattaagcaagtatttcaattcatcggaggaaatcaaaacaggttcaattgttttatgcgcaataaatgcaaaaatttcacaagcacttaaattattcatatcatcaattgcaagccataacgtatcgtcattttcttgaatcggaatggctaaataacgcaacaaaatatgtttttcgtcacaatttttctgccacaaggattcagagatatcaaatacctgctggctattcatatcacaaaccgaatactgcatttgatttcctccttatattattattccgagcaaaatgctgcggggaataaacttttatcctctcctgaacaggttgttttccacgtcagtgttttacttgaataatccggtgtaagtgtataaccatatcccgctacgctgcccttgccattcacggttatagtaccggcagttacagagactgaatctaaatacttagaatttttaagatcatcgccattcttaatgccattggctccactaaaacagctattggtagctccagtgttataaatacaaatttctacatccgttttatatgcagaagatgccgctaacagttcggataatgccgcttttttggtgtaattgttataagaaggaatcgccacagttgctaaaattgcaatgattgcaatcacaatcattaattcaatcagggtaaatgcctgttgtatcggtttaattatgtgtttcatctataagttccttttttgtccacgcttattgcgctctattagtttgcaagctgttttaaatcaatgcgataaccgaacatcaaattctcgatccggatcgcaaaaacaaattcttacctgtttatttactcagtattttttgctatgattttatcggtttaaatcaaatagaggtcaaaatggcaaaagcaccgaaaacggcttacgtatgtaatgattgtggcgcagaatattctcgctggatgggtcaatgcaaagagtgcaaagcatggaatacgattagtgaagttcgcttaatttctagtaaagaatcaagcaaaaatgaccgcttcagtggctatgctggagagacttcaggcaaggtacaaacactttccgaaatcagcttacaagaagtgcctcgttttagtagtgggtttaatgagcttgatcgcgtactcggcggtggtgtcgtgcccggttctgctattctcatcggggggcatcctggtgcgggaaaatcaaccctattactgcaagtaatgtgtggcttatcaaaaatgctaccgacgctctatgtcactggtgaagaatcattacaacaggttgcaatgcgtgctaatcgtttagggctaccaactgataacctgaaaatgctttcggaaacatctgtcgaacatatttgcaatattgccgaccaagaaaaacctaaattaatggtaattgactctattcaagtgatgcatttatccgatattcaatcctcgccgggttctgttgctcaagtacgagaatgtgcatcatttcttacccgctatgccaaaacacgccaagtggcaattattatggtcggtcacgtcaccaaagacggtacgcttgccggcccaaaagtgttagaacacgctattgatgcctcattattgctagaaggtgaatctgattcacgtttcagaacattacgaagccaaaaaaaccgatttggtgcggtaaatgaacttggtgtatttgctatgactgaacaaggtttacgagaagttaaaaatccatccgctatttttttaagccgtagtgatgaattggtttcaggcagttctgttatggtactttgggaaggaactcgcccattattagtcgaaattcaagcgctggttgatcattctatgttagctaatccacgccgtgtggcggtcggtttagatcataatcgcttatcgctcttacttgcagtgcttcatcgccatggcggactgcaaatgtctgaccaagatgtttttgttaacgttgttgggggcgtaaaagtcacagaaaccagtgccgatcttgctttaattttggcactgatctcaagttttagaaatcgcccgttaccacaggacttagtaatttttggtgaagtaggacttgccggcgaaattcgtccggtgccgagtggtcaagaacgtattagcgaagcggcaaaacacggttttaaacgagcaatcgtgccatttggtaatatgccgaaaaaaccgataaaagatatggaagtgattggggttaaaaaattaagtgatgcgctagatgcgcttggtaatttataatcttgttaatttaaatttagctacgatataaaaactttcattcaataggaatcttatttatggcaatgcaaatcacattatcgcaacaagccgctccggaacaatggggcaaaaatgcaattctgtcagccaatgaacaaggtatgacaattcacctacaaaaagatccgttaacgactattcaacgtgctgcccgtaaaattaaaaatcaaagtatattgaatgttgcacttaccggttctgattggggcctagaagaatgctgggcattccatcaaggttttgtcagtgtccgcaataccggaacagtaaattaccctgacttagccgaacaacaagcggaatttgacgcacgtgtacactgctctagctttactcgatctttgattaacgaatcttctgaaacacttacacctgagaaattagctcaaaaagcagcggagtttattaccaaacagtctgagcaatatctcggtaaaaatgcggtatccgctgaaattatttgcggtgaagaactgaaaaaacagggttatcacggcatttggactgtgggtaaaggctcggcaaataaaccggcattgctcaaattggatttcaatccaagcggtgatattaattcacctgtgcttgcttgtttagtcggtaaaggcattaccttcgataccggtggttatagcattaaaccgagtgactcaatgagtaccatgcgtaccgatatgggtggtgcagccttattaactggtgcattaggctttgcaatcagtcgtggcttaacacaacgtgtaaaactctacttatgctgtgcggaaaatatggtaagcagtactgcatttaaattaggcgatattatcgaatatcgcaatggcgttagtgcagaagtgttgaataccgatgcggaaggtcgcttagtgttagcggatggcctaattaaagcaagtgagcaaaatgcaaaatttatcattgatgcagcaaccttaaccggtgccgcaaaagtggcggtcggtaatgactaccattcggtactttctatggatgatgaattaaccgctcgcctatttaatgcagcaaaagcggaaaacgaaccgttctggcgtttaccatttgaagaatttcatcgctcacaaatttcgtcatcatttgccgatattgccaatatcggatcggtgccggttggtgctggtgcaagtaccgcaactgcatttttatcgtacttcgttaaagattacgctcaaaattggttacatattgatgcctcagccactttccgtaaaacagcaagtgatttatgggcagccggtgcaaccggtttagggatgaagaccctagcgaatctgcttttatctcaataagcttttagtaaaatttctggaaaatttaaccgcttgttccgctaaagttagcgtaaaacaagcggttttattttgctttgtgtataatattacgaattgacttctattttgccatttaggaacaaatatgaattacttagcgagcgcaaacgaaactctcagcctttatacccaagcaattaaccagcttaatcagcgtttagacggtacatttaatcaagcgatcgaaatgattttaaactgtgaaggccgtgtcgtggttgcgggtatcggtaaatccggtttagtcgggcaaaaaatggtagcgacgtttgcttcaaccggcacaccaagtttttatttacatccgaccgaagcgttccatggcgatttagggatgttaaaaccgattgatgtggtgattcttatttccaacagcggtgaaaccgatgatgtgattaaattattaccaagcctaaaaagctttggtaatacaattattgcgatgaccggaaatccgcattcgacactggctcaacatgccaatttaattctcaatatcggtgttgaacgagaggcctgcccaaataatcttgccccaactacatcaacactagtgactatggcgctaggcgatgcgctagcgattgcattaatcaatgctcgtggttttaaagcggaagattttgctcgcttccacccgggcggtagtttaggacgtaaattactcaatcgcgtgaaagatgtgatgcaaaccaagttacctattgcgcaaccaaatgcagatttcagtacgattttaagtgtgatgaatgaaggcagaatgggagttgcactgattatgcaaaatgaagatttacagggcattattactgatggtgatattcgccgtacgctcgctcaattcggtgctggaagtctaacgaaaacagcggaacaaattatgtctaaaaatccgaaaaccatttcggataatacttatttagcgaaggcggaagaaatgatgaaagaattgcatatccattcgcttattgcgctgaatgacgagggtaaagtgtccggtattatggaattctcaagttaaggatattttgtggcgaaatcaaattatattacgcgtagcggatggcaaaccttagatcaagagcttaaatttttatggaaagatgagcgtccgaaagtaacacaagcggtttcagaagcggcggctttaggtgatcgtagcgagaatgccgaatatatctatggtaaacgtcgtttacgtgaaattgaccgccgagttcgttttttatccaaacgtttagaagtgttacaaatcgtggattatcatccgaaacaagaaggcaaagtgttttttggcgcttgggttgagcttgaaaatgagcaaggtgaaaccaagcaatatcggattgtcggttgtgatgaatttgatccggctaagaattggatctcgattgattcaccggtagcccgagcgttaatcggtaaagaagtggatgatgaaattaaggtcgatacgccacttggcaaaagcttgctatatatcaataaaatctggtacgagaaagaaagtctttactagacataaaaatataagcggtcgtttttaacgggaaatttgcaaaattccagtcaaaaacgaccgcttgtttttagcacgtcaaacgaaaaattagatcgcttttaatacgtttaccatttcaattgcacctaatgcacactctgaacctttgttacctgctttagtacccgcgcgttcaatcgcttgttcaatattttctgtggttaatacaccgaaaattaccggtacaccggtttctaatgcaactgcaccgataccttttgccgcttcattacatacgtaatcataatgagttgttgaaccgcgaattaccgtacctaagcagattaccgcatcatatttaccgcttgttgccatttttttcgcgactaacgggatctcaaatgctcccggtacccacgccgtatcaatattgttttcatccgcaccgtgacgcactaaggtatcaattgcaccacttaataatttatcgttgataaaatcgttgaaacgtgcggttacgataccgaattttaaacctgtcgcaactaagttacctgtaatctttgccatttttttgtcctcttgaaatatgcaaaattttataaaaaagtgaccgcttgtatcattttatagtagggaagcaatgcttgcttccctaacattacatacagtcgttaaagttagaagttaaacatatgtcccatttttacctgttttacttttaggtagtcaatgtcatttttgttcggttctacaataatcggctcacgtgcaacgatatttaacccttgctcttttaagccttcaatttttgccggattattggttaataaacggatcgatttcacgcctaactgctggaacatttgcgcaccgatataatactcacgttcgtcctctttaaaacctaaagcaacgttcgcttcaactgtatccatccctttatcttgcagttcgtaagcacgtaacttattaattaaaccgataccacgaccttcttgacgtagatacagtacaacgcctctaccttctttttcaatttgtgtcattgctgcggcaaattgttgcccgcagtcacaacgttgagagccgaacgcatcaccggttaaacattcagaatgaatacgcgctaaaacttgctcaccgtccgttaaatcacctttgactaacgcaacgtgttctttacctgaaatcacttcaacaaagctatgcgccataaactcgccgtatttggttggcatttttaccacggagatttgtttcactaagctatcatgcttacggcgatattcttgtaattgttgaatcgtgataaatggcatattgtgctctatggcaaatttttgtagatccggcatggtcatcatggtgccgtcatctgccataatttcacaacataaaccagcgtgttttaaaccagctaaacgagctaaatcaacagtggcttcggtatgaccgttacgtactaaaacaccaccgtcttttgctactaatgggaacatatgccctgggcggcggaaatcacttgctttcgcactatcatctacaattttcattgcagtaattgaacgctcaaaggcagaaatgcctgttcctgtatcaatatgatccaccgataccgtaaatgccgtttcatggttatcttcattgactgccaccatcggatggaaatttaactttttagcaatttccgttgaaaccggtgtgcaaattaaacctttaccgtaagttgccataaagttgatattttccggtgtcgcaaattctgccgcacaaataaaatcgccttcgttttcacgatcttcatcgtcagtcactaaaatgattttaccttgacgaatcgcttcaattgcatcttctacttttgaaaattggaaatctgtcatcttcttttcctaaaatatacattttttgtcggtagagacacactgcgtgtgtctctacaaattttaaaatcctgcctgctttaaaaagtctaaactaagattacttttcggctcatccgccggctttttcaataaaaactgttcgatatatttgccgacaatatcattttctaaattgacaatactgccgatgtttttcgaacctaaattggtttctttaatcgtatgcggaataatcgacacacggaagctttcatcgtcggtatctactacggtaaggctaatgccgtcaatggtaatcgaacctttctcaataatataacgcattaactttggagaggttttaatgcgataccacgttgaattatgtgccggtgtgatttccgcaatttcaccggtaccgtcaatatgacccgaaacaatgtgtccaccgaaacgtccatttgccgccatcgcgcgttccaaattcaccggactattcggttttaattcgcctaatgaagtacgttttaacgtttcagacatcacatcagcggtaaattggttgtttgaaaaagacgttacggttaaacatacgccgttcaccgcaatactgtcgcctaaatgaacatcttgtaatacctttgttgcattaatcgtcactaccgcaaactcaccttgtttatgaatttgagcaattttaccgacttcttcaataatacctgtgaacattttttcctccgctgtttatatctactcgctcttagccagagagaacatcataaaacttcataatccaacaaaatatcttcgccgatgagttcggtcgatttcaattttaatttaaccgcttggtcgatttgttgaatcccttcgccgccgattggggttttcgcttgtttaccaccgactaatttcggcgcgatataacaatgtactcgattcacaataccactttctaacgcactgaaatttaaacttgaaccgccttctaataacaggctgtcgatctgcatgtcaccgagcttttgcaaaagatcttgcaaatctacccgcttgtttcgtgctttacacactaatacttctacgccaagcgatctaaattgttcaattttttgcaaatcgtcacaaacggttgcaatcacggtgcgatattctttcgctgtttgcactaactggcaatccaacggtgtacgtaattggctatcgcagacaatccgaaccggctgtttcgcattcggcattcggctatttagcatcggattatcggcaagtaccgtatctactccaaccataatcgcactatattgatggcgagtttgttgcactcttgctcttgccgattcaccggtaatccatttagattcaccggtactggttgcaattttgccgtctgccgtcatcgcatatttcatcaacacatacgggcgtttagtttgaatatagtggaaaaaaatcgggtttaacgcatcgcattcttctttgagtaaaccttccaccacttccacaccggcttgacgtaactgacctgcaccacgccccgccactaaaggattcggatcacttgaaccgataaacacttttttaatgccccgttcaattaataaatccgaacaaggtggcgtgcgtccgtgatgacaacaaggctcaagtgttacataagcagtcgccccggaaagatcttccttacaatgtaaaatggcattacgttccgcatgccagccaccaatcttttcatggtaaccttcggcaacgatttcaccgtttttgacaactacacaaccgacaagcggattgggattcgtccagcctaaaccttgttttgccagtgcaatggcacggcgcatatagtctaaatcagtcattgttttgaaactattttaagggcagaggaaaacacattacaggcatgtttaccctaatgatgaaaaaagccttgaaatctttcgatctcaaggcttgtaaaaaagataggaaaaaccaccgcttacacggttatttcatcttcttccatccagactatactgtcggtactggaatctcaccagttcctgccaaacctttttcgttcggctcgcggactttaccgccgatcgggaatttcaccctgccctgaagattattaaaaaatttttgcaaattttgcgacttttgattgtcaatgtcaagcaagaattagcgtttatccaatgccattgataataaagtaattggatgtaaacaagtaacattgctcgacatatcaatctgccatttacaggtttcgcactctgaaatcacataatcaaaaccgccctcattgatatgctcaaacaacgtacggccgatcgcttgtgacgtttcatagttttccgctttaaaaccgtaagttcctgcaataccacaacattgcgatggcaacatgactacttctaactctggaatttgttttaacaattccaacgtataaggtgcccaaccggctttttccacatgacaagcagtatgataagcaacacgtaaacgcatcggtttaagcggtaattttctgcctgctttttgcaatttgtataagtggcgtgtcacaatatcaatatgcgatttcactttggtattcggcataccgagtacatggctgtattcttctttaatatttgccgtacaacttgaagaagtaccgatcacttctaactgtttatccacagttttttcaagatatttcaggttaaattccgcctgtttttttgctctttcaggaaaaccgttcaccattaacggtaaaccgcaacatttttctttttcaagcaagaccacaccgatatccagtgcattcatcacatcgatcacttctttacctaactgcggattattatagttcacataacaaccatggtaataagcgacttgctctttgaattgcgcctggcgtttcgcttcttttttcatataccaattacggaacgaaccgaatgaatatttcggtaaggtacggtgttggctgacttttaaagttttctctaacaagaaacgagtcgcttttaaaccggtaatcgtattcacaatcggtgcaaacggggtattcatcgtccccataatatcggtattacttaataccgcatcacgcaatttatgaatcaacggtttattttgacgctcaacgtgacgatttcttgcacgtacgataatatcgccgatttttacatccgacgggcaagcaatttcacaacgtttacagttcgtacaatatttcaaggcttcatcatagaaatctgggcttttcaggcgtaaacgctcaccgtccggaccggattgttttggtcccggataaaacggattattacgtgaaaccggacataccgccgtacaagcggtacatttcaaacagctttcaaaacttgggtcaaaatgttgatgaacaaccggagattgtgcgccttgacgtgcattttcaatcaattgttggatattcattttatacctccgatttgttctgcaacggttaatgccgttaccacagcaacacccgaaccacaaccttgctcaatgccttggaaaccaccaatgacattgcccaccgcatataaattcggcacaactgcaccgtttttttgcacttggcaagccgagttaatcaccacaccggcagattggtaaggttgaggtgccgcaaagcggttatttgtccaagtaaagcgatcggaactgtcaaaatttttgcaaccgcaaatatccaaatcaaacaccggttctttcacacgctcaaattccgccacaagtccgttgctaaagaaactgccggcagccaacacaaaatgatctgcactaatcggttcttcttggtgtgatgtagtaaaaatacgtactaccttatccccttcaaattccgctttaaccgctcggtcaccgttcatcatcataccgcctaattgctcaaagcgtgaacgtagctgacgatgttggcgaatacctaataaagacggtggtaacgtcggtaattcgaataatgctaaaccggttgcttgttgtaagctattgaagaaatcttgattatccaagccgaaacaagccggcaaaaatactgctttcgcactccctgccgcttgtttaatttcttgcaccagatcttggaaagacaatttatgctctagtaattgtgcaatatttacgctgcgaaactcacgcgagttttgacgtaaatagtccaactcgggaatattcaaataaccgactgtaaactcataatcagcaaactggctatgttgttttaaattgtccgctaataattgcggttgaaaatcgtgatagccttcaattcctaaaatggcgacctgtttctccgctaaggcggctaaatgttttactgtcggtacgctattcggcgataaccacgttgcacgaagaccacctagcggggtaatgcgttcatgattttgcaccgttgagccttctaaatgtagatttaaactttgcgctaattgttcgaactgctgcgcttttaccaatacttgatctttgccaagaatgctgtacggatgttccggcacttgaagttttaactcatcaagcgattggtaaacattttcgactttttgaccgcttggtaaacgagaaagtaaatccattgaaccggaagaaaaatcaattgccgcctgtccgttgttgataatcgcacagcgtttaccttgttcttgaagcgcaatcccacaggttaaaccggcgagcccgccgccaataatcactacatcaaaattcattgctattcactccctgctcttcgtccatcggtacatcattcagtccgagtaggctatagtaaatccagctggtaaattccgcttcccgcattgcatccccccatgcaatcggttgaattccacgccagcgctcttccataaatgaggctaattgtgtggttgattcttttggtgtcgccactttaaaacgactcatcagtcctgcagcacgacaagcacaaagttccgcttggcaagttcccataccgacacgagtacgacggcgtaaatccaccaaattattcacgttgagttcatcaaccgcatagcgaacttcaccggcagttactgcttcacattcacacactaaagttttatctaaacgctcggtttcaagtaaacgcaatgctctggaaccatgacgataaactgcagaatgacgaatcgtattcggcaatgaaataatttttttactggtttcttcacggctttcatttgaacccggaagcggacgttccgccgtgctacacaagcggtcggatttattcaattttttgcaaactaaatcggtcgtccattccgccatcaagcgataagtcatcaatttaccgccggtaatcgtaataaaaccgtctaaaccgtcacgttctgcgtgatccagcaagacgataccacggctaacattacgaccggacggatcatcatccgtcgcaaccagaggccgcacccctgcataagcacgtaacactcgggtatgacgtaaacttggtgcaagtttctctccttcacggaataacacatccacttcttccggagtaaccaccatattgtcaatttgatcataaggaatacggtcggaagtcgtcccgataacacaaatggtatcgcccggtactaaaatatcggcattcgccggtttacgacaacggttgatcaccatattattgatacggtgtcccatcactaataacgaaccttttgccgggaacattttgattttgagatcggcgtattcggcaataccctgcccccagatcccgcctgcattcaccacaatcggcgcaaaaaattggcgtttgacttggtttcgatgatcaaacacattaacaccgataacagtgccaccttcgcgaatcaaaccggttacttcacagtaagtaaacacttttgcaccattctccgtcgcatccaacatattggaagcggttaaacggaacgggtcaatcgaaccatccggcacaaccactgcaccgactagcgaagggttaacggacggctccatatattttgcaaggtccggctcaatttcgaccgcttctatacccgaatcggtacaggcttggataaagtttttctgataattaagatcatcttccggtagggtaatgaaaagcccttttgtgtcatctacacaatggcgcgcgatctgtttgaggatgagattttccttaatacattcttcagccgattctctatcatttaccgcatagcgagccccgctatgtagcaagccgtgattacgaccggttgcgccggttgcaatgtctctacgctctaacaatacgcattttaaacctcggagcgcacagtctcttgcaatccccgcaccggttgcgccgccgccgatgataatgacatctgtactgattggcgaaaaatctgcaacattttgatacatttgaggtgaaatgttcatactcaacctctcccacattttaaatgaaatgaaacgaaacaataaaaacagatttattgtataaaaatgagcgttttggaacaagcagatgagcataaaagaaatcaaaaatgtgataatgctcacaaagaatttaaatttgttaaattctttgtggaatagatcacaaatttgtacaaatgtgcttttctattcattttgttcggttatcctgtgcgcggtttgttgataaacaaacatttaagctaatcaaggagaaaataatgaaattgaaaacattagctatgagcttacttgcagcagcagttttaactggatgtaccacacagcaagccgctgataaatcagctcagtcagacaaattaatcattgcacatcgtggagcgagtggttacctacctgaacatacgcttgagtctaaagcgctcgcttttgctcaacaagcggattatttagaacaagatcttgcgatgacgaaagataatcgcttaattgttattcatgaccatttcttagacggtttaactgatgtagcgaagaaattcccgaaacgtgcgcgtaaagacggtcgtttctatgtcgctgatttcaccttaaaagaaatccaaacacttgaaatgacagaaaacttcaaaacagaaaacggtcaacaagtacaagtttatccaaaccgtttcccaatgtggaaatctcatttccgaattcacaccttcgaagatgaaatcgaatttatccaaggcttagaaaaatcaaccggtaaacaaatcggtatttacccagaaatcaaagcaccttggctacatcaccaagaaggcaaagatattgcattagaaaccttaaaagtactgaaaaaatacggctatgaccaaaaatcggacaaagtttatttacaaactttcgattttaacgagttaaaacgtattaaaactgaattgttaccaaaacttggtatggacgtaaaacttgttcaattaatcgcttataccgattggcatgaaaccgaagaaaaagatgcttcgggcaaatgggtgaactataactacgactggatgtttaaagacggtgctatgactgaagtagctaaatatgccgatggtgtaggtccgggttggtatatgttggtggatgataaaaactcaaaattaggtgatgtcaaatacacgccaatggtaaaagatattgcgaaaaccaacatggaattacacccgtacactgtacgtaaagatgcgcttccggaattctttactgatgtaaatcaaatgtatgatgcgctattaaacaaagcgggagcaaccggggtattcaccgatttccctgataccggcgtacagtttattaaaggaactaaataagcgttttttgagcgaaaatgaatactaaatttgtgaattgcttacatttttaacaaatatgttgaaaatctctcataaaaatgtgagtgcattcacaaatttagataaataatatggagtattactcttttttcgctaaaatatgcgtgattgttcgtaatcgaacgttttatcaatatatatcatttggagtgtttctatgtttggtccttttaaaccggctccgcacattgcggaattaccggcagataaaatagatgcaagatataaattcttacgttggcaagtattcgcaggtatcttctttggatacgccgcatattattttgtgcgtgcaaacttcgaccttgcgcaaaaaggtttaattgaagcaggtttatataacaaagctgaattaggtattatcggtaccggcgcaggtttagcttatggtctttctaagttcgtgatggcaggcatgtctgaccgttcaaacccgaaagtatttttaccgttcggtttattactttccggtctctgtatgacgatgatgggcttaatgccgtgggcaacttcaggtattgctgtcatgttcatcatgattttcttaaatggttggttccaaggtatgggttggcctccatgtggtagaacgatggtacattggtggtctaaatctgagcgtggtactatcgtttctatttggaactgtgcgcataacgtgggtggtatggtaccgggtgcaatggtgttgttagcaagtgcgatttactttagtaatactggtgaacacgcaactgcgaaagacgtatggcaacaagcgctttactatccgggtattgctgcaatgattgctgcgattccagtttattttgtaatgaaagacacgccacaatcttgcggtttacctccggtagaaaaatggcgtaatgattatcctgatgactataatgaggaaacagcggaaaaagatttaagtaccaaagaaatctttgtgacttatgtacttaaaaacaaattattatggtatatcgcaatcgctaacgtattcgtttatttaattcgttatggtgtattaaaatggtctccggtttatcttggcgaagtaaaacacttcaatattaaaggtactgcttgggcttataccatttatgaattagccgctattccgggtacattattatgcggttgggtatcggataaattattcaaaggtaaacgtggtttaaccggctttatctttatgatcttaaccacgattgccgttgtagcattatggaaaaacccagcaacaccagaggctgaattagcgcaatatgcaggtaaagcgtggtatgaaaacccatatcaattgatggacttcattttaatgactactatcggtttcttaatttatggtccggtaatgttaattggtttacatgcgcttgagttagcaccgaaaaaagccgcgggtacatcagcaggtttcaccggtctattcggttacttaggtggtacggtttctgcatcagcagttgttggttgggcagcagaatattatggctgggacggcggtttctacgtgatgattgctggcggtgtgttagctgtgttattaatgcttatcgtaatgcttgaagaaggtaaacataaagcaaaattaggcgaccactacggtaaataattaactcgcttacaaaaggaagaacaattgttcttcctttttttcatcctaaaaccactatttgtcatcaatttgccatataactaaggttaactagctactaacttccttaaccaacaacattaaataactggagaatcatatgaaattatcaaaaattgcacttacgttaggctgtttatttatgacttctatcagtgttgcaaatcaaagctgcctctctccatacgcagaagcattacctaaatatgaatatactttaaacaaagtaatggaggtcaatggtcgccaaggtgtcaccactgacggtaaatatctctatgtatctggttcagcgtcgctcgccaaatatgatttaaacgagaagctcataactgaaaacaaaaaaccgtttatcggttatcaaaaagaagccaatcatatcggtgatatcgatatttataacaatgaattatatatttcctccgaatggtttatggacggtgttggtaaaaatatccaaattgccattcatgattcggatagcttagcatttaagagatctgtagatttttatccggagtcggggcaattagaagtctcggcaattacggtcgataccgtcaatcatagtgtttggatggcatcttgggttggagaagaaagtggtcgctatttatatgaatatgatcttgatagtggcaaatataaacgcaaagtccatttacagccggttccgcaatggattcaaggtatcttcgcccatgagggaaacttatatctgactgcagatgatggaactgccgatgagaaagaacacgatcacttatatcgtgtagaactttctgctaaaaataacgaagctcgagttgtgctagagcgtacccttgatgatgtgaaagattatggtgaaattgaaggactcgtaatcaatccaaaaagtaagcaactgattgtacatgctaatcgcggcaaacaaatcgtattaggaatgccgaaaggtttttacccgggatatgatcgtgaaattagtgaactgtatttttatcaaatgacgcctagatgccaataatcatttctgtttttcccatttcttataaggaaataatccgagattatttcctttcttttttaactttaatcaaattttttcttgtttttccaaatttcacccccataatggaaaaattaatattttgatagaacatttaagaagagagcaaattcatggcaccaagaaaaaagaaagcaattgagttaccgctacttccgttacgtgacgtagtggtttttccttatatggttatgccgttatttgtagggcgagaaaaatcgattcaagccttacgtgcagcaatggatagtaataaacaattattccttgtaactcaacaagatcctaataaagaagaaccaacaactgccgatgtatatgatgttggtgtaattgccaatattatccaaatgctaaaccttccggacggtacggtaaaagtactcgttgaaggtcagcaacgtgccaaaattgaacatattcacgatgatgaaaacggcttttgggctggtgtacaagttatctcatcggaatttgatgaagaagatagtgaattacaagcaatcgcaaaagcaacacttaatgaatttgaaaattacgtaaaaaataataaaaagattccggctgaaattctacctaaattacaaaaaatcacttcggaagaccgcttagccgatacgatttcttcaaacctcattgcgccggttaagaaaaaacaagcgctacttgaagaagcaaatcttatcgctcgttttgaagcgttattagttgcgatggcgacggaaatggattctctggaaacagaaagccgaattcgtaatcgtgttaagcaacaaatggaaaaaaaccaacgtgattactatttgaatgagcaaattaaagcaattcaaaaagaattaggtaatggtgaagatgccgaacagagcgaattagataaacttaaagagaaaattgatgcagctaaattaccggtagaagtaaaagaaaaattagacggagaatttaaaaaattaaaagcgatgccgcaaagttcttctgaagcaaccgtagtacgcagttatattgactggattttgcaaatgccatggcataaaaaatctgcggtcaaaaaagacttagcgaaagctcaagccgtattggataaagatcattacgggctcgaaaaagttaaagaacgcattgtggaatatcttgcggtacaaagtcgcttaaataaactcaaaggtccaatcctttgtttagttggtcctccgggcgtaggtaaaacctcgcttggtcaatctatcgctaatgcgaccggacgtaaatatgtccgtatggcactaggtggcgtgcgtgacgaagcggaaatccgtggtcatcgccgtacttatatcggttctatgccgggttcattaatgatgaaaatggcaaaagtcggcgtgaagaacccgctattcttgctcgatgaaatcgacaaaatggcgcaggatatgcgtggtgacccagcgtctgcattacttgaagtgttagatccggaacaaaataaagcgtttaacgatcattacttagaagttgattatgatctttctgatgtcatgtttgtcgcaacatcaaactcgatgaatattccaccggcactactcgaccgtatggaagttattcgtctttccggttataccgaagatgaaaaaatgcacatcgcacgtgaacatttaattgctaagcagcaagaaaataacggcttaaaagcaggtgaattaagcattgaagacagtgcgattttaagcattattcgttactacactcgtgaagccggtgtgcgtggtcttgagcgtgaaattgcgaaaatctgtcgtaaagcggttaaaactttagtgctagacaagaaagttaaatcactgactgtaacagaagagaatattgcggattacttaggtgtaaaacgttttgattacggcaaaatggataaccaaaaccgtgtaggtgaagtaaccggtttagcatggacagaagttggcggcgacttactaacgatcgaaacagcatcagtagcaggtaaaggtaaattctcatttacaggttcattaggcgatgtaatgaaagaatctatccaagcggcaatgatggtggtgcgtgcaagagctgctcaattaggtatcgcagatgacttccacgaaaaacgtgatattcacgtacacgtgccggacggtgcaacaccaaaagacggtccaagtgcgggtatcgcaatgtgtactgcattaatttcgagcttaaccggtaaccctgttcgtaaagaggtagcgatgaccggtgaaattagcttacgaggtaaagtattaccaatcggcggcttaaaagagaaattactggcggcacaccgtggcggcattaccaccgtgattattccaaaagacaatgaaaaagatttggaagaaattccggaaaatgcaaaagcggcattaacaatccatgcggtcgaaacaattgatgaagtattatcaattgcattggaaaatccgccaatggggattgagatcattccggcaaaatctcaaacgattaaagtgaaaaaatctcgctcaaaagcggcaattcaataaatttatcgtttaaagtaaaaaacctcgaatatttattattcgaggtttcttttttatagattaatcacagcttgttctgctaattcccgtgccagcttatcaatatgtaacacatcagctatttctgttacttgaatcggtgcaatattttccactaccgttctattcacattcacaatatcaataaaacgaatacgttcatttaagaaagcttctaccgccacttcatttgccgcattcattgcggttgtcgcatattgcccttctgcaaatgcatcaatcgctaatttcaaatttggatagcgggcaaagtccggttcgataaaagttaattctttcaatttaaagaaatctaacggtgccacacctgcattaatccgcttcggatatgccatagtatgcgcaatcggtgtacacatatccggattccccatttgagcgataaccgagccgtcaatataacgtaccatcgagtgaataatagattgcggatgaataataatttccatctcctctgccgaagcattgaatagccaacgagcctcaatatattccaaacctttattcatcatagtggcactgtcgactgagattttcttacccattgaccaattcggatgtgccaccgcttgtgccggagtaatacttgcaaactcatcgagtggttttacacgaaacggaccgcctgaaccggttaaaataattttactcacgcctaactctgcaagcgggcaaaaaccgactttttgttgcgcttccggtggtagagattggaaaatcgcattgtgttcactatcaaccggtaataactgcgcgccagattttctcgcttcatcaataaaaatttgtccgcaagtaactaacgattctttattggccaataaaacttttttaccggccttaaccgctgaaagggttggtaacaaacctgccgccccaacaattgccgccatcaccatatccacttcggggtgagcgcttagttcacaaatcgctttttggccgcttagcacttcggtttttacattgaattgtttgagctgttccgctaacgcttttgctgcattctcatcatctagagcggcaaatttcggttgaaacaataaacattgcgctgccattaattcaacatttttaccaccaactaaaccgaatacctcgtattccgttttgttctgttccaccacagataaagtgcttttaccgattgagccggttgaacctaaaatcactaatttcttcatagacattcctaatcactaaaaacaagcggtctattttgcaattttttttgcaaatttgaccgcttgtcacttaatttgataaacgtttcgcttcaataacatcttcaagttgtgcgatacgcgctaataatttacctagcatttcaacattgctcagttcaattcccatatccataatggctagactacgtttcgcatcaatacggcttgagacactcaacacgttaactttctcatttgccattaccgcactcacgtcacgtaataaaccgttgcggtcatttgcggtgactcggatcgctaaactaaagccgctcgcataattcgtgccccattgtgcgccgactacccgttccggatttgcactacgcaattcaaacaattgttcacaatccgcacggtgaatcgaaatgcctcgcccttgagtgatataaccgacaatcttatcgcccggaatcggctgacaacaacgggcaatggtgtgcattaaattaccgacaccatcaataataatctgtccgtttttgcctttgtgctgattcgcattattggcatgtttattcacttgtttcagtactgcttcgtcttcttgctctgcagtcggtttgattaacttactttgtaaataatggcttaactgattcagacgaatatcaccaccgccgatccctgcatacaaatcatcaaattgtttcagattatagcgaggcaacgcatattgctcgatttgcttataagtaaagccgaaacgcgccatttccgcttccaatgcttctttgccgatcggaatatttttctctcgatccaatttcttaaaccaagcgataatttttgcacgcgctttggaagtatttacgaagcctgaattcgggtttaaccaatctcggcttggattcggatttttctgagtaataatctctacctgatcccccatttgcaataaataggtgaacggcacgattcgtccggcaactttagcgccgatacaacgatgtcctacttcactatgaatcgcatacgcaaaatcaagcggtgtggcatttttaggtaaatcaattacttcaccgcgcggggtaaacacgtaaacacgatcgtcaaacacttgagatcgcatttctgcaaccacatcgcccgaatccgcaatatcattttgccacgccaataatttacgtaaccaaacgattttctcttcataaccggaacggccagcagttgcaccttctttatatttccaatgcgccgcaacgcctagttccgcatcgtcatgcattttacgtgtacgaatctgcacctcgatagttttatcgccctcacccaacacgacggtatgaatcgattggtaaccattcggtttcgggtgtgcgatataatcatcaaagtgttcaggtaaatgtctatattgcgtatgaataatccccaaagcggtatagcaatcttgcagattcggtacaatgacacgcaccgctcttacgtcaaacaactgctcgaaacgcagatttttcttctgcattttcttccaaatactgtaaatgtgcttcggacgaccgtaaacttcaatatcactgatttgttctgctaaagaagcggtcaaattcgctacaaaatttgcaatatagctttcacgttctagacggcgctcgcccaattgtaaggcgatcactcggtaacattgcggatgcaaagctcggaaacaataatcttccagttcccatttaagttgtccgatacctaagcgattggcgagcggcgcataaacgtgcgaacattctttggcggctaaaaccaaatcttcttccgtatgcaaatgtttatcgcgcaaataggtaatacgttcggcgagtttgataactacgcaacggaaatcatccaccatggcaagtaacatacggcggatattatcgatttgtaaatcggaagcactgttcgcacttaattgacgaatattatccatttcgatcacgcctttaaccaaagtttttacttgattactgaagcgttcttttacctgaacgagatcgataatattgtgtttaacgagaggaaataataaggctgcgacaagagaatcatcatccatattcaagccatgcaggatttcgaccatctcaacaccgtcccacattaaatgatatgtttcggtatctaatttctcttgtgcataacaccaagcaatttgtaactcttcgaaggttatgggcgacatttgtaaagcagcactccaactcgctaactcaaaagtactagggttaagctcgtgtgaacggcgaatcgctaccataaatcctccttttgtaaaatcttacgaatatttaaccgcttggcggctagaaattgcttagcattatacttggatttgcggattattgttagtggttatcgatagcttgttgttatctatccgctacaaattgttcactttttcacttaattcaccatatcataaaaaagtatttggctaatttctcaaaatcaaccccacctcttttgaggtatataaattgtgataaatcaaaccaatctctacaattaattgcagcgtatttgccgattggttagaatgcagtatgttttaagcggcattttgccgtttttcttttgtgtgggattcaatgacaattttagctttaggtattaaccataaaacagcatcggtgagtttgcgaggaaaagtggcgtttgatgaagtcaaacgtcagttggcgttcgaacaaattcagcagcgtggtttagctgaaagcgttgtcatcttatcaacttgcaaccgcaccgaactctatttccatcattcggaaatcacgccacaagtagaacacgaagataatcttgcgtggcaagagcaatgttttgaatggtttgccgaaattcatcaactcgatcacgccgaattacgtgagtgtatctatttcaaacaaaactttgaagctgctcgtcacttaatgcaggtagcttgcggattagactcgctcattttaggtgagccacagatccttggccaagtaaagcaagcttaccaatactgtgaaaacttctatcagtcacaaggttctcaagtttcgaccaaactttctcgcttatttcagcgtactttttcaacggctaaacgtgttcgttctgaaacggaaatcggttcaagtgcagtttctgtcgcttatgccgcttgcggtttagcgcgccaaatttttgataatttcggtaaattgcgcttcctattagtcggtgcgggtgaaacgattgaattagtggcacgatatttaattcaacacggtgcaaaaaatattatgattgcaaaccgtactcacgtacgcgcggaaatgttagcggaacgtttggaaacgcagatgcagattctatcgctgagtgcgttacaaatcggtttaaatcaggcagacgtggtaattagctcaactggaagtcctgatatgttaattagcaaagaaatggttgagattgcccaaaagcaacgccaatttgatccaatgctgttaattgatattgccgtgcctcgtgatattgatgagaaagctggcgagctggatgcagtctattcctatagtgtcgacgatttgcaaaacattattcaacgcaatctagcccaacgccaacaagcagctgaacaagcagctgaaattgtggagcaggaatgtaaagcgttcttcgaatggttaaaacaacagcaatctagcgatttaattaaacgctatcgccaagatgccgaacaaactcgtcaagaattactcaataaagcgatgcaagcaattgccgcaggacaagatacggaaaaagtcttaaatgaattaagttataaactgactaacaacttattacatgtgccaacccaagccttacaagcaatggcgaaaagcggtaactctaagggcttacagtgtttttctaaagccttgaaattagaagaacagtaacaactcagaaattcaagcaaacaagcggttgattttcagtaaaattttgcaatcccttaaacgaaaaatggttagcattaggctaaccatttttttattcaaaattaagatctcaatatactgcaactatccttaataggatttcacgatttctgtaaattttctgagtgaatcaagccatttttcttcatcaaaaatatatcctgtcagcataatttcatcgactaattcagcatattcatccataaaatcagcatattgcttagtcaccgtatctttgctaccaataaaaataccgccactttgtaaatcaatagaatggcgttcgccggcagaatagtatagagaatccatattctcaaccggttgtttaacaaagacattttcaccacgttgctcattcaaaaaaagctgttttagcgtactgtttgtgtaatgcgcttcagcatccgtttctgcgacattaacattcaaacaaagtaccatataaggcttagcacaatgttcggaaggtttaaaattttgacgataaatctctgctgcttgtttttgttgcattggtaaaaaatgggatgcgaaagcatacggcaatcctttttctgcggcaaaatacgcacttgtaggactagaacctaaaacaaaaatcggtacattcgtctctacgcccgggtaagcattaataccgtttggttgctctttgccgaaataagtttgtaaatccgcaacatcttgttcatgatttgtttgagatgcagcctgacgacgtaaagcagcagcggtaaaaggatctgtccccttagctcgtcctatcccaatttcaactcggtttggaaatagtgttgccaatgttccatattgttccgccacaataagtgggctatgattaggcaacattacgccaccagcgcccactttaattcgctgagtatgatgtaataatgttgaaactaaaatctgggtagctgagctagcataagctcgaatattatgatgttcggcaatccaaaagcgttcaaatcccagttcttcggcaagttttgcctcccgaatcaccgaatcaattgcttgtttgcgtgtaaatccttcacgcacaggtacaaggcttaaagctgataatttcattttgctctccgaatctaaatattggcattatacaaataccttcataaaagggaaattgtgtattttccatttcaatcaacaagatttacagaaaatcgaccgcttgttttcgatcctttttccgttctcaatgcttttagtatataatatggcgattttgcgactcgcaaagacagaatttttagaaggacagaataataatgactccagttgttgcccttgtcggcagaccgaatgtgggtaaatccactttatttaaccgcttaacccgcacacgtgatgcgctagtagcggactttccagggctaactcgtgaccgtaaatacggccatgcaaatatcgccggttatgattttatcgtagttgataccggtggtattgacggtacggaagaaggtgttgaagaaaaaatggcggaacaatcgctactcgcgattgaagaagcggatgttgtacttttcttagtcgatgcgcgtgccggcttactgcctgccgatattggtattgctcaatatttacgtcagcgtgaaaaaacgaccgtggtagtagcaaataaaacggacggtatcgatgcagattcgcattgtgcggaattctaccaattaggtttaggtgaagttgaacaaatcgcagcggcacaaggtcgtggcgtaacacaacttatcgagcaagtcttagcaccactcggcgaacaattaaatgcggatcaagcggtcgaaaacgaggaagattctgtaaatgaagaagcggacgaatgggatactgacttcgacttcgataatgaagatgataccgcattacttgacgaagcattagcagacgaaagtgaatcgattgaagataaaaatatcaagattgctatcgtcggtcgcccgaatgtggggaaatcgactttaaccaaccgcattctcggtgaagaacgcgtggtggtttacgatatgccgggtacgacacgtgactcgatctatattccgatggaacgtgatggtcagcaatatacgattattgacacggcaggtgtacgtaaacgtggtaaggtcaatttagcggtagaaaaattctctgtgattaaaaccctacaagcgattcaagatgcaaacgtagtattacttaccattgatgcgcgtgaagggatttctgatcaagatttatcattacttggctttattctgaatgccggtcgttcacttgtgatcgtagttaataaatgggacggcttatcacaagatattaaagatcaagtgaaatccgaattagatcgccgtttagactttatcgatttcgctcgtgtgcattttatttctgcattacacggctcaggcgtaggtaacttatttggctctgtaaaagaagcctatgcttgtgcgacacagaaaacatcaacttcaatgctgacacgtattttacgtatggcagcggatgagcatcagccaccgttagtaaacggccgccgtgtgaaattaaaatacgctcacccgggtggttataatccgccgattatcgtgattcacggtaaccaagtcgaaaaattagcggattcttataaacgttatttaagtaattacttccgtaagagcttgaaaattatcggttcgccgatccgtattcagttccaagaaggtaataacccgtttgccggtaagaaaaataaacttacgccaaaccaattacgtaaacgtaaacgcttgatgaagtttattaaaaaaagtaagaaataattagacaaatctctcccttattagtacccgtctttggcgggtattatgattgaacaaggtttaaggcactcgtcacaaacgtgtgctatcatttaattgagaaattaactatgatgatgcaatactctccgaaatttaataatgctaaagtgcttgtacttggcgatgtaatgttagaccgttactggtttggtgcgacaaaccgtatttcaccggaagcaccggtgccggtggtaaaagtacaagatatcgaagaacgtgccggtggcgcggcaaatgtggcaatgaacattgccagccttggtgtaccggtcgcccttcatggtttaatcgggcaagatgatgccggccgtgctttagataaattactcaattcacataatatccaaaaccactgtgttgcattggattcacacccaaccatcaccaaattgcgtattctgtcacgtcatcaacaactattacgtttagatttcgaagaaggctttcatcatgttgcaagcgattctctacttgcaaaacttgagcaagaaattaccgcttatggcgcattaatcttatcggattacggcaaaggtacgcttgaatcagtacaacaaatgattcaagtagcacgtaaagccggcgtaccgacactcattgacccgaaaggtaccgattttgaacgttatcgaggtgcaacgctcttaacaccgaatatgtctgaatttgaagcggtagtcggtcactgtaaagatgacgatgaaattgtagagaaaggcttaaaacttattgctgattttgaattaaccgcattattagtgacacgttcggaaaaaggtatgacgttactacgtccgaatcaagctccgttccacttaccgacccaagcaaaagaagtttatgacgtaaccggtgccggtgacacggtaatcagtgtacttgccactgcgattgccgacggtcgtccttacgaagaagcatgttatttagcaaatgcagcggcaggtgtggttgtaggtaaattaggtacttcaaccgtgacaccaaccgagttagaaaatgcgattcatcatcgtgaagaaaccggcttcgggattttagcggaagacgaattaaaacgtgcggtagaacaggcaaaacaacgaggtgagaaaattgtgatgaccaacggttgttttgatatcttgcatccgggacacgtttcttacttagaaaatgcacgtaaattaggcgatcgtttaattgtggcggtaaataccgatgagtcggtgaaacgcttaaaaggtgaatctcgcccgattaacgatttaaacgctcgtatggcggtacttgccggtttagcttctgttgattgggtcgtaccttttgcggaagatacacctcagcgtctgattggtgaaatcttacctgacttattagttaaaggtggcgattataagcctgaagaaattgccggcagccaagaagtttgggcaaacggcggtgaggttaaagtgctaaactttgaaaacggttgttcaaccacaaacgtgatcaagaaaattcaagcatcaaaataaaatttctactctataatggaaaaaattattattgatgccgagcagtttcagcgtacgatttcgcgtatttctcaccaaattatcgaaaaacattcttcattagataatttggttttagtcggaatcaaacgtcgtggcgttgaaattgccgaaatgttacaaaaaaggatatcggaactctcacaaacagaattgcccttaatggctttagatatcaccttttatcgtgatgacttaaattttattcatcaagacccgatttataccggtgcggaagatcaagttgatattgaaggcaaaaatgtaattctaattgatgatgtactctttactggacgaacaattagggcagcattagatgctttattagatttcgggcgggcgactcgtattgaactggttattctggtcgatagaggtcatcgtgagctaccaattcgagccgactatgtcgggaaaaatatcccaactgctcgtaatgaacaggttcaagtaaggactcaacattatgacggtgcaaatcaagtcgctttaattcgagcaaataatgaataaaacgatgttccgtatgaaccttttttctgaattttgctctaactggctttagggcttatctttaatctttaagggaattaacaaatgaaattaatctctgcaaaatcattattactgacattggttgcagcagtcggtatttcacaatcggcaatggcatgggaagaacgtgtcgtagcaacagtggacggtgtaccggtgatggaaagcgatgtacaacgcttacttggcaaaaatgctacggcagcccaacataaatcggctgtagagcaagctattgatgacgtattaattcaaaaagctgtcaaagaagctggtgtaaaagtcaattatgctcgtgtagatcaagcaattgaacaaattgcagctcgtaacggcattacttacggtcaattactggatgcattagattatcaaggcattacattaaatcaataccgtcaacaaattgctcaacaaatggcaatggaacaagtacgtaatattagcatcggaaaatcaattcaagtgcaaccacaagacgttcaagcgcgtgcgcaagaattattagcacaagataaagcaagcggtaaattaaaaaccgttaccggcaatcaataccgtattagccacattttgttaaaaacgacccccgttctgaacgatgcgcaagcgaaagcaaaattaacgcagattaccgcagacattaatgctggtaaaacaactttcgaacaagcggcgaaattaaactctgttgattatgtttctgcagcggatggcggcgatttaggatataatttcttagatatttacgatcctgcatttgctaaagcggcaagcatggcaaaacaagatcaaattactgcgccgttcaaatctcagtttggttggcatattcttaaagtaaccggtagccaacaaggcgaccgcactgaagatgcatatcaccagcgcgcttatgaacaattagttgataagcaagcgcaagaagcctctaaagactgggtgaaagcgttaagaaaaacagctaacgttcaatacgttaaataatttttgagaacctcgcgactgcgaggttctttccttatttctaaagagtaaaaatgagttctccaaattctaaaaaacacttaggccataccgctcgtaagcgcttcggtcaaaacttcctacacgatatgaatgttatccataatatcgtgtctgccatcaatcctaaaaacggtcaatttttacttgagatcggcccgggtttaggtgcgttaaccgaacctgttgctgagcaagtggataaattaacggttgttgagctagacagagatcttgccgagcgtttacgtcaccatccgttcttaaatcacaaattaacgattatcgaacaagatgcgttacgttttaatttccgtgaatattttgaaagccttgaattaaaagaaggtgaaggtgttcgagtattcggtaacttaccgtataacatttcaacaccgttaatgttccacttattcaaattccatgatttgattcaagatatgcactttatgttgcaaaaagaagtggtaaaacgtttatgtgcagcaccaaatagtaaagcgtatggccgtttaaccattatggcgcaatattattgtcaagtaatgcctgtattagaagtgccgccgactgcatttaaaccggcaccaaaagtagattctgctgtggtgcgtttaatgccgcataaagtattaccgcatccggtgaaagatgtgtattggttaaaccgtgtcactacacaagcattcaaccaacgccgtaaaacgttgcgtaatgctctctcaaccttatttagccctgagcaattagaagcattgaatattgacttaaatgcacgagcggaaaatttaagtattgcggactatgctcgcttagctaactggctatatgacaatcctccggcagtggataatcaagaagaaatcattgacgaagatatttagccttaagtaagcggttaaatttgtaaaaaattttgtaaatcaaaccgcttgttacaagataaataattttgtagatataaaaaaacctaagatttctcttaggttttttatcttttacttgaaattattttgtaccgaaaatcttatcaccggcatcaccaagtcccggaacaatataaccatgctcatttaggtggctgtcaattgaagcggtaaataattctacatctgggtgtgcagcttctaacgctttaatcccttccggagcagcaacaagcacaagcactttaatttgtttacaacctgcttttttcaataaatcaatggttgcaatcattgaaccaccagtcgctaacattggatccacaataatcgctaaacgctcttctacatcattcgctaacttagtgaaatacggtaccggctctaacgtttcttcattacggtaaataccaacaacgctaatacgcgcacttggaatatgttctaaaacgccatccatcatacctaggcctgcacgtaaaatcggtactactgttacttttttaccttttatacgttcaacttcgaccttaccacaccaaccgtcaatttctactaattctgtttcaagatcagttgtcgcttcgtatgttaataaactacccacttctgtcgctaatgcacggaaatctttagtattaatatccgctgctcgcattaagcctaatttatgttttactaatggatgtttaacttctacaattttcatttgtggctcctaagcatttaaatgctaactttatgctataagcagagttttatcctctgcttctcctaaatctatttatacgctttgtgcttttgctaattcttcatctcgcaatacacgacgtaaaatcttaccgacattgctcttcggtaattcatcacggaactcaatttcacgaggaatcttatagccggtgaggtactggcggcaataattacgcagttcttcacgtgttaagctctcatcttttttagtaacaaagattttaatcgcttcacctgacgatttactcggtacaccaattgcaactacttcgtttactttcgggttatgcgcaacaacatcttcgatctcattcggatatacattgaaaccggaaacaataatcatatcttttttacgatcaacaatgcgtaaattcagatcttcgcccatcaccacaatatcaccagttgccatccagccatcttttaaaacatttgccgtatcttccggacgctgccaatagcctttcattacctgaggaccttttacccaaagttctcctcgttcacccattgttacatcatgtccttcatcatcgacaatacgaatatcggtatttggcactggaatcccaatcgagccggtatgctcggtcgaatcagagcgagttgccgcaatcaatggtgaacattcagtcatgccatagccttcaatgatatggctacccgttaattcgtgccaacgttttgcaactgcagattgaattgctgcgccgccacctacactcagttttaaatttgagaaatcaacttctttgaagttttcattgtttaataaggcattaaatagtgtattaacacccgttaatgctacaaaacggtattttttcagctctttaacgaaccccggaatatctctaggatttgtaataagtaatcccgttactcccagctcaataaagagcaaacaattcacagaaagtgcaaaaacatgatagagaggcaaaggaatcactgcaatacgctcacgagcattcttaagcaatggctctgcaacccattttgcctgcaggacgtttgcaatcacactaccatgcgtcaacattgcgccttttgcaacacctgttgtgccaccggtatattgaagaaacgcaagatcatctttataaaccatcggttttacatattgacgctgtttaccgatacttaatgcttcgcggaaacttactgcgtgcggtaacttatatttaggtactaactttttcacgtattttacgacaaagtttaccaatgtacgtttaccaaaagaaagctgatctcccatacgagttaaaattacgtgcttaacactcgtatcaaaaaccactttttctaatgttgctgcaaaatttgatacaataacgattgctttcgcaccactatcattaagttgatgttcaagttctctcggggtatatagcggattaacattcaccacaactaaacccgcacgtaaagcaccgaataatgcgattggatattgcaataaattaggcatcattaatgcaattcgttcgcctttttctaaacgtaattcattttgcagataagctgcaaaagcgcggctacgctcttctaacttacgaaatgttaatactttacccatattaatataggccggcatatcaggatgcttacgcacagcagattcaagcatttcaagtaatgattcatattgattaacatcaatagtttgagctgaaccttctgggtaattttttaaccaaattttctccatattgtctccattaaatccgtcctagaaatacgggggtaaactcgctttcccgtatttgactcatcattttttttattccgataaaagtcccaccggtgcaaatacacatagcaagaacaaccaataattcatttgcaaaaagttgagaaaatccgaccgctgataaaattaataccaataacggcatgacatagatccaaaaaacactacgcagcaaagtttgctctgcgagaccgattcgaatttgttcgccgactgcaagctgttcacttacctttaattcaaatttcggtgcaaatttttccccagctaaagcagataaagattttgttccgcaactttcttttgccgcacacccaccacacgcacttttagcgctacattgtacggttgctaagccattccgataactaatcaccgttgcaatttcaaccatcattattttgttctcctgtatcatgtacccgctaactgccttaattcgcagaataaaaacataatatttcgtttaattctcatcggctagaggacggaggtctgaataggtaataaaaaagcggtaagattgtagcaaatttttgcaaaaaattcgctaaatcttaccgcttaattaggctaataatttaacctgtttaataatgaaacgaaaatgacaggctttcaagcttagttagtcttttgcatttcaccattttcagctggttccattgaagatgtttgagctcttgctttttgttcttctgataatgttactgcgccagcatttggacgacgttgtaattcgttagtttgtaataacgtattaattttatcttgttgctgttctaattgagtcgccgtaggcacatctttttcaggtgcgttataacttacaggctgaaccgaatcactaaatggttgggtttgtaaaacaggctgatctgcttgtgcaatatcattatccgttcccatcatattcacacccaacactgcaactaaacacacagatgcagcaataccggcttgcataagtggcgtcccccaacgtttaagtttgagtaacataccttttggctgggcctgctcattcgctgctaccaatgatggagattcaatctcttcattttcaagcaatgcttccatttttgcagagaaatcatcacctagaatgatttcgtcaccatgcataacactgctaattgcatggtagctagcccatttttgctttaattcaggatcgttacataattcattgatgaatgcatcatcaacattatgcccatccataaaagctgaaagggtttctctttgttgcataataaactccgattgaatcttaaatctgctgcataagaggattaatttttgcatcaattgcttctcttgccctgaagatacgtgaacgaaccgtacctaccggacattgcattacttctgcaatttcctcatagcttaacccttctaactcacgcaaggtaattgcggttttaagctcttcaggcaagctctcaattgtgtcgaaaacaacacgttttaattcttcggacaacaccatactttccggcgtatccccctcacgaagctgtacacctgcatcaaaactttcagcatcttctgccaaaatatcttctttaggcggacgtcttcctaaggctgttaagtgattcttagctgtatttactgcaatacgataaagccatgtataaaaagcgctttctccacggaaagactctaatgaacgataagctttaataaatgattcttgcacaatatctggaatatcatcgcgtgcgacataacgggttaatagacccgctactctattttgataacgcacgacgagtaaattaaatgcttttttgtcaccttgctgtgcacgctcaaccaaaatttgatcggctacctgctcactcatctatctgcgttctcctaacttagttacgcgtatattctttcatcactttcacatcgtatatcacttagtatataaaaccatgtaaaagttcctaaaagaataggctaattaaaaaatttacaaatcattttaatccgaatacataagaagccagtattgacgcaaatatatgctgcttactagactgctcaggtataagaaaattcaatttttcgctaacaaaaagatcgtgtgattaataaataaacaaaaagatcattatcctataaatgaagcggtcagattttactggattttcgtaaaaataccactctatctgaccgcttctttctattttttaatattttctgatgttttttctatttctttgcttttaaatccgcaactttatgcgcacgataaatagcattaatcgcatgaattaaagcacgagctgatgattcaacaatatcggttgctaaacctacaccgtggaaacgacgaccttcatgttcaaccacaatatccacttgcccaagcgcttctgctccctcgccttttgcggtaaggttataatgcgacattttaatatccattcctacaattttaagaatcgcattatacacagcatctactggaccgttaccaccgtttgacacttcactcacacgcttaccatcaagttcaacctgaacgaaagccgatgcaggtaagccactaatcatttgtgatgtaatcacatctaaatgcaatctatcttcatcgcctgcctgcatatcaataaaggctagcgcttccaaatcatagtcaaacacctgacctttcttatctgctaattttaagaatgcgtcataaagtttatccaaatcatagtcactttcttgatatcccatttccgtcatatgattttttacagccgcacgccccgaacgagcagtaagatttaatttttctttcttcaagccgattgtttcaggcgacataatttcataagtatttttgtttttcaccataccgtcttggtgaatacctgatgaatgtgcaaatgcatttgaaccgacaatcgctttattcggctgaatcggcatattacataattggctgaccatttggctaacacgatgaatttcttgcgtattaatgcgagtatctttgccattgaacatatcttggcgagttttgattgccattactacttcttctaatgccgtattacctgcacgttcaccgataccgttaatcgtacattcaatttgtctcgcaccgtttaacacggcagtgagagaatttgccgtcgccatacccaaatcattgtggcaatgcactgaaacaaccgctttatcaatattcggtactcggttcatcacattggcaataatatcgccatactgatatggtaagcagtaacccactgtatcaggaatatttaccgtggtcgcacccgcattaattgccgcttctacgatacgacaaatattgtcaattccagtacgccccgcatcttcacatgaaaactccacatcgtcggtataacttcttgcacgttttaccgcttttaccgccatttcaactacgtcatcaaacgaacgttttaatttagattcaacgtgaattgccgagctggcaataaatgtgtgaatacggaacgcttccgcaacttttaatgcttccgccgcaacatcaatatctttatccacagcacgagaaagcgcacaaactcggctatttttaatattctgtgcaatggtttttactgattcgaaatcgcccgcagaggaaacaggaaaccccacttccattacatcgacacctaaacgctcaagcgctaacgcaatttgtagtttttcttttacggttaaacttgcttttagtgcttgttcgccatcacgtaatgtcgtatcaaaaataataatgttgttattgctcatgggcttctccattagtgttaaaacaccgatttaattaaaatgagtaaaatacctacgataaacactcgtttttcttttttattatttcttttaaaaaattaagaaaaaataaaaaaaaacccgcatcgatgtgcgggtaaagtgtggatagtgaactattttcgtccaaccaacctttatcctcgcacagaatgcgataacagaagaagtcggagagaaagtagtttttccattgtgttgtgtgtgtgtttatgtttgcatagttattcgaaatacaagagctatattagcctcaaatagagtgaagtcaatagaatttttcactcctcgcaaacgttttcttggtaatttcaaatataaaaacagtgataaattcttcatttaataaattaattagcaattaatcccaaattaagattattcctccaaataaaagcaatgccttttgagaaataacaaagccttacactttttattcgttttgtgattttttaaacgatttttggttaaaataacgtaaaatcactattttctttgaagataaagcttaaatttgctagcctttgcagaataattgtctaaaaaatatttgaggaaataacaatgaatcaaccatttaaagccatcgtttcagatttagacggaaccttattaaatgcagaacataaaattggcaattttacgattgaaacattaagtaaacttgctgctcaaggtgttgatatctttctggcgaccggacgaaatttgccagacgtgaaacacattatcaataaagtcgatttaaaagaagcgatgctaattacttcaaatggtgcaagagctaatttcctttccggtgataccgtcctaaaccattacattcccaaagaacttgcctttcaattaatgcaaataccttttgatccaactcgtgtgtgccttaatacctatcaaggcgatgagtggtttatcaacattgatatcgaacaactgaaaaaatatcacaaagattccggttttacctatcaagttaccgatttcagccaacatcacggaaaacaaacggaaaaagtgttctttatcgggaaaacaccagaagatcttattccgatcgagacttatattcgacaacatttcggggatcagctttatattacttactccggtattttatgcttagagattatgcataaatccgtttgtaaagcgaatgcacttgaggaattagtcagattacgaggctataccttacaagattgtttagcattcggtgacggtatgaacgatatagaaatgcttgctcgtgtcggcaaaggttgcattatggagaatgccgacccaaggctaaaacaagcccttccacataacgaggtgatcggtaatcacaaacatgaagcagtcgctagctatatccgtgcaacctttggtattatttaagtttcaagtaagcggtcaaatttcggaattattttgcaaaaaacaggtcaaaaacgaccgcttatttattgatctttacccactaaaattggaaaacaaatgaaactaaaacctatcattaccgcattagtgcttgcgggtattacaaccgcaggttacttctatttttcgagtagcgatgaggcgcaacaaattcactatataaccgaaccggttactcgcaacacgatagataaaagtgtgctggcaactggctcggtgcgtgcaagcaaacgtactgaagttggtgcgcaagtttcagggaaaattattaatctctacgttacacttggtcaaacggtcaaaaaaggtgatctgattgccgatattgactctagtaaccaaagtaacagtttaagcaccgcagaagccaatcttgcttcttatcaagccaagttatcttctgcacaagtggctttagaagtagcacaatcaaattacacacgtttgagtaaattatataaacaagctagtgcatctcaatccgatcttgaaacggctaaaaatactttagccgctgctaaagcaagtgtggatgaagcaaaatcacaaatcaaatcggcacaaatttcggtagctgatgcgagaaccaatttaaattacacccaaattgtctcaccaatggatggaacaattgtatccgttccaatttcagttgggcaaaccgtgaattcggcacaaacctcaccaaccattgtgcacgttgccgacctatcaaaaatgttaatcaaattggagatttccgaaggtgatattgcgcaagttatgaaaggtcaaaatatgacattcactacgctcgccgaaccgaatcataaatatcacagcaaaattgatagtgtcgatccggcgttaaccacgctcagtgatgacagcgcctcaaataaatatactgaaaaagccggtaataccgaggcaatttattactatgcgaattctttagtagataatgccgaacaacgtttacggattggtatgactgtgcaagggcaagtggaaattgctaaacgtgaaaacgtacttgtggtgccgacatcggcgttaaagaaaaaaggtaacgaaacttttatacaagttttagaaaacaatcaaccaattgaaaagaaagtcgaattggggttagccgatagccaatatacggaaattacatccggtgtaaccgaaggcgaacaggttattacaactcaacgttccgacagcgaacaaatcagtatgcagccacgtggtcgaggccccttctaatctagaaaaaacaagcggtcgaaatttgcatattttttacaaattccgaccgctttcagttctctcaagcgctagcctattccttgctatccggctgatttttgattgcagcaaaaatcatcgccaagatcggtccagaaatattatgccaaaagctaaatacggcacttggtacagcaatcaatggattggctttaaaatgcaatgcggcgagcgctgcgcccaagcctgaattttgcatcccaacctcaatcgcaatcgctttactatcggcaataggtaatttaaatacacgtccgattaagtaaccagtcaaatagcctaacccgttatgcaccgccactactaagaaaatcaatagccccgattcaataatgcgatctttacttactgaaacaacagcggtcacaatcaatacaatcgctaatactgaaattaacggcatagtttggctaaattgctcaattttttgcttaaagatagaacggatcaccacaccgataaaaattggtaaaagcaccatttttaagaccgaaacaaacatcgcccccgcatcaatctctaaccattcgcttgcaaaaatataaaataccgctggggtaagtaatggtgctaataatgtcgaaaccgtggtacacgctacagacaatgcggtattaccttttgctaagtaagtcatcacatttgacgaagtgccgccggggcaagagccgaccaaaatcacaccgatggctaaatctggcggaagttgaaacgcttttgctaaaacaaaagcgatactcggcatcacgacaaattgggcaattacacctaaaatcgccgctttcggatttttagtgacttccgcaaaatctttaaaggtaagcgttaaacccatacctaacatcacaatccctaataaataaggaatccaagggacaaactgtttaaacgtatcaggaaattgtgctgcaataaaagcaaaaaacacgacccagacagcaaaagttttactgacaaattgtgttattttcaaaagtgcattcatgttgtgtccttaattgttattgatttagattaaaagagtaacaggctaacgtacttttttacaaaagtgaatagacaaaaatcaggtttatttgtaccctttgggcgctttggctgtcattgccaaagttgcgaaagaaacaaacacgaaaggagaacataatgaaattagttaaattaactgctattacggtagcatcaatgtttgcattaaccggctgtcatcaccatgcacaaaagcacaatgaaatgattttgcaagaacaagcggcgttagggattaactggatgcaacaatccggtgaatatcaagcattagctcaccaagctttcaatatggcaaaaattgcgtttgataatgcaaaagtaacaaaaggtaagaaaaaagcggttgttgttgaccttgacgaaaccatggtggacaacagcccttacgcaggttggcaagtaaaaaatcataaatcatttgacggcgaaagctggacacgctgggtaaatgcacgccaaactcaagcgattgccggtgctgttgaatttaataactatgtaaacagccacaaaggtacaatgttctacgtatcaaaccgtaaagacagcagcgaaaaagcagcaactatcgatgatatgaaagaattaggttttaccggtgtaaacgagcaaacattattcctcaaaaaagacaaatcaaacaaaacgcctcgtttcgaacaaattgaaaaacaaggttatgaaatcgtgctttacctaggcgataacttaaatgactttggtgatgcaacctacaaaaaatcaaatgcggaacgtcgtgactttgtcagcgcaaacaaagaaaaatttggtaaacaatttatcgtattaccaaacccgaactacggtgactgggaaggtggtctagataaaaactattacaaaggcgatgcgaaaagtcgtttagacatccgtcacaacgccattaaagcatgggatggtaaataattgataaaaagagaccgcttatcaaagcttctgataagcggtcttttattgtgacttatttaagtcattatgctctttcacgcatatgtttaatgaaaaaatagagattggtgcaggtcacaaaaaagtttaaacctgcaacaggtaaagaacctatcattaatccataaatggtgaagcaagcacaccctaccgcattcacaaaacgcaacttaatcacatcttttaataaaaaagatacgcctactaaaaacatcgcaaagtagccgaataactctacataatccataagaacctcctaaaattaattactgtgtattattttaatcagtcttattttgtttgtgtttaactttaaaaaaagcaaaggattgcgttcacatttttatgttttgattgacgataaaatcagcagccactacgttccagtaacataaaacggcattgataagggttttgctcatcaatttcagaccatgtttccgcttttaattgccaattttcttcatcgaattcaaaaaacgtatcgccttcaatctccgcctgtatttcggttaaatagagtttgtttgcaacaggaatagtttgtttaaaaagctcgccgccaccaatcaccataatttcttccacatttgcaaaagttttggctaattcgaccgcttgttcaaaattagtcgccgcataagcgccttctactgaaaagccggaacgagataaaataatattaggacgtttaggtagtaagcgaccgatagattcgtaagttttgcgccccataatcactggcttgcccactgtattttgacgaaaccatgccaaatcaaccggtaaatgccacggcatttgattgtccttaccaatcacgtgattttttgtacgtgctacaattaaactaatttccatcgtttttccgcccttatgccttttagtttgatttaagttgaaattaatagtgattttagcaaacaaaagtgctacttttcatataattctttttttgtttacacaacctaccaaaatacagcttatgagcaagactattgttatcaaatttgggacaagtaccctcacccatggcggtaaaagtttaagccgcccttatatgttagagttagttaaacaaatcgctcaactgcatcagcatcatcgtgtgattgttgtgacatctggtgctgcggcggctgggcgtgattatctcggtcatcctgaacttcccaaaacgcttgcttataaacaaatgttagcggcggttggacaaagccaactgattcgtacttgggaaaatttattcgatatttatggcattcatatcgggcaaattttattaacccgtgccgatattgacgatcgtgaacgtttcctaaatgctcgagatacgctaaatgcgctgttagaacaaaaaatcattccggttatcaatgaaaatgacacggtggcaaccgaagaatttaaagtgggcgataacgataacttatctgctttagttgcgatccttgcacacgccgaccaactctatttattaaccgaccaagaggggctttttagcgcagaccctcgtaaagatccgaatgcgtcgcttctttctgtcgttgaaaggatcacgccggaaattcgtcaaattgccggcggaagttcaaccggactcggtaccggtggcatgagcacaaaaattactgcggcagatattgctactcgttcaggtgtagagacgattattgcttcaggctctcgtgaaaacgtgttggttgatttagccaatgatgtggcgatcggtagcaaatttttagtgcaatccgaccgcttagaaggcagaaaacagtggttattcgctgccccgcaggtgggggcattaacagttgataaaggtgcggaaaccgcattattacaacataaatcactcttgcctgtcggtgtttcagatataaaaggggtctttagtcgtggcgaagtggttaaaatctttaatcaagaaggcaaagctcttgcgctcggcttagcacgttacagtagcgaagcgttagaacgcattaaaggcaagaaatcagcagaaatcgaatcattgttaggctatgaattcggctcagttgccgtacatatagatgaaatggtgatttattaacaaacaggcggtcaaatttgctaaaaattttgcaaatttaaccgcttgcataagggagagaaaatggaattaggactagatgtttttgcaatcttatttagcgtggcaatgatagccggctttattgacgcaatcgccggcggtggcggattactgacgattccggcattattagctgtcggtgtcccccctgccatggcattaggtaccaataagttgcaagcctgcggtgggtcattttccgcttctatctatttcgtgcgcaaaaaagcagtcgatgtcaaacagattttcctattgatcttattgacctttattggtgccgcttgcggtacaatctttgtacaaaccattgatgtgaacgcactaaaagcattgttaccgttcttggtattgattatcggtatttattttttatttagcccaagtatcggtgacgaagatcgaaaacaacgtatcagcctaccgttatttgcctttacggcagctgccggtgttggtttttatgacggaatgtttgggccggcaaccggttcgtttttcacccttgcatttattttgttacttggctttaatttaccgaaagcggtagctcacgccaaagtgttaaattttacctctaattttgcctcattgattttctttattctaggcggtgccgtattatggaaaatcggtcttatcatgatggtaggacaatttatcggcggtactctcggggcaagaatggtggtgaccaaaggcaaaaaattagtgcgcccaatgttagtcaccatgtcatttataatggtagcaaaaatgctctatgatcaaggcttattaaactttctatgaaccaagcaaaacgaattgaaattttaacccgtttacgtaacgaaaacccacacccaactaccgaacttaattacagcaatccgtttgaattactgattgctgtcattctttctgcgcaagcaaccgataaaggtgtgaataaagccactgataaactgtttccggtggcaaacacgccgcaagccattttggatttaggtgttgatgggctaaaagaatatattaaaactatcgggctttttaatagcaaagcggaaaacattattaaaacttgccgtgatttaatcgaaaaacatcacggtgaagtgccggaaagccgtgaagcgcttgaagcattggctggcgtcgggcgaaaaaccgccaatgtggtactgaataccgccttcggacacccgaccattgcggtggatacgcatattttccgtgtatccaatcgtaccggttttgcaccgggtaaagacgtggtcaaagtcgaagaaaaattactcaaagtggtccctgccgaattcaaggtagatgtacatcactggttgattctacacggacgttatacctgtattgcacgcaaacctcgttgcggttcttgcattatcgaagatttgtgcgaatacaaagacaaaacggaataagttaccccttcacatacaagcggtcgaatttgtattttttttgcaaatatttatgtaaatttgaccgctgctcctatctttcttaatctatatttcttttctgcctaacggtgctacaatatcaccttttgcaactcaacatcccctcccgataaggacaaacaatgccgaatcagaatctactgaccatgaaaggtgagcgtgttgcgattgtatcaggactccgaacaccgtttgctcgtaaagataccggtttcaaagatgcatatgcaaccagtcttggcacaatggtaaccaatgaattactcagccgtacggcgattgagcgaaaagaaatcgagcaattagtttttggtcaagtaatccaacaaccggatattccaaatccggcacgtgaaattgcgattgcgctcaatatgccgcacttacaatcttacagtatcagtagttcttgcttatccggtttacaagcgatcgccaatgttgcgggcagtattgtcagtggatcaatttctgcgggtattgccggtggtgccgattcgatttctaatgcgccgttaagcattagccctcgagttatttataactttaaatcgatttttgctgcagaaacgctagacgaaaaatatcgccgtttccgtcagttctcatggcgcgatttcaaacctcacagcgtaaatttaaaagatttcaccacccaaatgtccgttgcggaagtttcagagcaaatggcgcaagactataaaatcagccgagaagatcaagacgaatatgcccgtctttccaaccaaaaagcggcagatgcgtggaaaatcggtttattaaaagaagaagtcatgccttctttcccgcatccttataaagattttgtagtctcggacaccttagtttccgctgcaacccgttctcgtcattaccaacgtttctcacctttggtaaataaagactatgccaccgttaccgaagcgaatatgccacaaccggtcgatggtgctgcggcagttttactgatgaatgaaagcaaagcgaaaaatttagggctgactccacttggttatatccgcagttatgccattaccggtaatgatatttggcaagatatgttcgccggcgcaaccattgccagcgctcaagcgctcgaccgtgcggaacttcaattacaagatatgagctttattgatattcatgaatcttcggcaagccaaatgctcgccaatattcaattttttgagtcgaacgaatttgcaaaaaaatacttaaatcgaaccgcttgtttgggcaaaattgagctggataagctcaatcatttaggcggttccattgcgtttggtaacccacgtgcggtaaccagtttacgcacaattattcaatcgctttacgccttaaaacgccaaggcggcggcttagcgttagtcgcttccagcggtttaggtggcttaggtgccgcaatggttttagaaagtgaataagggaaatacgatgattgaacaacaagaaccaacaccggtgtttcaagtagaaattgatgataaccgtattgcgattattcgtattcaaactttagataatgatgctaactggttaccggaaaactttgtcagcgaactacgccgcgtcatcggtagtgtcatctatcagcaagctagaggtgtgatttttatctctgctcgtgcccacaattttattcaaggcttcaagccgagcattctaaaagagaaaacagcagaacaattacgcctgttttcacaagaagcgcaagcagtaatgcgtgaaattaatacgctaaaaatgccggtgatcgccgcaattgacggcaattgtttcggcttaggcttagaattagcattggcgtgtgattatcgtttagcaacggatgaacatcacacacaatttgcgatgccgcaagtacgttccggcttattaccgtttgccagcggtacgcaacgtttacctcgtttaatcggcttacaaaatgccacaccactgttgctctttgggcataaaatcaatgccgaacaagcaaaaaaatttatgttagtcgataagctcgtgccggcaaccagactttttgataccgcttatcaaatgttattaaataacaaagtgcaaaaagttgactataaacgaccgcttaccttattcaaaaaatggcgtaaacaactggaaggcaacacgctatttcgtaataagtttctcgatcgtaccgaaaatttagtatggctaaaaaccttcggtaactaccctgcggttgctcgtctgatcgaattactgaaagagccacatttcaaggctgggttaaccctagaacaacatgcattcgctgagttatttcataccgaaacctcaaaagttttgattgatttgaaaaaaaccgaacgtgcgatgaaagataaatatcgcattcgtggtgatgtacgagatgtattgcaagtaagtgtgcttggttctggctatatgggcgctggcatcgcttatttaactgcaaataatgcgcaagtaccggtacgaattaaagacattcatccttcggagatccgtaaagcactacgtacctgctacgaattgatgcgcaatgaagtggataaaaaccagctcaagccggggcaaatgattcagagaatgaacctaattaccggcggtgagcgtcttgttgcagcaaaatcgaccgattttgttatcgaagccgtgtatgaagatctcaagctaaaacaacgtatgttgcaagaaagcgaagcctattatgacgaacacgcgatttttgcgaccaacacgtcaacttttgcaatccgagatatcgctgcagtcgctaagcgtccggaaaatgtaattggcttccactactttagcccagtggcgaagcaaaaaatggttgaaatcgtaccgcatgaaggcacttgtgaacatacgattgccacggcgattcactttgcaattcagcaaggaaaagtgccgttattagtcgctgataaacaaggcttctttattaaccgcattttaacgccgttcttattagaagcaattcaatgcttagtcgatggcgaatccattgagtttatcgaccgttccttgcaagaattcggtttccatttaggtccgttagcggttattgatgaaatgggtttagatgtgattgccaaatcaaaccctgctttggttcgtgaattaggcagacgttttagtttgccggaaagtgtcgatttactgattcgcaatgaacgcaaaggctgtaagaataaacgcggcttttatatgtatgattctaaaggcgaacgtttgcaagaggacaaaagtatttatcatgtgatggaaaccatcgctcgtaatgatttggaatccgaacaaattgcccgccgttgtattctgcgtatgctgaatgaagcggcgtggtgtttacaagataatgttattcagtctattgatgaaggtaatgtggcttccgtacttggtgccggtttccctgaatttagaggcgggatttacgcctatatggaaaaaatcagcgctcaagaaatcgttaagcaattgcgtcaacatgctaaacaatacggtagtcgctttgaaccttgcgaatggctaatacaacaggctgaacaagcttaatatttaaaaaagcggataaaaatctacattatcccaaaatctataaaggaaataattaatgaaaaaatcaacccttgcgatttctgtagtggctgcattagctgcaattactagtggcggtgcgtggtataccggtaaccaaattgagcagcgctatccggaactgcttaaacaagtaaataccgcactaaaaggcctaaaagcttatgatattcatgctgatatcagtgatgttaaactcacaaaaggtatctttagttcagaagttcaatataacgtcaatgttaaaacggataacaacagttttacccttaacggtaacgacactgtttaccatggtccgcttccgttaaaccgtttagtgaaaggtaatctgatgccgatgttactaagcggcgaaacgcatatttctgccgtggacaaccagcttaaaagctattttgcaggtaatgatattctttcagcgacaactgatattcattacagtggtaatgtggcaggcaatgcaacgcttaatccgtttaaatcggagaatattgaagcctcaaaaatctatttagagggcgattataacggtttcggtaaacaacatttgaatattgagttactgaaaataaaagacgctggcgaaagtaaaggtgcgcttgaattatccggcttacattacacggcaaattacacgcaagataaacaatatccagaactaaaaggtttaggtgattatcaagcgaacattaaaaagctctctgttgttaacgaaaaaaatgaggtcatcaatttaaacgaactaacatctaaaggttatagtgaaattaaaaatgagcgagtggttggttccggagatcttacgttcaatgcagattgggctgcagaagctaaaaccgctgatttagggaagattcatctcgatatgatgatggattttgacgcaaaatcatttaatgaattgactttgctttcagataaattggaaaacgaatcgcctgaaatccaaaatcagttacaaacagctgtaaccgaccttattactaaagcacctaaattaaaaattaacgaactctcgattcaaaatgcgaaaggtaaaaatagtttctcacttaatttagatttggataaattcgatattgcacaaatctcacaagcgaaatctatcgaagatacgcttaaaatctttaagccgtctcagctagatctaaatgtaaatctagcagcaagtgaagaaatgacaaaacaatggttaaccattgcgcctgatgcaaattatgtcggcacaccggaagaaaatgccaaactgcgtattcaagaattaaccaatagtgcgaaacattcgggcattgctagcgtagacgctgagaatattaaactggcattaaaaattgagaatggcaaagtaaacttaaatggtagagaggtatcagaatccgaactacaattggcactgtgggcaattatgctcggtgcgagcggcttaggtcactagtcattcattaaacacgcggtctgttttggtagaaaatttgcaaaattcttactaaaacagaccgcttgtttttaccttaaagccactgatatagagcaataatcagcggcatggtaaacacacaaagtaaggtagttacgccataaattgcactggcttttcttgcgtcttggttatataccaccgccatttgggtaacagttgccgccgaaggactagtggttgccaagaaactaatcatcgcaatagttgcaccgttctccgctacccaactgccaaagtcgaacgctttcacaatcaccaataaaatcagcgggataaaaatcaagcgaagaaacgaaaccaaataaatacgcttatccgccataatctctttgaccggaatcgacgcaattaacatccctgccactaacatcgccattggcccaatcatatcgccaagccaagctaacgtaccggaaattacactcggtaatttaatttgtaacaggaacaacagcataccaatcacaatcgcaataatgttgatattagtcacaatctttttcaaagacacttcgcccttaccacacaataacatgcgtaaatgcgaccaaaacaagaaattttgtaccaccataaaaccagtggcataaattacccattcattgccaaataacgaagcgaccaacggaataatcaaattgcccgaattggaataaatagcggtggcgtgttccaaattacttaatttaaaaatcggctttaatattttaccaattaaaatcaacagaccgcttaacaaaatcgccataccgaaagacaaatataagccgtgtaaaatagcgtccgaatattcgatttgaaaggcggtaatcagcatagacggactaataatatacaacccgataaccgaaataggataactttgttccgaagtcagcaattttagcttcaccaataaataaccgagtaacacaataatggttaactgggtaattttctccgctaataataaagcgatttccatattaggcattctccaataacaagcgtttctcaccggaatatacggtcgcttttcctttgcgggtaaaagcagtcaaagtgaaatcatgtgcctgcgcaatctcaaccgccaaagccgttgttgcggaaatggcacataacatttcgataccgaccgccaaacatttctgcaccatttcaaaactggctcggctggtcacaaacacaaaaccaagcggcttaccggctttcgcataccaaccgataagtttatcgagtgctacgtgtctgccaacatcttctcgaatcgctagcaattccccttgcggagaaaagaatgccgctgcgtggcttgcaccggtttgttgtgccaattgctgcgcttgttccagttgttgcaagcaatcatcgaatacctgtggatttacggcttgcaagcggccatttttttgtaaaaatttgcaactttggctgacttgttccaactgctcgaccccacaaatcccacagccggttctgccggtcattgaacggcgcttttcttttagcgctacaaattgacgagtggcgatctccatttgtacttcgataccgttgcactgttcaattacatctagcccgtataactcttgtttatcggttaaaatgccttccgccaacgaaaaacctaatgcaaaatcctctaaatcttgtggcgttgtcatcattaccgcatgagaaatgccgttatacactaacgcaaccggcacttcacaaataagattttcttgaatttcagtagtaaaaaattgttgtaatttaaccgcttgtttttgtattgttatatccataatttattccaaattaccttccaccccatatttttatcgttattctacaattttttattagtcaacaatataagagtttcgcactgtttctattgcagaagaaataaaaatcactttcatttgataacaatttgttaacaaaaatgcttttttacttgcattttatgcttattttgttaaaaatttgtaaaacccaaaaatactcaataacatttaaattccgctagtatttcactaaatatttaagctatatcaaactaagtgcaaataatgtctgctttacttacgattgggtatggcttattacaaataaaggtcaataatagctttcactttaaatgcagtatgcaattggagtttttttcaaattatttgcattaatttttattaatgtttcatttttaggtaggagtgattatgcaggtctctagacgtaagttctttaagatctgtgcaggtggtatggcgggcacatccgcagcaatgctaggctttgcgccggcaactgcgttagcggcccctcgtgaatataaattattacgagccaaagaaactcgccaaacttgcacttattgcgccgtaggttgtggaatgctgatgtacagcataggtgacggtgcaatgaattcacgtggtaaattattccatgttgaaggtgacccagatcatccggtaagccgtggggcgttatgtcctaaaggtgcgggtgttttagactatgtaaatagtcctaatcgtttacaatatccggaatatcgtgcgccgggttcagataaatgggaacgaatttcttggcacgatgctattcataaaatcgcaaaacttctaaaagaagaccgcgatgcaaacttccaagcaaccaacgaagccggtacaccggtaaaccgttggctcaccacaggtatgttatgcgcttctgctgcaagtaacgaaacctgttacctcacacataagtggggacgttctctcgggatgctctatttagacaaccaagcgagtacctgacacggaccaacggtagcaagtcttgctccaacatttggtcgcggtgccatgacaaatcactgggttgatatcaaaaatgcggacgtagtggtcgtaatgggcggtaatgccgctgaagcgcaccctgtcggtttccgctgggcaatcgaagcgaaaaaacaaaacggtgcgaagttaatggtggttgacccacgctttaaccgtacggcatctgttgcggatttctatacgccgattcgttcgggtactgatatcgcaatgttattaggtgtgatccgttacctgttagcgaacgataaaattcaacacgaatacgttaaacactataccaacgcaagtttcttagtaaacgaaggttttaacttcgaagacggtttattctccggctacgatgcggaaacacgtcaatacgataaatcgacatggtcttatcagcttgatgaaaacggtcagccgaaacgtgatttaacgcttcaagatcctcgttgtgtcattaacttattaaaagcacacgtggaacgttatacacctgaaatggttgagcgtatctgtggtacgaagcaaaaagcattcttagaatttgccgaaaccattgcttcaacttcaacgccggaacgtacaacaaccttcttatatgcattaggttggactcagcattcggtcggttcacaaaatattcgctcaatggcaatgattcagttacttctcggtaacatcggcatggccggcggcggggtaaatgcgttacgcggacactcaaacgttcaaggttctacggatatgggcttgttcccatcaatgttgaccggttatatgccgcttccgaccgaaaatgatacgtcattagatgcatttttagcgcgtattacgccgaaaacaacggttgaaggtcaggtaaactattggcaaaacacaccgaaattcttagtcagcttgcttaaatcattctatggcgataaagcaacggcagaaaatgaatacggtttccataatttaccaaaacaattaccgaaaaaactcgacccgatgcaatacatcaacatgatggttgaaggaaaagttaacggttatatctgccaaggttataacccgattgcgtcttatccggattcgaataaagtccgtaaaggcttaagcaatcttaaattcttagtcattttagacccgttagcgaccgatacgtctaacttctggcaaaaccacggtgagatgaatgatgtcaatccggcagacattcaaacggaagtattccgcttaccgactatctgttttgcggaagaagacggttcgattgcaaactccggtcgttggttacaatggcactggaaagctgccgagccgccaaaagaggctaaaccggacgtagatattctctcggaaattcgtgaagtgatgttagagatgtatcatcacgaaggtggtaaatcgattgatacgattgaagcgatgacttgggattacgcaaatccggcagagccaaaagcggatgagttagccaaagaaattaacggctacgcactagaagacatcgttgacccgacaagcggtcaaattttagtgaaaaaaggcgaattactttcttcatttgcacaactgcgtaatgacggtacaaccgcttcaggtaactggatttacaccggtcaatggacaccgaaaggtaaccaaatggcaaaccgtgataactctgacccgtcaggtttaggtaatacgttaggttgggcatttgcatggccggcaaaccgtcgtatcgtgtataaccgtgcgagtgcggatccatccggtaaaccgtggaaccctaaacgccagcttgtaaaatggaatggtaaaaactggaactatattgatgtagcagacttcggctctgctccaccgaatagtaacgtgagtccgtttattatgcagccggaaggggtaagccgtttattcgcattggataaattggttgatggtccgttccctgaacattacgaaccaattgaaagcccaatcggaacgaacccgcttcatccgaatgtggtacaaaaccctgtggtacgtattttagacagcgataaagcaagtttcggtacagcggatgaattcccttatgtcggtacaacgtatcgcctaacggaacatttccacttctggacgaaacaatccatgttaaatgtgattgcgcagccggagccatttgtggaaattggtgaagcgcttgcacaagaaaaaggcattgctaacggcgatacggttaaagtgagctcaaaacgaggctttatcaaggcaaaagctgtagtaacaaaacgtgttcgttcggtacaggcggacggcaaaaccattcatacggtgggcattccaattcacggtggttttgcgaccgtaggtaagaagggttacttagcgaatagtttaaccggtcgtgtgggtgatgcgaatacgcaaaccccagagtataaaacgttcttggtcaatattgagaaagtcacggaggtagcataatgtcggtcgttcaagaacaaaacattattaaagtctccgcaacttcattcgttacaccaccaccgcaagctcgtaccggtggtgttgtagaagtggcaaaattgatcgatgtttcaacctgtatcggttgtaaagcgtgtcaagtaggttgttccgaatggaacgacctgcgtactgctccacaagaatgtgtaggtgtttatgataacccgattgacctgaatgccgaacaatggacggtaatgaagttcaatgaagtggaagaaaatgatcgcttagaatggttaatccgtaaagacggttgtatgcactgttctgaaccgggctgtttaaaagcttgtccggcaccgggcgcaatcattcaatatgcaaacgggattgtggacttccaatctgacaaatgtatcggttgcggttactgtattgccggttgtccgttcaacattcctcgtatgaacgataaagataaccgcgtgtacaaatgtaccctttgcgtcgatcgtgtcaacgtaggtcaggaaccggcgtgtgtaaaaacttgcccgacaggcgcaattcgcttcggctctaaagaagaaatgcttcactacggtgaacagcgtgtagcggaactgaaaactcgtggttacgaaaacgccggtgtttataaccctgaaggcgtgggcggtacgcacgtaatgtacgtattacatcatgccgataaaccggagttatattctggcttaccgaaagatcctggcattgatccaacgatcacgctttggaaagacgtattaaaaccggttgccgcaattgcaatgggcggtcttgccctcgctgaagttgcgcactatgtaacgattggtccaaacgttgaagaagatgtggaagatcatcatgaggaaggagataaacatgagtaagaaattagagattacgaacgatactaaaatcgttcgtcataaaccgcttgcccgtgtgagccactggtttttggttatcgctttcttcttaaccatgtttaccggggttgcgtttttcttcccagattttgcatggttacatgagattctcggaacaccacaacttgcccgtgcattacatccgtttaccggtattgttatgtttatcgcgtttatcattatggcgtttatttattggcaccataatattccagaaaaaaatgatattcgttgggcaaaagggattgtcgaagtattaaaaggtaatgaacacgcggttgcttataacggcaaatacaatttaggtcagaaaatgttgttctggactctaattttagcgatgtttaccctattgattacgggcattattatgtggagaaaatacttctctgcgaatttctcgattcaaacgttacgtatcgcaatcctacttcactctgctagcgcatttgcgttatttaccggtatcctagtgcatatgtatatggcattctgggttaaaggctcgattaccggtatggttgaaggttgggtaacggttcgctgggcgaaaaaacaccatccaaaatggtttaaagaagaagtattacctgaaattgaaaaacaagtgaaggaataactggcttctaaaatgacttaaagtgcggtaacttaccgcactttatttttgaacacttgatttttaaatgcttgctaagtttctttttaaagggcatttagcaagatttaaccagagataataatatgagtatccgaattttacctgaaaacgaaatcaaacaagcggcgagctcgtttcaaaacccgccgctactgtttgctaatccaaagaatctctatttccgccgagcaaagcgtttaagagaactcgcggaaaataatccgtttggcgattacttagaatttgcagcaaatctttctgaggtgcaattagatttactggaaagtcgtcctattgcaaattattcggaaaaattgaccgcttgtgtccaaacttcaaacggacaaaaaccgttaaatgccaaaaccttccaacgcagcagtgaatggcgtgagttattattagctttaattgataagtttaagccttatgcaaacgacacgatgttggttactattgagctgttggaaaaatcttcgagttccgaattagaagcttttgccgatgatttacttaacgaacgttttgaaacagtgggtgcagacaaagcggttttcctatgggcagctttatcactttactggacgcaacttgcgcaacaattaccacgtaatacccgaaccgaagttggtgaacgtcatacctgcccggtatgcgattctgcaccggtggcaagtgtggtacattttggcgacacccaaggactgcgttatttacattgcgcattatgcgaaagcgaatggaatatgactcgctcacaatgttctgtctgcgaccaaagcggcaaattggattattggagcattgatagcgtagatgcagcggttaaagccgaaagttgtggcgattgtgaaagctatctaaaagtgctttatcaagaaaaagatccgcacgtagagccggtcgccgatgatttaggcacactgattttagatgcggaaatggaacacaaagggctggctcgcagtggcttgaatccattcttattccaagtggaataaccattctttttgcaaaaaagcggtcaaatttgaccgcttttttacctctctgatttatatgcattcgattaatttgagtttcgtcattatttcacaaaattaattaattctttattgctattttcactatttttaggtatatctacccttagttaaatttatgcaatacataggaaaaaattatgaatcagccatactccgctatgcgtaacaacatccatatgcttggtgattttttaggtgaaactattcgtgaagcccaaggtaatgacatcttagaattaattgaaagtattcgtgtgctttcaaaaaattctcgtgccggcgatgaaaaagcacgcgaacaattactagataaattggcgaatatctcaactgaaaatgtattacccgttgcgcgtgcatttagccaattcttaaacctcaccaatattgctgaacaatatcaaaccatctcacgtcaccatcaagatgcctcgttaggcaaccgttcgttagatgcgctattcgctcgcttaaaagcgcaaaatacaccggttgagactgtcataaaaaccgttgagaaattattggttgaattggtattaaccgcacatccaaccgaagttacccgccgttcattagtacataaacacgttgaaatcaataaatgtttaggtcagttagaacatgatgatttgaccgatgcggagcaaaccaaacttaaacgccgtttaatgcagctgattgcgcttgcatggcataccaatgagatccgtgcggcacgtccaacaccggttgatgaagcgaaatggggcatggcaattattgaaaacagcttatggaaagccgtacctgatttctgccgtgaactgaacttccaattagaaaaacattttggtgtacagcatgacgtagcgcttgctccggtgcgcttctcttcttggatggggggcgaccgtgacggtaacccgtttgttacctcagaagtgacgcgtaaagtgttacacatgaaccgttggaaagcagcagaattatttttaaatgatatcagtgatttagctgaagaactttctatcgtacagtgtaccgatgaattccgagcgaaatacggtgatcatatcgaaccgtatcgtgttgtagtaaaagggttgcgtacaaaattacaaaaaaccttaacctactttggtgaattaattgaaggtaaagcgaccacagttgatccaagtgacatcatcactaacgataacgatttatgggagccgctctatgactgctatcaatcattacaggcttgtggtatgcgcattattgcaaatggcggtctattagattgcttacgtcgtatccgttgtttcggcttaggcttatctcgtttagatattcgccaagaaagtacccgtcacgaaatggcaattgctgaaatcactcgctatatcggtttaggcgattacgcacaatggacggaagacgacaaacaagcattcttagtgcgtgaattaagctctcgccgtcctttagtcccgaccaactggacacctagccctgaaacacaagaaattttagatacctgtaaagtggtcgctcagcagccggaaggcacgatttccgcttatgttatttctatggcgcgagaggcttctgacgtattagcggtacatttattattgaaagaagccggctgtaaatataccgtaccggttgcgccgctattcgaaacgttagatgatttggatcatagtgaaaaagtgatgaccgatttatttaatatcggctggtatcgtggcgtaatcaataattaccaaatggtaatgatcggctattcagactcggcgaaagacgccggtatgttagcggcaagttgggcgcaatatcgttcacaagaagcgttagtcaacttggcggaaaaatataatatcgaattagtgctattccacggtcgtggcggcacggtaggtcgtggtggtgcgccggcacacgctgcattattatcacaaccgcctcgctcattaaaatctggtttacgtgtcaccgaacaaggcgaaatgattcgtttcaaactcggtttaccagccgttgcggtagaaaccttaaatctctatgcgagtgcgattttagaggctaacttattaccaccaccggaaccaaaacaagcatggcgagatattatggataaaggttctgatatttcatgtgaaatttatcgtggagttgttcgcggagaaccggattttgtcccatatttccgcagtgcgacaccggaacaagaattatccaaactgccgctaggttctcgtccggcaaaacgtaatccgaacggtggtgtagaaagcttacgtgcaattccatggattttcgcttggatgcaaaaccgtttaatgttaccggcttggctcggtgccggcgctgcgcttcgccaaatgattgaacaaggcgatgaagcaacgcttaaagaaatgtgcaaagaatggccgttcttctctacccgtattggtatgttagaaatggtattctcaaaagcggatttatggcttgccgaacattacgaccaacgtttggtggcaaaagaattacaccgtttgggtaaagagcttcgtgcacaattatcggcggatattcaaaccgtgttgaccttagcgcatgacggtcagttgatggcggatttaccttggattgccgaatcaatcgcattacgtaacgtttataccgacccgctcaacttattacaggtcgagttattacaacgtttacgtagccaaggtgatacgccggatccagctttagagcaagcgttgatgatcaccattacaggtattgccgcaggtatgcgcaacaccggttaattgcaaaaaatcagtaaaaaaagaccgcttagttgactacaagcggtctttttttgcatttattttacctattcgcttcaaaattcttttcattcgcttgctatatccattctaaaatttatgttatcatctcgaattgtttttactcgatttttatttatatgaatattcgcctaaacatcattctacttgttattgttgcagctttaggtggttggtatatgagccaacaaacgcctgaaacaaacggtttagatcaattaatcaagaaagaaggtaatcctgattatactgggaataagatgactacttcggtttatgatctaaaaggcaacccacaatattttgctcaagccgatgaaataaaacgttatgaatcaagcgaaagaacggaatttttaaacccttttgttgacttatttgatgcacaaacagcactcaaacaatggaaggtaagcgcaaaacacgctgaaattacgaaagaaaaaatgctgaatttatcaggtgacgttaaaattgaagcgcttgatcccacctctcgcttacagcgagttgaaactgacaaactaaccgttgatttaaacactcaagatatctttaccgacagtgcggtaaaatccgtaggattaggttttacaaccagcggggtcggtttaaaaggcaatttaaaacagcaagttgccacactcactaaaaacgtaaaaacttatattgaaccaactgttataagacagtctaacgaaaaagaaaaatcagagacgcaatctcctaaggacgtacaatgaaacttgtcatgaaatcggttgttcttacaactctattgggtgtaagtatctcagcacatgcgctaaaaggcgatacagatcaaccaatcaacattgattcgggtagccagtctctcgatatgaatagcaatgtggttgtttttaccgataatgtcgttattacccaaggctcaattaaagtcactgcgaataaagtgacgattacacgtcaagaaggtaaaaaagaaacgcttgatgcaacaggttcgccggtgactttccaacaaacactggataacggtaaaccagtgaacggtaaaggtaacagtgtgcattacgatctcaattcagaatttttgacattaatcggtaatgcggaattaaaacaacaaggtagttttatcaaagcaagtaaaattacttatgatgtaaaaaaacaacagttaaaagcaagtagcggaaataaatcacgagtgagaaccgtgcttattccgaacgaattaaacaataaaaaatagtaggtaatatcaatgccaacgctttatgcagaacatttagcaaaaagctacaaaaatcgccaagtcgtaaaagacgtgagcctgaatgttaaagcaggagaaattgtcggtctgttagggccgaacggggctggtaagacgaccactttctatatggtcgtaggtcttgtacgccatgatcaaggtaaaataagaattgatgatgaagatattagcgtacttccgatgcatgatcgtgcaaaacagggtatcggctatttaccgcaagaagcatcgatctttcgccgtttaagcgtatatgacaatcttatggctgttctccaagttcgtaaagacctaaacaatcaacagcgcaaagctcgagcggaagagttaataaatgaatttcacatttctcatatccgtgacagcttagggcaatcactctcaggtggtgaacgccgtcgagttgagattgcgcgagcacttgcagcaaacccgcaattcattttactagatgaaccttttgccggcgtagacccaatttcggtgattgatatcaaaaaaatcattgttaatttaaaagaacgcggtttaggcgtattaatcaccgaccataacgtgcgtgaaacgttagacgtatgtgagcgtgcttatattgttggtagcgggcaaatgatcgccagcggaacaccggctgaagtattaaataaccctgatgtaaaacgtgtttacttgggtgatcaatttaaactgtaatctgatggatttatagggcgctcaataacgccctatcttttcagagtaaaaattatgaaattaacagaatttctgacgatcgagaacattcgtcaaggtgctttgatctcaagtaagaaaagggcattagaattagtcggtaaaattattgcggagtcactgaataaaagctgtggctgcggagaaagcgaagggctttgtccaatcgagtgttttggtaatctatttaaacgagaaaagcttggttctacaagcttaaatcatggcattgccttaccgcacgcaaaattaccgagttcatcaacactttctttagaaaaaccgattgcggtatttatccagcttgaaatgccgattgactatgaagcaagtgataataaagaagttgatttaatttatgcggttatgttccctgaaggtcactgcgaaacatataaaggctgtttacaacatattgcacaacgtcttagtgataaaacattaataaaacaattgcgtagtgccgaaagtgctgaagaaatttggcaattatttgaatacgcagataatcaaactatagagcaagattaattgcattagaggaaaagtatggaattagtgattataagtgggcgctccggttcaggtaaatccgttgcgctacgagctttagaagacgtaggttattactgtgtagataacctaccgcttccgcttattcctgaattagcctcattcttagcgagttcagagcgctctgcagttgttagtcttgatattcgtaacttaccggaaaacccggaacgcatcgaagaattgcttaaccaactttcacaactcacgatcaatacaaaattgatttttcttgattgtgaacgtaatgcgctcatcagacgttacagtgactccagacgcttacatcctctgtcgaataaagatttatcccttgaaagtgcgattgatttagaaagcactctgcttgaaccactttttcaccaagccaattatattattgatactacgaatatttcttcacatgaattagcggagaacttgcgtagtctcttacgcggctcaaccgataaagaactcaaaatcgtctttgaatctttcggctttaaatacggtttacctgccgatgcagattacgtttttgacgttcgtttcttaccgaatccgcattggaatcctgaattacggccaatgaccggtttagagcaaccggttatcgattttttagatcgacaaactgaagtacacaattttatctaccatacacgtaattatttagaaatgtggttgccgatgttggaaaaaaataatcgcagctaccttacgattgctatcggttgtaccggtggaaaacaccgctccgtattcgttgcggaacaattagccaaatattttcaaagtcgagacaaagacgtacaaattcgtcatcgcagtctcgaaaaacatcatcgtaaatcttgctaatctaagcggtcagtttttctcaaaattttgcaaatttttcaagaaaaacgaccgcttttaatttatacattcaataacatagcacactatgaaatcagcagatatcatcattattggcggcggtatggtagggcttgcactcgcagcgctattaaaagatacggaatgccaaatcaagattattgaaaaaaatgcgccgacacttagcgatagctattccaatcgagtaagtgcgattaatgcaaccagcgaaaaaatgttacgccgaattggtgcctttgatcgcattgctgtcgagcgcttatcgccttaccaacaaatgttagtgtgggaaaaagacagttttgccaaaattcattttgacaatagtcaaccggaaattaagcaattaggcgcggagcaactcggctttattattgaaaataatcgaattcgccatgccctttggcaacaagtcagccaacaaaccaatgcggaaattatgttagcgtcaacacaaactatcggtatcaatgagacaggcgcatttttaacattagacaatggtgaaatgttaacggctaaattagtagtagccgcagacggtgccaattcatggctccgccagcaagccaacattccactgacaagtaaagactaccaacatactgcattagtctgtaatgtaaagacggcggaacctcatcaagctatcgcacgccaaattttctctccggagagtattttggcatttttaccgcttgccgatgaacaacactgctcaattgtttggtctttagcgccggaacaagctgaaatgttagtaagttgtgatgaaaaacaatttaatcaagctttaactattgcctttgataatcagctaggtatggttgaattgcaaagtgagcgtgcaatttatccgcttgtagcacgttatgctcgtgattttgcacaaaatcgtattgcgctgattggggatgcggcacatacaatccatccgttagccggtttaggagtaaacttagggtttgccgatgcaattactcttgctcaggaaatccaacaacatttagtgcttggatatgatatcggtgaatatcgtcacttacgccgttttgaacgtattcgtaaagccgaagcgattaaattattggctgcaatggaaagtttaaaacagctttttcatggcaataacccacttaagaaattaattcgtggcattggcttaagtgcagtgaaccaagttcctctgctaaaaaaacagctgattgctcaagcaatgagcatataattaaagtttaaaaattacacaatcgacaatcttatacaagattttactgaactagtcttttatctcattgtctattaccgttacaataaacgcccttttcaaagggaatttttaatcttactttttaaggaatactaatgaaaaaattagcaaccattggtgcggtagcactcttagcatttagcgtaacagcatgtaacaaagcagatcctgcagcggattacaaaaaattccaagagtggtatcaagttcaagaacaaactcaagcaactgcacaagctgagttccaaaaacaattagctgaagtgatgggtcaagcagagaaagatcctaaagcattagaaaccgtattaaataacttcgcaggtaaagtgcaagaaacattaaaaagcttagatgctgttgatgtgaaaagcgaagaaattaaagcattaaaagacaaaactaaagccgttttaggtttatcaagcgaagtgctttcggagcaagtaaaagtgatgtctgccccaacagcggaagcgcaacaagcgatccaagcgaaagcagctcaattaaaccaagctgctcaagaacttcaaaaattacaagcagatttaaaagcaaaatttgctaaataatttgctgatacaatgatagaatcataaggttagtgttgcaaagcactaacctttttcatataggataatcacatgaataaatttactaaaatcggcgcaaccgcgctattcgctttatttttaagcgcttgcgataaaccggctaataaaacagctgaagcacaagcgacacaagcagaaactaaagttgctgcggtagataccggtgcacaagactacaaaaaattccaagaatggcaacagctacaagaaaaatcaattggcgatgcaattaatagtgcaattgaaaaattaggtgataaagcaaaagatgccgctcttattcaaacaaccatgaataaagcgattcttgagcaaattgaaaatatccaaaaaagtgctgcaacgttagaaatcaacgatccgcaagtaaaagcacttaaagataaagcgcttgaagctatggcattaggtgcaaaaatgatcgctgaaaacgacaaacttgccaaaaatccaactcctgaagcacacaaggcgtttggtgaattacaagcgcaattagataaaattgcgacggaaggtcaaaaaattgaagcggaactagcaactaaatatggcgcagctccagctccagctccagctccagctccagctccagctccagctccagctccagctcaataattatatttttatcggctaggcaatgcctagcctttttcactcggcagcaaacagcatcaaaatgcacaacataataaaaattattatttcttattcatttatattaggtcttatcggttgtacagcgctggaaaaccactctccacaggctgatttccaacgctttcatcattgggatgaggtttacggaaatgattatatccaagcgaccgtctttgcgatgtacggtttagaaaccgctacaaataaatatgcgcgcattgaaactatgcaaaattatttagaagaagtggatacgatccaagcatcgttgaactatctggatatccaaaatgatgaaattttaccaattaaaaatatcggcttaagagcgttacaattaagccaagaaacgttcagagatatgattaaactagaatctcagcccaatgaagcactggcgcaatcggttcaagataaagggcgaatcattacccaattaggtaatgaaatctcacatgaaaaattaaaattaatgaaaaaatatcaactataaacaaaaggacgcccaagtgcgtcctttttactttttattgccaacctaaagccctatttgcaatattttctcgcaataacttgctatgcgaaatcgcaaataagcctaaatttctgaccgcttgtagcggtaataaatcacaagaaaacagtgaaatcagaccgcttgttagagaaataatctctgcttgatcttgctttctcgattgctcaaattgattaagcaatatgaactcgcccaaattttccccttgttcaaaggcttttgacaatagttgtgcaagggtaaacagatctcgcatacctagattaaaaccttgtccggcaaccggatgtaataattgtgccgcattgcctacaatcgccaagcgatgatgaatatgcgattgcgctttttgcgaagtgagcggataaacaaaccgcttactgactcgcaaaaactgccctaatttccaaccgaattgctgctgtaattgcgaaagaaattcatcatcagaaagctccatcaaatcttcagcttgtttcacacaccacactaatgacattcgattatcacttaacggcaacaacgctaacggaccttgcgtagtaaaacgctcaaaagcttgacctttatgcggttcgctgatttcgacatttgcaattaaagctgattgttgataatcctttaatagctcagtttcaacaccgcactgctgagcgatttgggattgaatcccatctgcagcaattatcagctgtgttctaatgtgttcgccattttttaacgtaagcgaaacctcagtttgtgagcgttcgaaatgaactatttgattcggacaaaaccgatggatattcggctgctgctcaatacaagcggtcaaatttttgcctaattttgcaagctccaccacgacacctaattgtactaaattcaattcacttgcttttaatgtcgttttaccgaaatgtccaacatccgatacttgaatctgttgaattggcgtggcaatttgctgaatttgttcggtaagtgagctgccgacaagcggttgaatttgagcaaatttttgcaaactgccttgtgccaacgcaatactacgtgcatcaaaaccgccttgttgcgcataatcaggcaactgtttttcaacgatcgcaatccgcatcttatgttgtgacaagctacttaacgccaatgccaacaccgaaccggttaccgctccgccgacaatgaccacatcaaactgctctgccatttccacctcttattcaaacacacgtaacacatcaagcggatagctttctccactcaaataatcttcaatagactggctaactaacggattacgttcgcattgtccttcctgctgaataaaatgcttaaattcctctaaactcagccaaaatccttgagtaatatcgctatcttgcggcgaaatcggcacaaaatcatctaattcaaccgcaaatacaaaacgtaaataatcggtctgtgaacgaggtgcgtgccattgataaatcttaattaaacgttgggcttcggcacgaatcccagtttcctcaaataactctctactcgccccttccaacaacgtttcatttgcttccaaatgccctgccggttggtttaaggttcgtttaccgtattcgatttcttccacaaataaaaatttacctttgcaatgtaccacacaggctaaagtaatattcggtttatgcatacccgctccccaattttccgcttaaatgacgtcaattaacggcttcgcactgtccgcctcaagtaaacgccccactctaaatagaggcacgtttgcctgttttgcaatttgttgtactttttcaaccgcttgtgggcgtacggcaatcaacaaaccgccggaagtttgcggatcacacaaaatcgccttttgttcatcggtcatagctgaaatcaaatgtccatagctgtcaaagttacgatttgttccacccggtactgcaccttgagcgatatagtcttttacaccgcctagcgtatggacttcagcaaaattcacttcggcacgcagattagagccttggcagatttcacttaaatgccctaacaaaccaaaaccggtaacatctgtcattgccttcacatcggataattgcgagaattttgcaccaatcaaattaatctgacacattacatcacgtgcaagattctgatgttccgcttttaataaacctttcttctcggcggttgtcagcacaccgataccaagcggtttagttaaaaataactcacagccagcttctgccgaagcattctttttcacttgttcagtgctaaccatgccggttaccgctagcccgaaaatcggctcaggcgaatcaatcgaatgaccgccggctaaggcaataccggcttgctgacaagcaaaacgtccaccttccacaattttttgtgccacttccgccggtaacttgtttaccgggaagcccaaaatcgcaatcgccataatcggcttaccgcccattgcaaacacatcactcaacgcatttgccgccgcaatgcgcccgaaatcaaacggatcatccacaatcggcataaaaaagtccgtcgtgctgataatgccaacgccattaccgatgtcatacacagcggcatcatcagcggtttcattacccactaataaattcggatcaacaaatttttccagctgactttgtaaaattgtccctaacaccttaggagaaattttacagcctcaaccggcaccgtgactgtattgcgtcaaacgaatcggttcttccgccattttatacctcgtaatctatctctgaattcggttattgtacgccaacaagcggtcagatttgagcaattttttgtaaaaccccataatgaacgctaacacgacatgaaatgtcgcacctattggttactattaatattcaaaaaaattaagtgttcttattcttatataggaaaatcagtatgtttcgcaaaatttgttctcttttcaaatgttttaatcggaaaacttcacaaactaaaatcgtttcacaaccgcaatatagtaaatccccccaagttacaacattgcctaaaaaatataaaaaacgttatccgctcattaccctaaaaccctctttaattacacccaaaaataatcgtataaccgttacacctgaaagtaagattcgctttattggtattggtagtgcaggacaaaatatcttaatggaagtggcaaatgttttacccgaacaggattatctgttaatcaataccaatctgatttctctacgtaaatcatcgtttaatacgctacatataggtaattctcccattggttgcggacctgatccgttacttgctcaagaagcggtgaagataagtgaaccgcaacttatcgaagcagtcaccggacaagatattatcgttttattttgtggtttaggtggaggaaatggtacgggtattgctccggaaatagctcgtttagctaaagcacaaggctgtcaagttttggcatttatcgtcactcctttttattttgagggtaataaacgtagccgattggtctatttcgccaaacaggaattagcaaccgcttgtgatatttgtgaactgtttaataacaatgatttattaaggctggcagatacaatcacaatggaaagtgcaattcaaacacaaaatgctctcattattcaacgcattaagcattatctaggacttacagctaaacgcccgtttcacatcagtatctataaaccataagtccccttggaggaaatatgtttgttccaatgcaagaaccaaataatctaattattcgccttatcggtattggcgaatcaggcggcaaacttattcagaaaatgataaaaaagccagctgaaaatgtgttttatattgccattgatcacaatgaacagcgtttaagtaaagtgatggcgcatcataaattacttgtaacctcggcagaacagcaacaaaaatcgatagaattactcaaaggtgtcgatttcttactgatctatgttgatattgataatgaagaagactttaatattgctcaagcattgattcaaacaagcaataacacgcttgtagtgattgctgcccaatatttacaagaaaatgctcaaattattgcacgtacaaaaaaactccatactgatcacagttgcatagtacattttgacttacagaaagaatgtgaaatttatcaattagctgagcaagaagcgaaaaatcatcttgaacaaagattaattcaattttcacacctaccgaatataatgtcctgtccggggttaactaatattgatattcaagatgtttgctcaatcctttggggagcggataacgcatttttcataatcgaatctgcgtccggaaaaaatagagtagaattaattataaataaatttatcgaacaggctaaatttagatatgccagtcaagttgatgctgtccttatcgatatgcaatcaggcttaaatcttgaacttgacgaaattaatctaattctggatggaattcattcgataagcgatgaagccggcacgataattttcggtacatcaatatccgaatcagattcggaaactcttactgttatggggatttttgcttgtgaaacaagcggttaaaaatgtacattttctgcaaaacaaagccctcaaaagagggcttatcttctacacacaatcactgagaaatcatcattaaatctttgtcgttttacatactttctataagcggtaattttttcttcaatattttcatattgttgccaaatctgttctcggaccttttctgagataaaatcagtcagcccatcagaacaaagcaaaataacttcctcttgttgtaaataaaaggtgtgtgaaaaaatttgaaaatccgtttcttcaaaatccacaattaagcaagattctaacccattatatagacctgaatactccacatcctctattgcgattccatctgcttttaatattgaaattaaagtatgatcttggcttatttgttgccatttcccatttgctgaaattttataagcacgactattcccaacattaacaagattagctaatccatcattgttaatttggcaagcaacaaatgtggtggcactgccccaatatttttctgaataagtttcacaaaataatttatgttgataacgtaaccaagaagctgaaagattttcgcaagtttttaattgattcataaaaaatcggcttgctaactgggagtttgtgctatgagaaacaccatcagcaataccgattattactgattcttgccgtaacgttaccacgtctgctaatttcaaaatatattggtaaacctcaatgccattaaataatgcatcttggttgacttttttatgtttagccgattgttgggtaaaataaatattaaacatatttatccaataattctctcacaaactttggcacaatttcagttgcttttccctgatggctataatgaaatgaggaatgtttttcactcggttctaaattcagctccaccgtcacagcaccggctcgatccgcaatattcacaaagcctgctgccggataaacattaccggaagtaccaatcgagataaagtaatcacattcccataaagcatcttcaatacaattcatttgtagtggcatttccccaaaccaaacgatatgtgggcgcaatttttgaggaggctggcagcattggcacaggctctcatccgtaatatcttcttgccagtcatataccgttccctttcttacacaacgtactttaagcagttctccgtgcatatgtacaacacgtttactgcccgcacgttcgtgtaaattatccacattttgtgtgactaataagaaattatcgcctagcttttcttctaattctgctaaagctaaatgtgctgcattaggttgcacatctgcatcaaataaccttgctcggcgtgcattataaaaacgttgtactaattcaggattacgcataaatccttcaggggttgcaacatcatcgactttatgattttcccataatccggtgctagctcggaaagtttcaatctctgattccgctgaaatccctgctcccgttagaactaccactttcggtaaatttttattcattatttactccttcaaatttttaagattaccttgaatagtctcatctattttacgcttatactcaagtcctcgcccagtagtagggtaactcacaaaacatttttctactttttctagttgaataaaggaacattttttaaaatcagcaaataaacttaatgaatttaaaaatgacgtattatctttagcatattcaataaattctcgtgaatacattttttgccatttatttacaatctgtttaaatgttttataacgtttatgattaattaagcaataaacaattccttcttgagtatgaatttcataacgcaaacaatttattttctcttgtaaaaatgtagataaattgaatgctgaatgttcagggcgtttacgttgttctgcggataaatcacgttctccatttgagtaaataaaaactttttcgtcttttgagtgtaatgaccaaatacgattcattaattctaaattttcagctaacttagcttcgatatttttatataatctagcttcagacaataaataatctgtaatagcctgccaatctgcatattcttgaccaagttgcaaaagtgttcctttaaaatagcccgcaccatttgcagtgcgatcatcaattaaatactcgcctacatttaaatttttatgatgacttagaattaaacgtttataaaatacatcgccaaaatatgttttaatccaatttaatttatctgaccaagcggttggattttcccaaggtgctgttgataatacgtaaatatcataatgcgcttttaattgttctacggcttctattgcgccattcattggtttcattagtgaaaaaatgtgtggtacttcatctaatcgacctgcatattgttggcgaacttcatcagataattgttcgatgcctgatttaaaatcaaccaatacattatccatatcaatatataaaatcggtttttgcattctttgctccttttatgcttttcgaagaatacaataactcaaacaacgacaattagtgtcgttactaaaaagaagcggtgaaattttacaaattttctgcaaaatttcaccgcttctttagatgatgaaaactatacttttttcacacttttcacttgtaaattaaagtctttatacattccattagcaaaacgtaatactttctgtgttgcaatctccaccgctttatattccgattctgcttttacacgctccattggactggcatttgtatgtcctttttttccgctaaatgtaactaaatacgtattcattgcttagccctcaatttcatcaaagtagaaagaatctagctcaatttgtttaacaagttttgtttttatcccaattttatattttttcactaattcgataatgtcttcaccatcaattaacgtgatcacttttgaacccgctttcgctgcttctatcgcagctcttgaaaactctgatgttgtgataaaaataccatactctgcattgaatttatctatcacacctcggaactgatcaatttctggcgatccgacttttgaattgttccaacgtttagcttggattgcaactcttgaagttctaagatcattacttctaaaataaccgtagccatcaatgccaccatctcttgatgcaactactcctaatttttcatccatttcaaaacctatttcttcgaggatttttcggcagaatagctcaaatttttgcggttgcatttcagctaagcgatttctcagcactgcttcccagccttcttctagctcttcatcatcatcgcctatttcatcaatatgtttttctggcataatgtgggattcaatatttaatggcgtattaaagttttgaagttcttctacatctctatttttctttctattacctttatttgttgtccaatattcgtgaattctttgttgagcttctttatccattacattgttgagatcacaaatgattccacgttctgttaaggctaattgtcctcgttcagggaaagaaataaaacctgcgatttctaaattctttaaagtaaattgaataataatatctaacggacaataaggcctaccatttttcccaatttttctttcatcaaaggcttcttctggaattgcttctaaattctcacgcaattcagatcttaattttttacgtgaacttttaccgcctaatttacgcagttgatcaataatagcagattctaaaatgcccattttttgccaacgattcatttcttcaaaattcatactctataccttttcagtttgttaaaataaaaacgaaaatactgcaaatcaatcaatcaatcaatcaatcaatcaatcaatcaatcaagcgttgtatttttatactatttttaatagttttattttgcttttcttgccacatagtatttagcatttttagtgcttcaagaatattcatttctaaactcaaaaagtgcatctttggaacgcctgcatccagtttattgattcgaataaaaccagcttttttagctttggctgtgctttcagaaaatcggcgaactgtgggaatcgcttttcctgccccaagctcaataaccaccaaattttttacttgctttaaccaatcacgcagtgcaatttctttcggtgcataatgttgttcgcagaataaataatcatcaaacattaatacgttttggcgagccatttccccacaatggggacaaattggtgttttatttaatactcggcattgctgatcatctgtgattggttgaaaatccgttacccaactttcatcattacagttataaaagcattgcgtacgaaaaattgtgccgtgaatttcatacactcgttcatctgaaaagcccgccttttgaaaagcaccatcaacattgctggtataaacaaaatagccattcggcattttttctgcccacgcttttaaaattgcatatccctcgtgtggtggtgtttggcgatattgattcaaacgatgcccccaaaaccaataagataaatcgggtcgttcaatatatgcttttggcgttgcgatttgcataaaagagagatgaaatttttctaagggcggataagcattccataatccgcctgaactacggaaatcaggtaaccctgaatctgtgctcattccagcacccgccgtaattaagattccatctgctttggctaacaaagaaatcgcataatcaagatcgtttttcatttttactcctgttttatttccattttttataatccagcgacaaattatgtcgcttaacaaaaataaactgttaaaaatcgcaataaacgaacttaaaaaccaattcttctagatacttttccctgtttaaggcgacattcatcttccaatgcatcaatccattcattctcattttcaaaaggagcaaaacggtgacggcgagccacagcagcaaaatcaccttgtgttaacataggaagtcgttcaattttttgctgaacattttctgtaaaattcaattcaaatttagccgcttgaattttagctaatgcaacactttgctgcggtttgaggtaatcaaactgtaattttaaatcgaaacggcgaagtgctgccggatcaagctcatcaagcaaattggttgaaatcaccattaaaccttcaaatttttcaatttgtgtgagcatttcattgacttggctatgctcccaactacgttgtccgctttgtcgagtaaacagaaaactatccacctcatctaaaatcagtaacatattctcatttcttgctcgttcaaaagcagctgcaattttttgctccgttcctcctacatacatatccaataaatcagatccttgtaatacaagcggctgcatttcaagctcttgtgccaaccattttgcccatgcagtcttacctgttcccggtacaccataacagcaaattcgtccgcattttgtttgttttaatcctttactgattttataaatatccgctttacacgaaacgaaatccaaagaatagtctgcttgtaggctttcagtaagcggttcgattttcttaaaaccttgtgcctgcaatgtttgattaaatagcgttctggtctgttcggcaaaggctacttgactattaggttcaaggctggtaacgacttttaatgtccgttctaatattgccggagataagtatggaattttcgcaaaatgctgaatataacgttcagataactgttctccggctaagttacgaattaaatgttctttctgcttataaggtaaatcaggcatttcaaaaataatatcaaaacggcgtaaataggcgttgtccatactattgatatcatttgaaatccaaatcataggtacattattattttctaaaaaatggtttacccacgctttattcgattgtgcaactgaacgttcaaataaaccggctgaaaatacatcttcaatctcatcaaaaatgagcatactgctacgatccgttaacaatttttgtgccaatacacagctattcagacgagtcttcgcatttaacgtttcaccatcgctatctgagaaatgtagcatataggtatcaatttgaagtaacttacctaataaagttgcaaattctgttttacccgttcccggtaagccgtgaagtaaaatatttacaccttttttatgcgtatctaccgcttgtcggagataattcagcataatttgttgcatggattgaatatgttcaaaatcagctaatgtcaaatgtggctctgccgccggaattaagcaacgagctaatagacttttttccgttaacggttcattaagaaattcatcaaaatctaatgtgtctccccattctaaataaccttcaagatcagtattatggcaagattgctcaattaacccataagtttttaatttttgattttttgcaagtgctaatttaaccgctgatttatctagtgaacataatttactgatccagccaatcgcagaagtaatatttaccgaacctaaaaaattaaacccgttttcaatgatctcttcatgctttaagtgaaaaactaatgtaaaaatcgctttttcaacctcattcaactcaatatattgcgttaatttattaatattttgataagcaatttctaactcactcggcacggagaaagggcattttttaatttcttgataacgtttttgcagcagtaatttcacactcgaaatactttcttgattatcccattcattattcaaacctaacgcataagctaatgtatcatcactccaaccatgggaacgaaaaaagtgattaaagccattatgttcacataaaatcttaagcaaaagtttttcagaaaaaagggatacagttggtggatttaaattatattcgctactcataaaacggctccttttgctgatttcacatcagtaataataaataatattacgacaatatatgtcgttttccacttaaaacactcttacaaaatatgtgacacattatgtcgcaatatcaattaccctctcaaataacacacctttaataactgagcagaatcactgaatttttgtaaattttcgatctacatagcaaaactattcaaatatttttccgcatattccactaaggtaatgatgtcaataaaaggagaaagatatgacaaatccaatcgaaatctatcaagccgaagacggctcaatgcaagttgaagttcgctttgaaaatgaaacagtttggctttcacaagctcaaatggcgaagatttttgaaacctcaacagataatatcagtttacatttaaagaatatttttaaggagaaagaactagaagaaattcgaactaccaaggatttctcggtagttcgattggagggtaatcgtaaagttaccagacaagtcaaacactataatcttgatgccattatttctgttggctatcgtgtaaaatccaaatccgccactcaattccgtatttgggcgaccactcgtttaaaagattatttaacgaaaggctatgccattaatcaaaaacgtttgcaacaaaatgcctatgaattggaacaagccttagctttaattcaaaaaacagcaaactcttcggaattgacgattgaaagcgggcgggggttggtcgatattgtcagtcgctatactcatacgtttttatggttgcaacaatatgatgaaggattgctaatcgaacctaaagttcaagtcggaggaaaattaccaaccattgaacaaactaaacaagcattacacgaattaaagcaacaattaatggttcgaggagaagcctccgagttattcgggcttgagagagataacggactttccgctattttaggtaatcttgaacaaaccgtattcggtgaaccggcttatccaagtattgaggcaaaagcagcacatttactctacttcgtcgtcaaaaatcacccgtttgctgatggaaataaacgaagtggtgctttcttatttgtcgattttctccatagaaatcaacgcttatttaatcaaaacaatattccgattattaacgataccgggcttgccgctctaacattattagttgccgaatccaatccaaagcagaaagaaactttaattagattgataatgcatatgttaaaacgctaaagttagacggtaagattcacaagatttattataaatcttaccgcttgatttattctcaactatccccaaattgcctctctttcaatatcccaaatatccgttccaaatttacgaatccaccaagtcagcatttcattgtcgggaacagtggcttggattcggtaaaacgcttcagtttcttctaaaatttgctgatcttttgaaagcggtgtttcagttaaatgaaaacctgccgaatgagaaatagagaaagtcagcttgaccatactaccgtcaccaaaaccgaaattcccctgctcttgatagtgtttaagattaaaatctttcggatattcaaaactgaaagtcgaaactgctgcttttttaatacgatgtaaggcaagatgacgataattttcaaacccctcatattgcacaactaaatacattgcaccaccttgttgaaccaaagcaagcggcatcacttgcgctttatttttcttaccgtgctgattttgatattcaacattcaataatttattttcaaataatgccgaactgactgcttcaaaaatatcaggagaaactttcgcaggaagcaatggctggctggtcggtacgctgctaactttatccaaccatttatattcaagcgtttctttaccaaattgtttttgataacgtgcttcatcaaaaaacggtttgagggatttcattaaattcgccggcaacagattctttaaatgttcctcagccaacattaataataaagattcgtgagcagttaacgtagaaattgccagtcctttcgcttgttctttccaacgataagcatgctgaatatcacgatcatctttttcaatatcaaaatgtgcacataaaatatttaatgttctctgtacggtacgaatatctttatcgaaaccgagttcttctaattgggaatgtaattgctttgcagtaatgtaacgcccttttccctttggaatacgacgtaagatttccaattggaaaagagtattatgaatattttggggacgtttaggcataagttattccttgatttttttatttattatagcaatagcaggcggttaaaattgagcaattttttgcaaaaatccccaaaaaaatgaccgcttgcgctataattctcggtcaattttaaaagagggaaaaataatgtttgaactgaatccaattaaaactcaattagccgatttaactgagcgtaccaacgtacttcgggggtatctttgactttgatgccaaagtcgaacgcttagaagaagtcaatgctgaattagaacagccggaaatctggaatacgccggaaaaagcgcaagcattaggtaaagaacgctctgcattagaaatggtggtcaatacgattcgagcattggatcaaggtgtggaagatgttgaaggcttaatcgaattagccgtagaggcggaagacgaagatacgtttaatgaagcacaagctgaagccaacgaattagaagaaaaattagcgaagcttgaatttcaacgtatgtttagcggtcagcatgatgcggcggattgttatgtcgatttacaagcaggttctggcggtaccgaagcgcaagactggacggaaatgttactgcgaatgtatttacgttgggcggaaagcaaaggctttaaaaccgaattaattgaggtgtcggacggtgatgttgccggtttaaaatcggcaaccgttaaaattaccggcgaatatgcgttcggttggttacgtaccgaaaccggtattcaccgtttagtgcgtaaatcgccatttgattcgaataaccgccgtcatacttcgtttgctgctgccttcgtttatccggaaatcgatgacgatattgatatcgagatcaacccagcggatttacgtattgatgtgtaccgtgcgtccggtgcgggcggtcagcacgttaataaaaccgaatcggcggtacgtattacccatattccatccggtattgtggtgcaatgtcagaacggccgttcgcaacaccaaaacaaagatcaatgtatgaagcagcttaaagcgaaattatacgagatggaaatgatgaagaagaatgcggaaaaacaagcgatggaagaaagtaaatcagatatcggttggggcagccaaattcgttcatacgtattagatgattcacgtattaaagatttacgtaccggtgttgaaaaccgcaatactcaagcggtgcttgacggtgatttagataaatttattgaagccagccttaaagcagggctttaatgacaagcggttgaatttgtaaaaatttctacaaatttgaccgcttgtttgtttttacgaggaatatccatgttcttagaagcccttcaattcagtattagcacgaccttgccgaccattttattaatgtttgccggtatattgttgcgccgcaaaaaatatattgatgaccatttctgcaatatggcatcgaaaagcctgtttaattttgcaattcctaccttgctctttttaaatatgcaaaaaggcgagctgaattatgctgcgaatattccgctgattctgaccgcgattatcggcacgctgacaatctaccttattgccgaatggtgggcagggaaatatattgcagacaagccatttcgtgctgttttcactcaaggaacgtttcgtagcaacattgctatccttggtttggcactcattatgaatgcctatggtaatgcggcaatgacagctgcttcgatttacgttgcggtatctgtaattttattcaatacgttagcggttatcacactaactaaggcatttaatgacggcaaacctaagctctgcaaattatttatttccattttgaaaaatccgttgattattggtttggtacttgggcttatcttcaatgaactcaaattggaattaccgacgccgttactgaaaactgggcaagctattggcggactaacgctgccattggcgcttatttgtaccggcgcaagtattgattttaaacagctacgcaaatttaaaaagggcgaaggtagtacaactaaccgtttagttttgctttctgcgagcattcgcttatttgccgcccctgttttcctatttagtttaggtaaatgggttttcgacttatcaccaatggagctcggtatcgtctttcttagcacctcagcaccgactgccgccgccacttatgcaatgattcgtaattatggcggtgatgctgtttctacggctaatttaattggtattacaacagtcggttcaatgtttacttctagtttgggtttgctgatcttacgccaacttggctgggtgtaacttgtaaaaaaaccataaaaaatgaccgcttgcatatctaacaagcggtcatttttacttaaaaagttgccaataaagaattaatcttcgccccacacttctttagcaatttcttcaacgtgacgtacttttgcccattgctgctcttcggtcatcacattaccttcttcagttgaagcaaagccacattgcggacttaaacaaagttgctcaagcggtacatatttcgctgcttcggcaatacgagctttaatcgcttctttgtcttctaattccgggaattttgagctcactaaacctaacactacacggcctttattgttcgcaaaatgttttaatggttcaaaaccacctgaacgttcatcatcatactctaagaagtaaccgtcataattggtttgaccgaataagccgtcagcgattggatcataagcaccttctaataaataagaagatttatagttaccacgacaaacgtgagtcgtaatagttagatctgccggtttgtccgctaaaatcgcttgaatattcgcaacggcttgtgctttatccgcttcaaaggtcggttgctgataattattgcagagtgagccccaatacacgtcatcaatttgtaaataacggcaacccgcatcatagaatgctttaattgcgtctttataagcctgttgcacatctttagcaaattcttcacgggttgcgtagataccgtgatcccattgtgccggatacattaattgattcggacttggaatcgtgaatttcgctaccgctctgcctgccacaatcgcattgaattttttgaaatgtgcaaggaatggatggtttgggttccaagatacttttccacaacagcgagtgttgtaaggacgcacttctacacctttgaatgcataagctttttcaggtacataaccttcgattccgttcaagttttctaagaaatcgatgtgccaccaagaacgatggaattcaccgtctgttaccacttgaatgcctgcatctaattgtgcttgtactaatttttttacttcttcttcaacaatcgcatcacgtgcttcaagagaaattgtgtcagctttgtaatctgcatgcgcttttttccaagcgtctgttcttaaatatgaacccactgtgtccgcatgaaaaggtaatgttgtatttgccatgttttactccgtatattcttatttgttatcactgagattaatttaagtgaaatttcatttcagaacaagcccagttgatgcttttctcagatgaaagttatcttcactcattatgaataaaattcataatcacttaacgccatattgctcacgatatgccttcattgcagctaaatatggtgtatattgctctgatttctcaataaatgacagtaaatcatcaaaatcgacaatcgaaaaaacttggcaaccgtaatcacgttcaacttcttgaatcgcagaaagttcacctttgcccttttccttacggtttaacgcaatcaatacaccggctaactccgcttggtttgcattaatgatttccatcgactcacgaattgccgtgccagcggtaattacatcatccaccaataaaatacgcccttttaaagatgagccgataagattaccgccctcaccatgatctttcgcttctttacgattaaaacagcaaggcttatccacatcaaattgatttactaacgcaactgcaactgtagtcgcaatcgggatacctttataagccggcccgaaaagtacatcaaaatttagaccgcttgcttggatcgcttgcgcataaaactcgccgagtttggcaagatctctgccggtattgaataaacctgcattaaaaaagtaagggctttttctgccggatttcaaggtaaattcaccgaattttaaaacattacggcttaatgcaaattcaataaaatcgtgtttatattgttccatgtttatcctctataagcggttatttttactaaaaaaattgcaaaaaaatcccctaacctaataaaaggctaggggaaaagattattcaggagtaatccattcaacagaccaactacccgtaccctccggcacaagcacttccgttaaataaggtagaatttttttcatctgactttctaattgccacggcggattaatcactatcataccgcttgccgtcatacctcgttgatccgaatccggacgcaccgccaattcaatttgtaaaattttgcggataccggtatcagctaaaccacgcacaatacgtttagtatgctgacgtaacaccaccggataccaaatcgcataaatccccgtagcaaaacgtttatagccttcctcaattgctttcaccaccaactcataatcttcttttaattcatacggcggatcgattaagacaaatccacgacgttctttcggcggtaatgcggattttaattgctgaaaaccgttttcacgcttagtcaccacattcgctttcttggcaaattcttgacgtaataatggaaaatcattcggatgtagctcggttaaaattgcacgatcttgtgggcgtaactgattaaccgccaacaaaggagaacctgcgtaataacgtaacttatcgcctttattaatttttttcagttcgttaatgtatagcgttacttcttccggtaaatctgtacgttcccataaacgggctacaccttctaagtactctccggttttctccgactctgcactcaataaactataacgcccaacaccggaatgagtatcaagataaagaaagcctttatctttctgttttaatgattgtaaaatcaaaagttgaacaatatgtttcacaacatcggcgtggttacccgcgtggaagctatggcgataactaagcataattctctcttttttcaataagttaattcgttaattttaacacggaatagcatagaaaacacagaaatgtaacacaatttgagattacgttgcgtaatgttttatgtgaaaacaatattttcatgaacgattgttcagtaattttttcatgcttccacttcatcacgcttaacaccagaataaacataaggcagaatatgaatcttactattcaaaacggaaaattaattcaccaacgacaagttccatccacacattttaatcaacgacctcaagaaaatgatatttcattattagttattcattatattagcctccccccagaagaatttggtggaaattttatcgaccaattttttcaaggaaatctagatccgaccattcatccttattttgaagaaataaaagatttacgtgtttctgcgcattgtttaattaatcgcaagggagaaattacccaatatgtgaattttaatgatatggcatggcatgctggattatccgaatttaacgggcgagataaatgcaatgaatattcgataggtatcgaattagaagggagtaacaaccagccttttacagaacagcagtatcaatcactcgcagcgctaaccaaggaaattatggcggcgtatccggctattacacctgagcgtattgtcggccataatgacgtttctcccggtagaaaaatcgaccctggtcaatatttcaattgggaatattatataacattaataactaaataaaatttataatatatttttaatataaagttgaaatattttaataattatttattaataacaaaattcaaaataaaaaaagggctaggtgattagcctagccaataagataatataatgaataaaattttcttagttatttaacgactgtcccctctgcaattatgtggtattgccgaagttacgaaatatattctattctaaataaaataaattacaagctatttttaaatgaaagataaattatttttcatctttcgtttcaaaacttattttttaaacaaaatgtataattgaactatgttcagtttaagaatcttttcttacactcctatattaaaaaataaaaacatacactaatttaatattcagcattaaaagcaaaaaaaagctagttccgaagaactagccaatattaggaatgaataaaattttctaagccatctgatgacagcctgtttcatgacaagggctaacttgcctaaaacagttacataataacgttaatttacactaaagtaaagttatttaaacaaaaatttacttaaaaatcagctaacgcactaaaggtcatcacttcaccgctaatcgggtgcgtaatagttaagctttctgcgtgtaaacacaatctaggtgctaaacttttagctaatggattagcataaaatttatcaccgagaatcggatgtcctaacgcaagcgaatgcactcttagctgatgtgaacgaccggtaatcggggtaagcttcactcgagtggtattattcggtaaatgtgccaatacttcataatgcgtaatcgcctttttacctcgttcatagcaaattttctgacgaggacgattttcccagtcacaaatcagtggaaaattcatttcaccggtatcaccgaccttttcgcctaatttgccccaaagcaaagcgatataatgctttttcggttccctgtcacgaaactgacgcttcaactctttttccgccgctttgctgagtgcaaataacagaatgccgctggttgccatatccaaacggtgtgccggttcggtaaaaccgtatttctgctgcacacgtgtcattgcactgtcataatactcagggcgattgcccggtactgaaagcaacccactcggtttattaatcactaaaatatgattatcacgataaacttccgttaaaaacggttcaagtgggggatgatattcaattaatgccatttttcttaccataaaaaacacggaatggacgaatacaagaaacaagcggtgaattttgaacttttttctgcaaattcacgcttatcgtatttccgtctattccgtgataaatactctattctttattacttacaatgacacgtaagctatctaaacgccaattcgctaatgcaatttgattcagcgattcgacacgttgtttttccaatgcttcaatttcatcggcacggatgtttttattcaccgcttgtaacgaggttaaacgatgtaattccgcacttaagatactatccgcttcttggctggctttttcaatcaattccggtaatttgactgcgattttttgctcactgatactaattaatttcttaatatccgcttgcgccatcttcgcaattttatttgccatttgtttattcaccggttttaactgcttctcaagccctgcaaacgacacctgagccgccatatcgttacctttgttatctaataggatacgtaccggtgtcggcggaaggaaacgcgttaaatttaagcctttcggcgcttgtgtttccaccatataaatcgcttcaagcaataaggtacctgccggtaagtttttattaatcagtaacgaaattgccgatttaccgatatcgccggaagtaatcaaatcaataccgttacgaatcattgggtgatcccaagttaaaaactcaacgtcttctcgcatgagtgcaagctggcgatcaaaggtgactgtcgtaccgtcttccgcaatccccgggaagtccggtaccaacatatggccggtcgggctaatcacgatagattgctcgcctaaatcttcctgctctaagccgataacatcaaataaactcaaagcaaaattgactaagtgcggattattatcttctttcgcaatcgcctcagctaactcttgtgccacttcaccgccatttgaatttagctcaagtaaacgatctcgaccttgctctaattccgctttcagctgttgttggcgtttaaaggtttttgcaagaaattcgtcaaatccgaccgcttgcggattcttcaggaagatttccaactcttcgccgaattcacggaataatgcggcgcccatcgggcaagtttcttcaaacgcatttagaccttgatgataccaagtcgccaataccatttgcattgaattttcaaagcacggtacgtgaatctgaatatcatttttctgaccgatacggtctaaacgtccgatactttgttccaataagtccggattatccggtaaattgaacaacactaaattgctggcaaattggaagttacgcccttccgagccgatgcttgaactaatcaagacctgagcgccttcttccatttgtgcgaaataagcggaagctctgtctcgttctacaatcgacattttttcgtggaacaccgccgaacgaatcgcttcacgttcacgtaagatttgttccaatgcaattgcagtatcggcttgcttacaaataactaagattttctcgtcacggtggtttttcaggaaggtaatcaaccattcgatacgagggtcaaaatccgcccattttgccgctggattcatccgttggaataaacgttccggataaagctgatcatctttggttacgccgcccatcattcccatcacttttaacgcattggtatattgactcggcatttccaaggtaatttgatgataaacacgatgtgggaaacctttcacaccttggcgagtattacggaataacactcggctggtaccatggcggtcaatcagctcacgaatcaattcttgacgcacttgcaagcggtcattttcttttgatttttcgctattgatcactttaaacatcggttcagtatcttgctcactgagtaattccgcaatgctattttgttcttcattgctcaacggtttgtcattcagtaagcttgctaccgcatccgccaccggcttgtaatctttttgctcagcaacaaagctgttgtaatcgtagaaacgatccgcatccaataatgctaaacgtgcaaaatggctttcttgccctaattgctcaggcgttgcagtgagaagcaatactgccggagtttgttttgataaacgctcaacaaattgataaccgacgctcggctcgttttccgaccattctaagtggtgcgcttcatccacgatgagcatatcccaattgcttgccaatacttgttttgcacgattaggagaggtttctaaccagtcgattgaagcaatcactaacgcttcgctatcaaacgggttttcgctgacatcattaccgtcttcatccgctttatcaaaatcgctacaacgctcttcatcaaataatgagaatttcaagttgaaacgacgtaacatttcaaccaaccactgatgttgcaagctttccggcacaagcactaatacacgttctactctaccggagaaaagttgttgctgtaaaatcatccccgcttcaatcgttttacctaaaccgacttcatccgctaataacacacgaggcgcaacacgctgtccgacttctttagcaatatgtaattggtgcggaattaagctcgcacgaatgcctcgcattccacgtaacggcgattgaaattgagcttgttggtgctgtaatgctcgataacgtaaagcaaaacggtcagaacggtcaatttgtgctgaaaataaacgatcttgcggcttgctgaagcttactttatggtctaactgcatttcaggcaataccgcttcttcaccggaatcagctcgcttacctaaatagataataaaaccttggttttcgacaacctcttcaacatctaactgccacccctctacactattgattcgatcacctttttgaaattgcacacgagttaaaggtgcaaccgaaagcgcataaatacgctcttcctctgccgccgggaattgaatggtaacagtacgattatcacttgctgttacgatacctaagcctaaattattttctgattcgctaatccagcgctgacctactacgaacattttggggttatatctcctatctataaattcctatttattctaccaaatttagcgactcaaagcggtctgatttataaagaattttgcaaattttgggcataaaaaaaccgcttgcaactagcaaacggtttctttaaaaacataccggattagtttttatctaagtctaaatccgctttatattcaatacgattacgattttttacttcaatttgaatatctaactcttgatcaccacgttcaaatttaagatccgcatcatctctttcaatttcagcctctgttactcggaaaccatgacgttttgcgtgtgaaattgcatttttagcaatcacacgcacatcgttaccacgtaagcgatattccacttcatattcaccattaccttggcgatccgctttcactaatttaccgttcgggcgataaatctcacgaggaatatctacggcaaatgcacttgcagcggtaaataaacctaatgtggttgctaataaagttgctttcgataacattttcataattgtccttccgtaataaaaataaaaaatggtaatactccattttagcttcacatgagacgaacaaataaccgcttagttcttcaaacttttataaactttggtaaagtttaaatgcttgcccatccgacatgctggctagataatcgcaaatcacccgagggcgttttgccacttcagcctgttgccagcgtaaagcaacattttgtggcaataaacgctccggatcagtacttaacatatcaaacaacgccattaaaatacgctgacctttgtattccactctttgtgttttcacatcacaaatcacatattggtaaacaaagcgttttaaaatttccagcacacatttcatatcatccggtaaatacgcattaaaacgtaataacggctcatcaaaacccgcctgctctcgccattttacgttagtcacaaaataattaaccaacgccccgatcacatctttacgttcataacgatgttgtgaaaataatttctggctaagggtcggtaaaatcgtttgaatccaactagaagaacattgtgctaattgttgctctgcctgttgccatgattgtggcgtgaccataccaccggcaatcgcatcttccaaatcgtgtacaccgtaggcaatatcatcggcaagttccataatgctgcaatccaacgatttatattgcgttttatgcggttcaagcggatctttactgaaacttatcgtacgtagtaacttacgatcttgctcgcttaacggtgctaacacccaatcgaaaaaggtttgatcatcgctaaatatgcccttacaggttttaaattggtgcaggttgatataaggcgactcagcaaattgcgggcgtgcttgcggttcggtttcttcaagcagtgccggatatttaataattcccaacaaggttctgcgcgtgagattcattccgtgttgcggtgtataaggttcaagctgggtaacgatccgaaatgactgagcattaccttcgaaaccgccatgtgcacgcattttataattgagtgccatttcgccgccgtgcccaaatggtggatgtccaatatcatgcgcaaaacaaagcgattcaatcaaactgcgagacggcaataaagcggtcaaattttcagctaaaattgcaaatttttgatcggaaacaaccgcttgaaaggcttgtttctctcgcaataatttcgcacggatactactgccgatctgcgccacttcaagtgaatgggtcaagcgagtacgataaaaatcatcttcaccaactgcgtgaatctgcgttttagcttgcaagcaacgaaaggcttcggaatgcaaaattctcgcgcgatctcgctgaaacggtgaacggtggtcttgttctcgttttttatccgccaaaaaacgttcggtccaaacattcgaaatcatctttccccctttttcatatataataactgactttacgaatttgattttacactaaaaatggcactgttctactctgaaaaagctgcaaaacagcaagcaaaaaaatcggcaaaaacgaccgcttgtccgccgattaccattcaatctttggactaccaaggcttaggcgtggcgaaaattgccggaaaaacgtggtttatcgaaaacgccttacctaacgaacaagttgaaatccaagtattggaagaaaaacgccaatacggacgagcaaaagcggttaaaattttaaaaccatccaccgaacgccaacagccgagttgtgctctctacggcaaatgcggcggctgtcaaatgcagcatattccgctagatttacagcgagaagccaaacagcgtgcgctttttcaacgcttacaaaaactgcaatcacagccgattgattttcaaccgatgatcgtcggtaacgataagggctatcgccgccgcgcaaaactgagtattgcgttacaaaataatcagttagcgattggttttagaatgcaaaattcaaaccaaatcataccgcttgagcagtgtgaagtgttggccgagccgctttctcagcttatcaaaccactgcaaagcctatttagcacgtggcagaacaaaaaaacacttgggcatatagaactggttcaagcggataataccattgcgatgctggtgcgtaacgtcgggcaattccatccgcaagatagtcaaaatttgcaacagtttgctgaacaatattcactttcattgtttgtgatgaccgctgaaaatgatatcgttcaattaagtggtgaagcgccctactaccaaattcatggtgtaaaactgggcttttcgattcgtgatttcattcaagtgaatggtaacttaaatgaaaaaatggtggataaagcattggaatggctcaatctttccgcacaagaccgagtattggatttattctgcggtatgggcaattttaccttacccatcgctcaacaagccggttttgtcgtcggtgtggaaggcgttcagccgatggttgaacaggccaagcagaatcaagctgcaagcggtctaaaaaacgtagaattttaccaaaccaacctagacgaaccttttgcagataaagcgtgggcaagtgagccgtttaacaaagttttattagatccggcgcgtaacggcgcatttttctgcttggatcacttagccgcattgaatcccgaaacgatcgtttatgtttcctgtaaccccgccacattagtgcgagatgcagaaaaactgattcaaaccggttataaactgcaaaaagcggcaatgatcgatatgttcccacatacaggacatttggaatctatttcgttatttactaaataatgaacacatcatcacagcataaaccgaaattaggttgatttatacttaggatattctgtgatgataatcttgaagaaataggaattgttttgacaagatatagaaaaaaagaaaccccgtagaaaacctacggggcaaattcttttgttctaattctggaggtatgaatcactgttttataaaaggagacaaataaaacaagaacaaaagcaaaactaaaggaaattagttggctcctcctgcgggactcgaacctgcgacatatggattaacagtccaccgttctaccgactgaactaaggaggaacatttcggaaaaaaataatatcgctaaaccgttttagcgtcaaaccatataacctaacttgtcaattctttgcaattcttgaattttagcgacctattcacaacaaatttcacaatttttaagtttcggtagcttcatttctcttaccgaaaaatgtaaaccgtcaatcatcaataatcttccggctaaacttttacctacgttcagcaataatttaatcgcttccaatgcctgtaagctcccaaccacaccaacgatcggcgcaatcacaccagcttccacgcaacttaaagtgccgtcaccaaataattgacttaaacaactgtaacaaggctcatctttcgcataagtaaatactgaaatttgaccttcaaagcgaatcgctgagccggaaacaagcggtcgtttttgcgcaaaacattgcaaatttaactgattacgtaccgtcacgttatcggtgcaatccaacactaaatccactcgctcaatcaactcggcaaattcggcatcgctacattgtttattaatcgcctcaagctgaatatgcggattgatttggtttaaacgcacttttgccgactctactttcggctgaccgatattggcatccgtatgcaaaatttggcgctgtaaattggataatgatacttcatcaaaatccaccaaaatcaaatgcccgacaccagctgaagctagatattgcgcagcactacaacccaagccgcccagcccgacaatcaatacacggctggcttttagcttttcttgtccatcaaaatcaacactttttaaaataatttgacggttatagcgcaacatttcctgatcgctaagttccatattcactcactatctcaataaactgttaaacggctgaatcgtcactttttcaccggcattcacatcgcctcgttccgcttccaacacaataaaacaattgctttcataaaaagcactgaaaatatgcgagccttgcgaaccgaccggacgtacagctacttcaccttgttgattaacataatagaagccacgttggaaatcttggcgacctaccgcttttttcaaattcgtatctgcaatagcggttaaattttgggtaagatttgcgatacgttccgcattcacaccggccagtttagctaacgccggttgcaccagttggtaaaaggtgactaaagcggaaaccggattacccggtaaaccgaagaaccaagcgtgttgcaatttaccgaaagcgaatggcttgcccggtttcattgcaattttccaaaagccgatttcgcccagtttttctaacacatctttggtgaaatccgcttcgccgaccgacacaccgccactggtaattaatacgtccgcttgctgctgcgcttgattaaacgtttgttcgaacactaccggatcgtccggtagaataccaaaatctaaaatctcacaattgagtttttctaacattaaacgcactgcaaaacggttggtatcataaattttgccttgttctagcggctgaccgaccgaagttagttcatcaccggtggaaagaatcgcgacttttaaacggctaaataccggcacttgcgcaatgcctaacgaagctaataatggcaaagtggtcacatttaataaactgccttttgccaacaccaatgcgccttgttttacatcttcaccaattcggcgaatattttgcccaagcttcggcgttttgcaaaatttcactaaaatttgaccgcttgtaagtgtctctacttccgtttcttcttgcatcacaactacatcacaatctgctggcagcatcgcaccggtcataatacgaatacattctccggctttcacttcgccggtaaacggattgccggcaaaagatttaccggcaacggttaaacgttcaaattgagcgagatccgctaaacgaaacgcgtagccgtccattgccgaattatcgaaactggggacattaatcggggaaaaaatatcttctgctaaaatacgattcgcacactctgccagtgttaatgtttctgtttttgatgctgtcggtaagcggtttagcatttcttgtaatgcttccgacaaagtacgtaatgccataaaatcctcggttatttaactcacttgaataaagaaatctcgcacaccgactaataaattattaatcgccactgacgctaaaattaagcccatgacacggctaatgatcgccgctcccgcattaccaataaagtgttgaatgcgatttgccgccagtaaaaataagtaggtaatcgccaatacagacagcataatacctgccgtaaccacttgatcggtaatactaaaacggtggttatcggtaagtaatacaattgccatcatcgctcccggtgaagcaatagatggcacggctaaagggtaaaccgccagctcactaatactggcttttattttcatctcttgttccggtttactctcaccaaaaatcattgttaacgcaaacagtaataatactaagccgccggcagcttggaatgccgatagcggaatctgcattgcttccagcaacatctgcccgccaactaagaaaaacattaaaataccagcagaaatcaccactgcattacgtgcaattttacggcgatcttcgattggcaaaccgatcgttttcgccaaatacactggaattgaaccgatagggtcaattaccgcccacaatacaacaaattgtactgctaatgaatcaaacatagcttcctctatttatgttagaataacggcaaaattttaacataaaccaagcatttataatgatttttttcaccgaccttatcttaaaacgcggacaatccgtccttttagaaaacacctccgtcaccattcataccggtcaaaaagttggactggtcggtaaaaacggttgtggtaaatcttcacttttcgctttagtgaaaggcgaattacaaccggaaggcggcgatgtttctctgccgaaaaactgggcgatttcttgggtaaatcaagaaacaccggcattggaaatttccgcattggattatgtgatccaaggcgatcgcgaatataccggtttaatgagccaattagaaaaagccaatcaagaaaataacggcaatcaaattgctctcattcacactcaactggatacaattgacgcatggacaattcaagcccgtgcagcaaccttgttaaacggtttaggcttcactaacgaacaactttccttaccggtgaaatcgttctcaggtggctggcgtatgcgtttaaatttggcacaagcgttgatctgccgttctgatttgctgctacttgatgaaccgactaaccacttggatttagatgcggtgatctggctggaaaaatggctgactaactaccgtggtacgctattgctcatttcccatgaccgagattttctcgatccgataattgatcgcgtgattcatatcgaaaatcagcagctgaatgattacaccggtaactacacctcgtttgaaattcagcgtgctaccaaaatctcgcaacaaaatgctgcttatgcacaacaacagcgaaaagttgctcatttacagagttttatcgaccgctttaaggcgaaggcaaccaaagcgaaacaggcacaaagccgtatcaaagcgttggaaaaaatggaactgattgcaccggcttatgcggacagtccgttcgaatttgaattccgtccgccgctcgctttgccaagcccgttattaatgatggaaaaagccagtgccggttatgctgataaaaccattttagaatcggttaaactgaatttagtgcccggctcacgtatcggtttgctcggccgcaacggtgcgggtaaatccacgctgattaaattactcgccggcgaattagccccgcaaaccggacatattcaattagccaaaggtgtacaattaggttatttcgctcaacatcaagtggatacattacgctttgatgaaagcccgttatggcatttacagaaaattgctccggaattaaccgaacaagaagtacgtaattatttaggcggctttgattttaaaggcgacaaagtgaaacaaaacgtcggctcgttttccggcggggaaaaagctcgtttggtgttagcgctaatcgtatggcaacgcccaaatttactgttgttggacgaaccgaccaaccatttagatctggaaatgcgtcaagcgctaaccgatgcgctcacttattatgagggctcgctggtagtggtatcgcacgatcgtcatttattgcgtagtaccgtgaatgaattttatctggtgcacgataaaaaagtggaagaatttaaaggcgatctggatgattaccaaaaatggctaaacgaacaaaatgcgcttgaagcggcaaaaaattcaggaaattcgaccgcttgtacggaagaaaaagcggataatagcgcggcaaatcgtaaggaacaaaagcgtttagaggcggaattacgccaacaaaccgcaccgttacgcaaaaagatcacccagctagagaaagatcttgaacaagcgagtgaaaagctaaatcagctcgaagcactactggcttcaagcgagatctatgaagcggaaaataaagtgcaacttaccgaaacactcgcgaagcaaattgaagcgaaaaaagccgttgaagaaattgaaatggaatggctggactgccaagaacagcttgaggcattgcttagctagttctgcttccttggcgcatttctgagatcctagcacggcaaagccttactagcttaagcagaatacagccctgctagggctgtaaattccaaataacaagcggtaagaattgcaactttttttgcaaatcctaccgcttgttttcttttccgagttctctatatatgccgtgctaattaaaatataagccgcggaatatctataccttctcactcactttttcttctgctttcgtaaaaatcgtgtttttaaccgaagttaataattgttggcgaatggcagaaagtttcggtttttcacccgcttggaacgcaaccggacggcaaaattccatcgctttaatgcctaatcttgcagtgagcaaacctacaccaatgccctgtgcggcacgcagtgaaagtttagcggttaaattttgcgagaagaattccataccgacatcgctcaccacttcggttgcaccagcaaacaccatattggttaagaccattttgaataatttcaaacggctgaaataccctaattgcataccgtaggttttgctgattttattcaccaatgcaatatttcgccacgctaccatcaacacatccaccacagctaacgggctaaccgccacaatcaccgcattttcagtcgcactttttgaaatcatttttttcacttgcttatcaagcggtgtgagcactgtttcactaaataagtacagcacctcttttgcattataagcctcatttaattggctttgccaacgttgttgcgaatgttgcacacttggcactttttttaaattcgccacaacctcattgcaaaaatttaccgctttttcaccgcttgtcgttgcaagttcttctaaaagtaattgctcgcttacttgctgttgttgctgatgatgacgtaaaaaaactaatttacgccattcaccgataatcgcaaccacgccggttaaactgattaaagcgaacacaattgcaaacgcaaaataaatccattggcgagcttggaaagtatcaatcagccattgcacactttgtgcaatcacggcaacgctgaacagtcccaacgcaaacagcactactcttacccaaaaacgcgacggcttcaggctttcttcaacaattaattccgcctcaacttcttgatattcctcttcaatttgaatatcgtccgaagcctcaaattcttgcttggccacaaattgctgttctgttgtgacctcttgctcactaaatatttgtttcttcatcgttttctcttttcaattaaccacggaatacactgaattcacggaaataaagttttcaataataactacataattatccgtttaatttctactttaggaaatgcaccaaaattaacaagtaaacctaacttcatacctgttatttttaaatagttcattaattgagctttatgctcttctttcaacaaattaactgcttttaattcaataataatttgatcaaaacaaataaaatctggtttataactctgctttaatagctgatctttatacattaatgcaagattgggttgtgttataaaaggaatatttctagctctaaattcaagctctaaacattcttgataaacagattctaaaaaaccattacccatttgaaaatacacatcaaatattgcactgcgtaaagcatacgtttcttgttcaaataataagctcatatattctctctttaaaaaatcaatattacttattattacttctgtgttttccgtggttaaaaccctattgttaaatcccttgatttaccgctcgttcaatatgtgcttttagaccgtcatagccgtgctccgttttgagtatttggaacaaatctttggcttccggatattctttatccaaataatgtagccattgcttaattctcgccacatgataaaagcccgagtcacgctcattttccatatttacatattgaaacagtaattgcagcacctcgtgccatggcattttaggctgattaaatttcaccactcggctaaggttcggcgtgtttaatgcacctcgcccgatcattaaactcgaacaagcggtcatattttggcaattttttgcagattcaaaatcccagatttcgccattggcaatcacaggaatcgaaagacgtttttgaatttcgccgattgcctgccaattaatgcgttcagctcgatagccgtcttgtttggtacgaccgtgtacggttatttcattcgctccaccttgtgccaccgcatcggcaatctcaaaacattgatctgccgaatcccaacctaaacgcactttcaccgaaacgatctgctcctgtggaactgcttctcgcattgctttggttgctcgataaatcaaatccggatcttttagcaatgatgcgccaccattactgccgtttaccgttttagacggacaaccgcaattcaaatccactccatgcgagcccaattcaatcgccaactgggcattttctgccaaccattgcggatgttgtcctaataactgcactcgcacaggcgtacctgaatcggttaaaccgccctgcaacaattcaggcgcaagacgataaaatgctttcttcggcaatttttgatccaccactcgcacaaattctgaaatacatagatcgtaatcatttactgccgtcagtaatttgcgaacaaaaggatctaatacgccttgcatcggcgctaaaataactttaggtatcgtattcatcattcaatttttttgcttattcgattcaaaaagaaagcggtcaatttttgcaaaatttttaccaaaaatgaccgcttgaaatggttaatgctattcgtaaaaatgggagcgaatccgcaagtccggacgggcaatcagataaataataagcgcagtaattgcccccaaagtatccgccaacatatctttttgtgcatcccaaatatcgccttgcgagcctaaaaattcaatacctgcattaccaccttctatcactgcatattgccattcgataatttcataacttgcggctactgccataataaaaaatagcgaaaagaaggttgcaacacctaatccacatttacggcggcgtaataaccattctgccatcgggaaactataaaaaccgataatgtaatgtgccactctatcaaaatggttacgatcttcgcctaaaatagggctaagaaactgattcgcccactcaaaaggcacattggcaaaggtatatttggcaccgattaaatgcataatcatccataaggacattaagatataagccaaaccgctaaattgaaatttagggtatgtaaaaatcaatagcccaaataccacaaaaattggcatcacttccgcataccagacagcccgatctgacggagtgatccccgaccatatcgcaattgcggtaatcataatcgctaaaaacagcggaataatatgtgagcgctgttccattatttccatccttttactttacagattaaatcgtaagccgcttgaatttgctgtgctttctctttcgctaattccatcatctcatccggtaaaccttttgccgccagcttatccggatgatgttcgttcatcaatttacggtaggcacgttttacggcggtttggtcgtcatttgcggtcacgcctaaaactttataagcggcatcaatgctcggtgcattactattagcttgatgataaccattatatctgccttgcgattgctgataagcgccaccttgctgatattgctcttgataaaagccaccgtttctaaattgctgtgcagccataaccatcgcaatcatacgttcaaattggaaacggctcatccccatagtttcggcaatcgtaaataaaatttgctgttcattcgcatctaattgcccatcgtgtaaagcggcctgcatctggacttccacaaaaaagcgcaataaatcggcacgctgaccacaagcttctctgaattcctgaatcacctgacgtaacggaaaatcagcctctttacctaacgtaaatgcttgttgtgcaagttgttgggcattagcatctaatttcagacggctcattaactgacgcgccaaatgaatgtcatcttccgttacacgtccctttgctttcgcaatatgtcctaataccgcaaatgtcgtctgagtgaaaagcgattgacgcgtaagatttttaccaaaaacacttgaacgaactgaacctaattcatacaactttttatccgcaagatgaccgataaaagcccctaatagccccccaaaaaagctatgaaagatttggtaacctaagaagaatccaataatttttccgataaattgcatttgttgtccttgtttaattcccagacgaatatcgttaaacgattattttagcttaaaatacttaaaatagaattaattatctttaaagtaagataatcattatgggggtaaaatctgaaaaacaaagaggaaggcgttaaataagatacaaaaaatgattttacttttgtaaaaaggaaaggaaatttaaccgcttatggtgttataacgaaataaagccctgaaaaatcagggctttatttttgtctttagtaattaggctacaaattagtattctaatactgcacgacggtttttagcgtagtcagcttcagtgtgacctaacacagctggtttttcttcaccgtaagaaacagttgaaacttggttagcacctttagttgctaagtagtttttaactgcgtctgcacgacgttgacctaacgcgatgttgtactctggagtaccacgttcgtcagcgtgaccagcaactgttactttaccgtttgctgatgttaagtatgcagcgtgtgcatctaaaagttgttggtactcaccttcaactgcatagctgtcgaaaccgaagtatacagtgttgtaacgagtttgtaagtcttcagcagtcataccgccgaattgacctgcgtttgcgttagcatttgcgttagcgttgtctgatgagctgctgcaagctgctaatacgaatgctggtgccgcaatcatcaatactttagctagttttttcatttgttgctcctaaaaagaattttattatttagtcaaatacggtgaccaagcaggaaacttaaattgtccacctgctcccggcaagttagctttgaaacggccatctgcggacaccaattgtagcactttgctcgtacctttggtagagctataaataaccataataccatttggcgaaatgcttggactctcgtctaagaaagttgaactcaatacttccgtgccacccgaagcgagatcgcgtttcacaaccttatcaccagcaatcatgattaaattcttaccatcagatgaaactttagcattatagctaccgcttccccccattgggcttgcgccaccacctgatgaactcattctatacacttgtggagaacctgctcggtctgaagtgaagtaaatcgtacttccatccggagaccaacttggttctgtattattacctgcatttgcagttaattttgatggtttaccaccatttgcaccaacaacataaatatctaactcaccatcttgattcgatgcgaatgcaatacgagaaccatccggcgagaacgctggtgcaccgttgtgtccacgtaatgccgctacgatacggcgagaacctgaacgtaggtcatgcacaacaacttgtgcttttttgttttcaaatgtcacataagctaaacgactaccgtctggagaccattcgggtgacattaacggctctctactttttacaacggtaaaggcattataaccgtcatagtctgaaacacgtaattcataagatgatacgccacgttgcacgacataagcaatttttgttctgaaagcaccgcgaatttgcgtaattttttcaaacacttggtcacttaccgtatgcgcaccttggcgaatttgtgctgcaggtacattaaatgaaccctgagctaatactgccgcaggattacttaacgtatcaactaactgataagcaacattatagccactacctgttggggtcacttgtcctacaactacagaatctacaccgatatcggtccattgttgtgaatctacttctgctaccgagcctggctgagccggtaatctagaacgttctaccggcgtaaacttaccactattacgtaagtcgtctgcaataatttgtccgacatccgccggtacagcaccatttgccttaaacggaacaaccgcaataggttgtgccatacttacaccttcatcaacagaaatcacaacatctgattcagctgttactacattgctgaaaaagagagcgatgacgctgataacactcgttaaacgagattttaatttcattgttaacctcttggttgttataaaactcttaaaccaaatttaataattggagatttatatttcttataagtctcttcatttggtgctctcggaacatttcttgccgaggtaattgccgctactgccgctcgacaaatatcatccgggccggataatacttgatggcttgtaatattacctgctggatcaatcgaaattttcacttggcattcacgcccgctaaaacttggatctactcggtaagtacgagctaattttttcttaattagctgagcataaccggtatccgctacacctcttccgtcaccaatacctttcgaattgccattaccttgtgagcccgcagtatttttattaccgcctttgctcgaaccgccaccaatatctccaccacttaagaaatcatcaagggctttattattcttggcttgagcagccttggctgccgcatctgctttggcttttgcttccacagcggctttcgctttagcctctttatcagctttagccttagcttctttttccgcttttaacttagcttctttttcggctttttctttcgcttctttctctgctttagctttggcttctttttcagcttttagtttcgcttctttttcagctttttctttcgcttctttctcagcctttaattttgcttctttttcagcctgtttctgctcttcaagttttttcagctgttccgcttttttctgtgcttcttttgccttcttctcttcctcagctgctttcgctgctgcttctaagtttctagcttccgcttcagcttttaaacgagctgcctctgctgcttttttgcgtgttgcctcttcagcttgctcttttttaagctgctcttgttttgcaatttcttgctgacgttgctgctcagctttttggcgttgctcttcttgttttttctgttcttcaatcattgcaacgcgttgctgttctttggcttgttcttcagcaacctcttgaggtgtcggttcttcctctactacttcttcaggctttggtttttcttgctccgccaccttcggctgtgcattgccttttttgtctgattttaaacgcccgtactcggcagcgacctgcccagtatcaaccattaccgcctcaaactcttcacccgtaccaccgctaccgccagctgcttcttccagcgtggtcttggtaaaaaatgaaccgagtagaagcaatccaatcaacaatgcatgtaataggactgaaactataaccgccagttctagtctgtcgtctttagatttcacacgttatccttattactatttgccttgggtcattaacccagcatttttaatacctgcatcttttaaaagaacaatccctttaataacttcttcgtaaggaatatttttttctgctgcaacaaggaaaagcgtattcggatctttttggaatgcttctcccgcatacgcaacaacttcttgctcgcctagttcttctagcccattgctcccttgtacaaagtttccgtcaatttttaatttatataaaccaacatccgcaacttgtaaaatgaccggagttttatcttcattagataccgactgactatgtttatcttctggtaaattaacctcaacgctttgactgattaccggtgcggttgccatgaagataagtaatagtacaagcaatacgtccaaaaatggtacgatattgatttcagatttaatgtcattacgtttacgacggtaagacatattttcctcttatacattagtgaataaaagatccgaccgagattaagcggtcagatcccgtgagttttttactacgctcttattttttagaaaacgcttggcgatgtaaaatggttgtaaattcatcaataaagttagcgtaatcttgttctaatttatttacacgtaaacttaaacgattgtatgccattaccgccggaattgctgcaaataagccaatagctgttgcaataagtgcttctgcgatacccggagcaactgattgtaaggttgcttgtttcactgcacttaagcccataaatgagtgcataatcccccataccgtaccaaataaaccgatataaggactaattgaacctaccgtgcctaaaaatggaatgtaactttctagattctcaatttcacggtttagcgctaaattcattgcacggctagagcctttcatagtagcttctggcgcatccgcatttacttgctgtaaacgcatatactctttaaaaccagcatagaaaatttgctctgaaccgcttaaaccgtcacgacgattttctaaaccttcatgtaagcggtgtaaatcttcacctgaccagaatttattttcaaacgctaacgcatctttctttgctgccgttaaaacgcgactacgttgaataatgacagcccaagataaaattgaaaatgtaattaagattaaaataacaatcttaaccacaatacttgcctgcataaacagcgaaacaaggttaaaatcagtttccatttaagagaactccgaataagtaatttgtttaaaaattagaccgcttgtagtgcctgacgtatatcatcaggaatcgccacaggcttcattttggttaaatcaacacttgcaacggtgacttttgcttcacttaaacaaatatcatcacgccataactgttgctgaaatacaatcgttgctttttttaactcagtcacgactgtttcgactctgagtaaatcatctaaacgagcaggaattttataatcaatttctaatttttttacgacaaaagcaaatgagccggccaataatttttgctgagagaaacctacttgacgtaaatactccgtacgtgcacgctcaaaaaaacagatgtaatttgcatggtaaaccacgcctccggcatccgtatcttcataataaactctaatcgggaaattcatttgtattccaatattcgtcaaaatgaaaaacgcccaaaaattaggcgcaaattgcgtgctattttagagagagaaaaatggttgtgcaatagggaaatgaaaatatttttttataaaaaaattaataaaaaagcgtaagaaatcttacgcctatcttaatgaaattaaataactcagagaaccgatcacaatgatatagcctagtataggtaaaaaggttaaacgccagatcgcactctcaatttcaaaaccgattccatgaatccataaaatcgccataccatagaaggctaaaattgctaaataaggaatatgtccgccaaaatgctgagcaaatagattcgcattcagcaatatcattgcaaatagtacacctgcaagaataaaagaaagggcctttagccagccctttcttgttaaattatagagcgaatgaatcattcactataatcctattcgtcaaatttgcctgttttctcaatgctaacagtaattaccgttgcaaaaagaatcgcaagtaaaacgcctaatacccaagttacataaaacatctgtttatctccttagtatgcacttgctttgttatcttctaagtatttagcatctaagcgaccatacatcttgatgtatgaccaaatagtataagctaatactaaaggcacaaagatacacgcaacaactaacattactgttaatgtatattggcttgctgttgaatcccaaaccgttaaactcatttctggatgagaaattgacggcataatgaatgggaacatagatacagctgcagtaacaataaccccaacgagcataattgatgatgagaagaatgctaagcctgaacgattcactttagaagcaaaaatcgttaacaatgcacctaataccgctaatgcaggaacgacccataataccggcatctcagcaaaatttctgaaccatgccgcactttcaaccgcaacagttttattagttaagaatgattgtgcattgtggtctaaatcgcttgtgattacaaaaccgtctttaaacgataaccaaacacccgctaatacaaacgcaactaatacgattgccgcagtaacttgagcggttgctctcgcacggttacgtaaatcacctgttgttttcatttgtaaccatgtcgcaccttgcgtggttaacatcattaagcttactacgccacataataatgcgaacggatttaataagccgaagaatgaacctgtatataccacttggttgaggttattaaattcgaatggtacgccttgtaataagttaccaaacgctacaccgaaaattaatgacggtacaaaaccaccgacaaataaaccccagtcccaagcattacgccatttcgggctatctactttagcacgatattcaaaacctaccggacggaaaaataacgccgctagcactagaatcatcgctaaatagaaaccagagaatgatgttgcataaacggtaggccatgccgcaaagatcgcaccacctgctgttaataaccatacttggttaccgtcccagtgaggagcaatggtattaatcatcactcggcgctcaacattgcttttaccaatcacaggtaataatgttaatacgcccatatcaaaaccgtctgtaatcgcaaagccgattagcaatacgacaatcagaatccaccaaataaagcggagaatttcataatcgatcattgtacactcctattattttgtagattgttcaaaatgataacgacccgtctttaatgcgcttggaccaagtcttccatatttaaacattaaatacatctcaaccacgaggaagatagtatataagccgcaaagtaaaccgattgagatccaaagatctgtcgtcgttaatgccgaattagatacgcctgtcggcaatacttcataaattgcccatggttgacgaccatattccgccaagaaccaaccagactcaattgcaatccacggaagaggaataccccataacattgctcttaagaataaacggtttttaccaacggtaccacgtaagttttggaagaatgcgaagccaattaataggagcattaaaccaccagaaaccatcattgcacggaatgcccagaatgttgggccaacattaggaatggtacttgctgccgctttttggatttgttcttcagtcgcatcaactacattcggcgtatattgtttgagtaataagccgaagcctaagtctttttgtactgctttgaatgcttctttttcttctgcagtatagttacccgcacgtaatttttcgagtaacgcatatgcttgaataccggtacgaacacgttgttcattgattgcacgaatatcttttaaacctttaatttcagtatcaaaagaacgtgttgcaataatacctgccatatatggaatatgaattgagaattcatttttcatttcagcggtattaggaattacgaatgcattccatgctgccggagcaggttgagtttcaaactcaccttccattgcggctaatttagtaggttgtgctttaccgatttcgtaacctgattcatcgcccataattaatacagcaagaatcgccattaaaccaaagcttgcacctactgagaatgaacgttttgcaaaaccgagatcctgaccttttaaaatatagtaagcactaatacctaatacaaatactgcaccacaagtataacctgctgttaccgtatgtaagaatttagattgtgttactggatttaatacgagatcagagaaactcacaagttccattcgcattgtttcgaagttaaattcagaaccaaccggattctgcatccaaccattcgcaacaaggatccataacgctgagaagttagaaccaaatgcaactgcataagtcgcaagtaagtgtttaccttttgataaacgatcccaaccgaagaagaataaaccaatgaaagttgactctaagaagaacgccattaagccttcaattgctaatggagcaccaaagatatcgcccacatagtgagaataatatgaccagttcataccaaactggaattccattgtaataccagttgttacgccaagggcaaagttaataccgaataacttaccccagaatttagtcatatctttatagacttcttttcctgtcgttacataaagtgtttccattacaacgagaacgaaagaaagacctaatgttaacggcacaaataagaagtgatagagtgcagttaaagcaaactgcaaacgcgagagttcaacaacgtctaacatctcagacctcttataaagtataataaaatttatttatagattattctgaatatgaataatcaccccaaccaaattttgacctaaaacaaccatataaccataaataggtatatgcttttttagaatctacgttccattttaccttgaatttaataaattaaaaatagtcgatttgttacatcgatcacatttctaatcaaaactttgaaacaatgttaaaaattagattgttttcacttatatttttataacttttctttagcatctctaccttttatggcgtatgtctttctacgcttttatgattagttttgatattggtcaaataaaatgatcgaaaagatccaaaaaaattgctatttaataatgacttttatttcttgtttgttataatcgaaaaaatcctaactatgcgctaaacgatagtttttaactataactgaaaaaggtaaaaccataatgttaaaaaaagttctcatttcaacttttgctagcttagtactggcattcacatcacaagtcgcgatggcaggagtgaaaacctcttcactttctatggcaaaaccttctgtaaaccaaaaattgccaacgcaatgtcaaagaatgtttagcgttgcagataagcttgtttcggatgcagaaaaacaacctggtacacatacccaagttgctaaaatgaaaagtaagttatcttctacaaggcaacaaattttaaaaatggaaactgagatgcaacaaaaaagttgtaataaaggtttaaccgctttaaacacactgaaacagaaacattaatcgtttagccctgaattatttaaccgagcactaattaccaaaaaggtgctcggtttttttattgcttttaatttgtaaaaaatcaaaaaattcgaccgcttgtcagatataaaaaaacctctaggacaacttcccagaggtctttatactagctaatggaggatgaattacatcattccgcccataccacccatgccgcccattgccgcagccggatctaatttttcatctttcggtaaatctgtgatcatacattctgtagtaatcattaaacctgcgattgatgctgcgaattgtaatgcagaacgagttactttagttggatctaagatacccatctcaagcatatcgccatactgttccgtaccggcattataaccatagttaccgttaccgtctttcacattacgagccacaactgacgcttcttcacctgcgttagtcacgattcggcgaagtggcgcttccatcgcacgaagcgcaagtttgataccaacattttgttcttcgttatcacctgttaaggttgctgctactttagaagccgcacgcactaacgcaacaccgcctcccggtacgataccttcttcaactgccgcacgagttgcgtgtaacgcatcatccacacggtcttttttctctttcatcgctacttcagttgccgcacctactttgattaccgcaacaccgccagctaatttcgctacacgctcttgaagtttttctttatcataatctgatgttgaatcttcaatttgttggcgaatttgtgctacacgtgctttgatttgtgcttcgtcaccgataccgtcaataatagtcgtgttatcttttgtaattactacacgttttgcttgacctaattcttcaagtgtcgctttctcaagttccataccaatttcttctgaaatcacggtacctgctgttaagattgcaatatcttgtaacattgctttacggcgatcgccaaagcccggtgcttttaccgcagccactttcacgataccacgcattgtatttacaactaatgttgctaacgcttcgccttcgatatcttctgcaacaattaataacggtttacctgcttttgctactgcttctaataccggtaaaatttcacgaatgttgctgatttttttatcaactaaaatgatatatgggttttctaattcaaccgtacctgcttccggtttgttgatgaagtatggagaaaggtaaccacggtcaaattgcataccttctaccacatctaatgcatcatctaaacctgtaccgtcttcaacagtgataacaccttctttacccactttttccattgcttgcgcaattaatttacccacggtttcatcagagtttgctgaaatcgtaccgacttgctcaatctcttttgaagtttcgcacggtttagaaatcgcttttaattcttctactacagcaacgaccgctttatcgataccacgttttaaatccatcgggttcatacctgccgctactgcttttaagccttcgtttacgattgcttgcgcaagaacagtcgcggttgtcgtgccgtcaccagccgcatcgttcgcttttgacgccacttcttttaccatttgtgcgcccatattttcgaatttatcttctaattcgatctcacgtgctactgacacaccgtctttagtgattgtcggcgcaccgtatgctttatctaacacaacattacggcctttaggacctaaagttacttttaccgcatccgctaaaatattcacgcctttaagcatttttacacgtgcgtcattaccgaa

SEQ ID NO: 7 - DNA, 2501598 bp, Actinobacillus suis (residues 1,250,800-2,501,598 of 2,501,598)
tttaacgtcttttgctgccattttttcttcctttctagtgattaatgtttgcttctacaagatctacaccaactttgatttgtagccccattcggaacattacgaaaaccaaatttttgctctaattcttgatgggttttagctgttacacttttacattttggacacgtgtgaggaagatttactgtaccactcataatttactccaactattcaacaattgctaaaatatcgttttcagaaagaattaacacttcttcaccatcaattttttctgatttcacaccataaccttcgttgaagataactacatcaccaacttttaccgctaatgcttgtacagaaccattttctaataaacgacctgtacccactgcaattactttaccacgagtagattttgttgctgcagagccagttaaaacgataccgccagcagaacgtgtttctacttcttcacgttttaaaattactttatcgtgtaatggacgaagagtcattgtatgtttccttctattaatctataaaaatttcgcacgcagaattgcgtgcaacgataatcaacattggggcagattatcagctttcaagttacttttgcaaaattttgtgcaaaagcaaccgctttcgtctgatttttaggcgataaaaaagagcatctcaaatgaaatgctccagattattaagcttcggattttaagcgttggattaaacggctatttgctggcggaaattcgctctcatccaagtcagcttgagcgacccaaaaaccttcttgcccttcacgcccaaacggttcaccgacccattcttccactaaatagaagaaaaactcaatcactttagtcggataatcgaaacggaacgattcataaggaaacgcacttaacacgtgaatcccgatttcttcttctaattcacgttttaatgcctcttccggcgtttctcccgtatccactttaccaccgggaaattccaacgcttgtgcaaaatcttgtccttcaagtctttgggttaaataaatctgtccaaattcattgcggataatgccggctgcaacttggattgtgggcttattcatgtattttccttgagaatttgttgtaatttttgttggatattttttatcacagattgccaattaagactagcctcttggcgaaaaagtttcacactgtcataccacgggctatcttttcgtgccaacaaccaacgaaaatctgggtgataactcagcataatccacgtcggtttgcccatggctgcagccaaatgggcgacagacgtatcaacactgatcacaagatccatttgggcaattaatgcggcagtatctgaaaaatcaccaatatcttgctgccaaatatgcaaattttcgaataaatcagaccgcttgtaatccgcttcgtttagctctttttgcaaacaatggaaatcagcatctaacgtaaataactgtgaaaacaactcaaagggcaaactgcgggaagcattccgattatgttttgccgagcccgcccaaaccacaccgattttcaagcgttttagcgaactacaagcggttatttttgtgtgccattttgcaagaaactccggttgtgcttgtaaataaccgcttgaataaggaatattttcaagtgtactgccaaatactaaaggcgcacttaacatcggcaaatggtatgccagccccgaaattcgcccaccattttgcattgtctcaatgccgtattgcgctaaattatagttaagcaaattttcgatgccactatgattcagcaccaccacatttaagccttgacgtttcatttccaaggcataacgcacaaactgaatgttatcgccaaatccttgttctacgtgaaacaagattttagcatcgccgatattttcccctcgccattgcggaatattaatttccaacggttcaaaagccggtaagcccgtttgccaacgccattcgtaagcctgccagccttgcggataatcacccaacaagttatgtaacatcgctttattacaccacgcaatggcgtaatttggcgcaagttcaaccgctttattcgcatcttctaacgctaattggtaaagccccaaattttgcaatatcgtgcaacgattgtgatatagcaccgctttatccggtaataagcggataatttcatcgtattttcttaaaatcgccagccattcaaatggagttacagcgctgtcctgctcttccaccaataaagcgagatattgttcaaacgtcatttcagccatattgttgttccaattgttgttgtactctagtgatcaccggttgccagtcaaaatcaaagccctgacgaaataggcgtacactctgataccacggactatcttctcttgccaataaccaacgaaaatcggggtgataactgattaaaacccaagtcggtttgctcatcgccgccgctaaatgtgccactgaagtatctacactaatcactaaatcaagttgagcaatcaatgctgccgtatcggaaaaatcggttaaatcatcttgccaaaaatgcaaatttttaagcttttccgaccgcttgtaatcggcttcattcactactttttgtaggcagtgaaattccgcatcaaattcaaataacggtaagaattgttcaaattgcaaacttcgtatcgcattgcggtgatgtttaggtgagcccgcccataccacaccaattttaagttttttagcagaattgcaggcacttattttctgttgccattttataaagtgatcggtttcgggcaataaataaccttccgcataaggaatattatccagtcttgtgccgagataatgcggtaggctcatcattgaaacataatatttcagcccgctaatcgcctcaccattttttgatgtggtaatcccatactgcgctaaattggcattcagcaaattttctaacggctgatgattcaccaccacaatattcaagcctcgctttttcgcctctaaggcataacgcacaaattgaatattatcgccaaagccctgttctgcataaaccaaaagtttggcttgaccgatatcctcaccttgccaacgaggaatcggccatccggtgtcctgaaaggtttccacatcagttttccagcgccattcataagcttgccagccctcttcataacgccctaaggtgtttagaataaatgctttattacaccatgccatggcaaaatccggtgcaagctcaagcgttttctccgcatctttgagagctaaatcataaaaacctaagtgctttaatacatcggaacgattgtggtatgcgagaacggactgagagaaatctcctaaaaaatcatcgtacaactttagcacagcaagtaattccaaagggttgctcgcctgttgctgttgttgataaatataagagaaacgttcttgttcggaaccttgctgaatagaaattaagtctgaattcatagaaaagacaaagaaaaaagcggtcattttttcagaaaattttgcaaaaatttagaaaaaacaaccgcttatattaattacgcatatcttgctttactgccgtggcaatgtttgtattttttgccggaaccgcaagggcaaggatcatttcggccgatattcaaattcgctaattgctcatctgtcagcgattctgctacacctgcttgagcattttgcatctgctcttcggtcgccgcttggtaatgtgcggcttctgcttccgccattgcgtcttgctggcgttgcgcttcttcaatttcttcttgactacgcacttgaatacggcttaacacgctaatcacattagatttcaacaaatcgagcatattggtaaacatttcaaatgattcttttttatactcttgtttcggatctttttgtgcatagccacgtaagtgaatacctttgcgtaagtaatccattgccgaaagatgttctttccaaagctcgtctaagttctgtagcatcacgcctttttcaaagttacgcatcacttccgagccgactttttcttctttcgcttggtactcttgtttcgcaatatcaacaatacgctcacgcaatgtttcttcgtgtaagtcattctcttgttctaaccaatgttggataggcaattccataccgaattggcgttttaacgcatcttctaagccggcaacatcccacatttcttcaatagattgcggtggaatatattggctaatcacattattgaacacgtcttcacgaacagtgttgatcatcgctgaaatatcatcggtttcaagcaagtaattacgttgttcgtaaatcgctttacgttgttcgttcgccacatcatcgtactgtaataagtttttacgaccgtcgaagttatgtgcttccacttttgcttgtgccgatgcgatcactttagtcagtaattttgactccatcgcctcaccttcttcagagaaggctttacgcatcatatttaatttaccttcattcaggtaaatacgcattagtgcatcgtctaaagacagatagaaacgtgatgaacccgggtcaccctgacggccagaacgaccacgtaactggttatcaatacggcgagattcatgacgttcagtaccgataatatgtaaaccgcccgctttcattacgatgtcatagcgctctttccaagccgctttgatcgcttcgatttgctcttcagtcggattttccaacttcgccacttccgctttccagttaccgcctaacacgatatccgtaccacgacccgccatattggttgcgatagttaccgcacccggtgcgcccgcttccgccacgatttccgcttcttgggcatggaattttgcatttaatacattatgagcaataccggctttggttaattctgccgataaaagttctgatttttcaacggatgccgtaccgactaacaccggttgctggcgagccatacagtctttaatatcattgataattgccgcaaatttctccggttcgctcttaaacattaagtcggtacggtcatcacgaataaccggtttattggttggaatcactactgtatccaaaccgtaaatttgttggaattcaaacgcttctgtatccgctgtaccggtcataccggctaatttttcgtatagacggaaatagttttggtaagtgatagacgcaacagtttggttttcaccttgaatattaactttctctttcgcttcgatcgcttggtgtaaaccgtcagaccaacgacggcccgccattgtacgaccggtgtgttcatcaataatcactacttcaccgtcttttacgatgtaatctacatctaattcaaataatttatgtgcacgtaacgccgcataaacgtggtgtagtaaagcgatacgagccggatgataaagtgtttcgccttcttgcattaagcccatttcggtcaaaatgccttccactttcaccataccacgctcagttaaatgcgcctgtttatttttcagatctaaggtgaaatcgccttcaccggtatattcttcggtgtcttctttatcttgctgaatcaaatgcggaataatcgtatcaatcgcttgatagatttgagtcgcatcttctgctgggcctgaaataattaacggcgtacgcgcttcatcaattaagattgagtccacctcatccactaacgcatagtgtaattcacgttggaaacggtcttcttttgcgtgcgcaaggttatcacgtaaataatcaaaacctaactcactattggttgagtaggtaatatctgctttatacgcttcacgttttacttcattcggaagacccggcacattcactgcaacggttaaacctaaaaattcaaataacgggcggtttgtttccgcatcacggcgtgcaagataatcgttcacggttacaacgtgtacgcctttaccggtcaacgcatttaagtaacaaggtaatgttgcggttaacgttttaccttcaccggtacgcatctctgcgatattacggttagttaataccataccgccgattaattgcacatcaaaatgacgcattcccatcacacgacggcttgcctcacgcacagttgcaaacgcttcgtgcaataagctgtcaaggcttgcaccatcagctaaacgttgtttaaattctgcagttttagcttgtaattccgcatcggttaatttttcaaatgccggttcaagtttattaatttgcgcaacacgttttcttaaacgttttaacgtacgatcgttgcttgaaccgaaaattgaagtgataatttttgaaatcattgttttgtcctaatctagttatctttatatgaaaaagtggcatagctttacggaagcactgttttattccgcctacttatgatgaatcgattttatagattagacgattggaccggctcgaataggatggttatcatcgccatcaaagcggtaagatttggtaaaaaattcgcaaaaaacgaccgcttgtgtcggaatttccacaagtacttgtttaagctctgcgataaataaagactgaggttcttgttcgtcagaacaaacaacacaaggagaaaaatgctgattgataaccgtttcttgttcactttcactttttactatcgaatgaatttcaggtaacgcaaaaatcgcaaccagtccgaaaaccaattgcgaccaaaaaggcgttttgtgaaaatgcttaaataaactcatcaacatttgttttaaatactaaaaattatattaattatacgataaattccagtagaatgggcagttaattgggtcaaataacgtaaaatcaaggggtaacagtccagaaagatgaaaaattcagcaataaaaaatatcactgaaattttgcagaactcaagccttagtcggattgtccaacgagccaatcaattaaatgatttgcatcaaaaagtacaaaaattattaccagaacagtaccgtgggctttaccgtattgtgaatttagttgataatcaacttgtattcgaagtgcaaaatgcgactgtacgacaaggcttacagttacaaagttcacatttattacaattaattcactctgattttccgaatgtaactgagcttcagtttaaagtgaatccgagttttaaacacatttaaatagaaggaaactggaatgaaaaaaattgcgttggttgcattcagtgcagtactaggcgcttgttcgctattaccacaacaatccgttactggcacattccaaggcgagctaccttgcgcagactgtgaaaaaattcaagctgagcttattttaggtgctaataatagctaccaatacaatactatttacgtaaaagctggtaaagaatatccgttcagggacaaaggtacctatacttgggaacaaggtaaacgcagcattattcgtctggaaaaagattccggctcattagcgtttaaagtcagcgagacacaagttgaagtgtgtgatgccaatggcaatcctgctaaaactgcaaatcacccttataccttacacaaagtgaaataatttgttgtaaattaattctaaacgcccgctcaccaagcgggcttttattttggattaaatttaaggtgataatataaaaaaatccccacaacgtatgttatggggattgaacctaaataaggaaaaaagtaattattacttactttaacttaaccaaggaaatatctatgaaaacagtaaggaatctttcgcattagcaatggcggtgagagggggattcgaacccccgatacactttcgcatatacacgctttccaggcgtgctccttcaaccactcggacatctcaccgattcactaaaatgcacaaaaaagtacatttgaaagatatagggaactataccgatttttcacactctaatcaagtattttcttcataaaatgaaataattgccaattccgaattatgcttattttatacttattgccctacacctaaacaatttggtgatttaggcaccataccattcgcttccgtccattcttgcggcgtaaaaaggtgtaaagctaatgcatgtacgccattctccaattcatacgctaagcagctataaaccgctcgatgacgagcaacgactcgttgtgcagcaaagtttttcgatactaatgtcactttaaaatgagactctgctccacgaccggagctgtgcatatagctttcattttcaatttgtaagaattgtggtgaaaattgttccgttaatttttgctgaatcgtttgttcaaccgacatttttattccttatgaattgctaattagtatttgataatggataattaaaaaacttatttgtaggtaaattgcctaataaatacctttatttcattatccattatcaaatagcaattatcaattaaaaggatttcttatgacattatctaaaaaagcattacttctcgtcactacacttgcaacagcggtacttgctggctgccaatctcaatcaagcgtgttaaatttcactacacctagtcctacggcaacatttaacactaacaaccaaactgctgcagtgagtgtgatgacacaagatttacgtacttctcgtgaagtggcaagctataccaaaaacggccaagtgactcgtttaacttcaagcccggaagttggcttaatgttccaacaagccatgcaacaagacttaaatgcgaaaggcttccaattggtacaaggtgctgcgaatgccaatgttatcgtaaacgttcgcaaattctttgctaccgtggaacaaggcaacttattatataaagtgaatgcagaagtgggggttgaagttgcggtacaaggtgcgaaaggtagctttagcaaaaactttaacgcaacacgaggctatgaaggtgctgcattaacgactgataacgatgacatcaaaaaagtgctaggccaagcgtatgatgatgtaatcaaagcgatctacaacgataacgaaattgctaacgcaattcaccaatttaaataattgattttattcaaataacaagcggtcggatttcactatttttttgcaaaatcagaccgcttgtttgtttatattagcacgattctctcacaatgagcgggcaatcaatcggctgaactttattggtttttcgcccttcgattaaatgcagtgccgcttgttctcccatctggtagtgaggcaattgcactgtggtgagcggtggtaaaaacagatgagccactccgaccatattgtcatagccgacaactgcaacatcttgcggaatacgtaatccacgcgcgagtaataactgataggcaagcatcgcaatacggtcatttccgcatacaatcacatcataatcaaaatgctcggaatcagaagctaaaatctcttttaagcgatccgcaccttctaaataatcatcgctttcattcataaaaaattcggtcggtacatttgcatttttttgtgaaaaccagaccgcttgaaagcccttctgacgttctttggcggcaattgcattatgtggaatatataaacaaagcggtttcttataacctttctctagcaataaatgcgtcacatccgcttgtccttgaaaatcatttggaatatagctcgcaacttgcaaatcatccgttacgcaatttgccagcacaatcggtaatgatgctaaacgttttggaatcttaattttttttagcccgtgacgggtaatgataatggcagtcgggcgatgagaaagcaataactcaacggctttttcaacatcttgctcatcatcttcaaaggtattgattacaaacgaattccaaccgtactgacgtacggttttttcaatcgcaagtaaaatttcgaccgaaaacggtgttgttgcggtgctaaacgataaaacacctattgtattttcactcacacctcgaattttctgcgcagcaatattcggaacataatttaattgttcaattgcatcttgtactgctttacgtgttttttcagaaagttgttcggggttattaatcgctctggaaaccgtcattaacgataccccagccaaccttgccacatcttttagggaagccataaaaatattaataataaataaacaaaaaagagaaatagataattaaaatgcatttatcagtcactattcactttaccccgtatcttttagcgaatcaattctcccctgataattattcaaaaataactgtgatcttgctcacaaaattaaaatgttaacgttaaaatttgtgatttaactcacaattttgcatattctcctcttgcaaaaccaaatgataacgttaacattttgcacatcaaatccacaatagaaggtgttttattatgcaagcacaatcacaaaataaagcttattactggggaaaccgtaattatttcgtattcagcggttacttctttacctatttctttattatggcaacctgttatccattcttagggatttggctaggtgacataaacgggttaaccggtgaagaacgaggtatcgtattcgctgcaatgtcattctttgctctctgtttccaaccgattttcggctatgtgaccgacaaactcggtgttaaaaaacatatgctttgggcagttgcgattgcccttctcttctatgctccattctttatttatatcttcgctccgatgcttaaaaccaatatttggatgggcgctatcgttggcggtatttatatgggattcgtattctccggtggtgccggcgcatccgaagcttatgtagaacgtgtcagtcgccaaagtaactttgaatacggacgtgcgcgtatgttcggtatgatgggctgggggatatgtgcttcgattgcaggtattttatatagtaaagatccggattccgtattctggctcggctcagccggtgcggtcgtattactcgtgttagtggcacttgcaaaaccggagcaaaattcgaccgcttctgtaatggcacaacttggggcaaacacaaacccggtaagccttaaacaagcgttcaagctctttaaacttcctcgcttctgggcattacttgcctatgttgtcggtgttgcttgtacctatgatattttcgaccaacaattcggtaacttctttaatacgttctttgattccaaagaagaagggattgaaatgttcggttatgtcaccaccatgggcgaattcttaaatgcggcaattatgttcttcgtaccacttgtgatcaaccgtatgggcgcaaaaaatgccttattagttgccggttttattatgactattcgtattatcggttcttcatacgcaacggaagcatggcacgttgtagtactcaaaaccttacatatgtttgaagtgccgttctatcttgttggcttattcaaatatatcggtaacgtgttcgaagttcacttctctgcaacaatctatatggtagcctgccaattcatcaaacaagtcggtaatatgcttgcctcttctgttgttggcggttggtatgacaaattcggttatcaagatacttactttattttaggctgtgtggcattaggctttactcttctctccattttcaccttaaccggcaaaatgaatatacaagaacgctatcaattacaaaaacgcaataccagaggcgcttaacaagcggtcaaaaaagtagagttttttgaacattggctttgccaacggcaatgaataaatgcctctcaaattttgcaaataaggaatttactatgaacaacatcattcgcttatctagcaaccaaaacgatctgattattaacgcctcagataatcctcaaattctctattggggcgaaaaattagcacaatttgaaccgactaatgcttggctcagctactcaggtgtaacaaacggcggtttagatattgatgtgccggtttcacttgcagcggaaaacggacgtggctattttgaatcgtcttcggttgaaggccatcgtaacggtttagactcaatgccggtgttcaaattaagtaaaattgaacaaaaaaatgaccgcttgatcatccgtcaaacggatgaaattgccggcttggaatttagcagtgagtttgtattagataaagcgacttccgtattaaaaacacgtaataagttacgtaatttaaaagcagaaaactattacgttgatcgccttgctgttactcttccacttcccgaattcgctgatgaagtttgtacgttctacggtcgctgggtgcgtgaattccaaccgaatcgccaaaacctcaaacacggcggttttattcaagaaaaccgtgtcggcagaacatctcacgaatatccgccgattttgattgtcggtgaagaaggctataaagaacaaaaaggtgatgtatggggcttccatttggcttggagcggaaaccaccgtattcgtgcagatattgatattcgaggcagacgtagcgtgcaattggaagcgctatactttccaggtgaaatcacactagcacaaaatgaagagattgcgactccttgggtttatgcaaccgcttctaaccaaggcttaaacggtatgagccagcaatttcatcaatatgtacgcgaaaatattctccgttttccgcaaggtaaaacacgtccggtacacctcaatatttgggaaggcgtttacttcgatcacaaaccggaacatattatcgccatggcgaaagctgccgcagaaatgggcgtagaacgttttattattgatgacggttggtttattggacgtgatgatgatttcggcggtttgggcgactggtatttagatgaacgcaaatatccaaacggtttaacgccggtggtcaaagcggtaaaagatctcggtatgcaattcgggatttgggttgagttagaaatgatcaacaaaccgaccaaactttaccaacaacacccagattggttactcgcagttgaaggttacgatcaacctgccgaacgtaaccaatttgtgctcgacctttgcaatccggaagttttcgattatttagtggaacgaatggattggttactcggcaatcacgatattgactatgtaaaatgggatatgaaccgccgtatcgtgcaaggtgctcaccaaggaaaagccgcagtcaccaaacaaaccgaagccttctatcgcttgtgtgatgtgctttgtgaaaaatatccgaatgttgaatttgaagcctgctcttccggcggcggtcgtattgattacgaggtattaaaacgttcacaacgcttctggacttccgatgataatgatgcacttgaacgtcaaaccattcaacgcggctttagttacttctatccacctgaaattatgggggcgcatatcggcggcttccattgccatactacataccgcaaattagatgcgaatttccgtggtttaactgcgctattcggtcatatgggtgtggaattagatccggtaaaagaaggtgaggaagaacgtaaaaattttgctaaatatattgcgttacataaatccttacgagaactattacatagtggcacggcattccgtttagaccgtaaagaccccgcatctcttgtgaacggtgtcgttgcaaaagatggctcccaagcggtggttttaatcaaccaacttgcaatgctcgattacttacgtcaggaatcactacgagtgccatacctcgataaaggcaattatcaagtagaaattctggatttaccacgtaactttgccgaaggcaaattcggtcacttgatgaaacaattaccggaatggatggtaaaagtattaaacggtgaaagagttgtcattaacagtgaatggttggcaaaagtcggtttaggcttaccgattattgacccagcttccgcaatgctattgaaatttactcgtatcgcttaaacatcataaacaagcggttaaattctctgagttttttgcaaacttttcaggaaatttaaccgcttgtattatctagtctagctgcaactgtgctaggctaagtgagaggcttcaattaaacgttgcgtgtaagcatgttttggttgctcaaaaatttgttgagcgctgccgctttccaccacttcacctttactcatcacgattactttgtcacttaacgctcgtactaccgcaagatcatggctgataaataggtaacttaaaccatatttttgttgtaaacgattaagtaattcgactacggttaactgtgtagaacgatccagtgcggaagtcggttcgtctaataacacgaatttgggttctaaaataatcgcgcgagcaattgcaatacgttgccgctgccccccagaaaactcatgaggataacggtttatcatcgtcgggcttaaattcacctcttctaacattttttgcactttttctctgcgttccgctttcgtcatctgcggataatgaaccgctaacccttctccgataatttcacctactgttaagcgtggagaaagagaattaaacggatcttggaacaccatttgcatatttcgttttaaagattggcgatcactttttgataagacagaaatcgcttgaccatcaaattcaactttaccctgataatccagaatttgcatgatcgctcgccctaatgtagatttgcccgagccggattcaccgacaatgccaagcgtttctcccacatttagctggaacgaaatatcttttaccgcattaaacactttcttcggttttccccaaaaagaacgctgtagtacataatcgacctcgatattttttgcattaatcaacaatttcgccggttcactttgcgtgcttttgaaatggctcggaataggcgttaaaagctccatcgtataagggtgctttggttgtgtaaatacatctgcggttttacctcgctccacaatttcgccggatttcattacacaaacgtcatcactgtatttttgcactaaacgcaggtcgtgcgaaatgaggataatcgccatgcccatttcagtttgtaattccagcattaaatctaaaatttccgcctgtgtcgtgacatccaatgcagtagtcggctcatcagcaatcaataaatccggtttattaataattgccatcgcaatcataatgcgttgtagctgtccaccggaaaactcgtgcggataacactttaatttcttttccgcatgtggaatttttactttctgtaatgccgctaaggtcaacgcttccgcctcttgtttggtcatattgggcgtatgcgtcgtcactgcttccgcaacttgttcaccaatcggcatatagggatttaaagaggtcatcggctcttggaaaatcatcccgatacgatcgcctcgtattgcttgcatttcggcttccgtaagcgccaaaatatccttatcttcaaatataatttgggaatgtttgccatattgcacaatatttttcggcaacaattgcataattgacatcgaggtgaccgatttaccggaacctgactcaccgacaatggcaagagtctgccctttttccagcgtaaaagacacggaacgtaccgtatgtgaaaaacgatcttccgcttttaaatatacgtctaaatttttaacttctaataatttcatccttcactcctgttgttatttatcttttggatctaatgcatcacgcagaccatcaccaataaaattgaaacaaaatagcgttaagcaaaggaaaaaagccggaaatccaagcaaccaaggagaagtttccatctgagctgcgccatcgcttagtaacgagccccaactgctcattggttcttgagtccctaaccctaagaaacttaaaaatgattcgaataaaatcagtgaaggcacttctagcgaagcatatacaaccactaagccaagcacattcggaatgatatgacgccaaataatctgacggcgagaaacaccgcacacaattgccgcttcaataaattctttatttttaagcgctaatgtttgtcctcgaacgatacgagccagccctagccaagcgatcataccgattgcgacaaaaattaagaaaatattttgcccaaataaggtcaccaataaaatgacgaagaacataaacggaaatgagcttaaaatttcaagaaaacgcatcattacgctatctactttgccgcccacatagcctgaaatagcaccgtaaatagtaccgataaccacagcgaccaaagcaccggcaataccaaccatcagcgatattctaccgcccatagcgacacgcaccatcagatctcgtcctgaagcatctgtgccaaaataatgcaaggattcaaaatccggtgcggcactcatcatattccaatcggtatcttcgtagctaaacggcattaacatcggcacaaaagtgataaatagcacgattaataacagcataaataaactggcaactgccgctttattacgaaaaaaacgacgacgggcatcttgccataagctacgcccttccaacaccattgctgtattagctgaagcgagattttccgaaaagttttggtttttatctatttgcatatttccttcctagctataacgaattttcgggtcaatcaccgcatataaaatatctacaatcgcattaaatacaatggttaaagtgccaaccaatacggttaagctcaacactaaagaatagtctcgatttaaagcaccgtttacaaatagctgacctaatcccggtaagccgaagacactttcaatcaccattgaaccggtaataatgccgacaaaggcgggcgcaagataagtaatgacaggtattaatgcaggttttaaggcgtgtttaaaaatgattttccgcattggcacgcctttggcttttgccgtgcgaatataatttgaatggagaatttctatcattgaaccacgggtgatacgagcaagtccggcaacataaccaatggtaagcgaaagtaccggtagcaccatataatagagttgaccgccgttccagccacctgccggaagccattgtaaatgaatcgcaaaaaataaaaccagcagcggcgcaaatacgaaactcggcataattaccccggtcatggcgaatcccatcacgatgtaatcccatttactattttgttttagtgccgctacaataccggcggttaaaccgatgatcactgctaaaataaatgcgactacgcctaatttaatcgaaacaggaaatgccgaagcaattaaatcattaaccgattgatctttatatttaaaagaagggccaaaatcaccatgggcaagattatccatatagataagatattgtttataaagcggttcattaagatgatatttcgcttcaatatttgccatcacttcaggcgggtaagctttttcagaggtaaacggactgcccggggcaagccgcatcagaaaaaatgaaaaggtaattagaatgaaaagtgttggaatggcttccaatatacgcctaataataaatttcagcattagcaatcctcccttttaattaagaataactaattagtaactgaaatcgtatattttgtaaatatgcttcaagcacaaataaacaacaagcggtcaaattttccgaaaaaattgcaaaaacagtttgcaaaatcttggtgaaattcgaccgcttgtctaaatttaatcaagcttagcgatacctaaatgcgcataagttcggctggtagcgatacgtcctcgcggcgttcgttgtaaaaaaccttgctgaatcaaataaggctcaagtacgtcttcaatcgtatctcgctcttcgcctatcgctgcggctaagttatctaagccgaccgggcctccgtcaaaacgttccacaatcgcttgcagtaacttgatgtccataaagtcaaagccttcggaatccacatcaagcatcgccaacgcttgtttagcaatatcagaggtaatcacaccgttattacgtacatcggcataatctcgcacacggcgtaataaacggttggcaatacgtggtgtacctcgtgagcggcgagccacttcataagcaccatccggcgataaatttaagtttaagcaatcggcactacgttttacgatcgaggttaaatcatccaccgagtaaaactctaaacgctgtacaataccaaagcggtcacgtaacggagaagtcagtgaaccggcacgggtggttgctcctactaaggtaaacggcggtaaatccagtttaattgaacgtgccgccggcccttcgccaatcataatatccagctgataatcttccatcgccggataaagcacttcttcaattgctggtgataagcggtggatctcatcaataaataatacgtcataaggctctaaattggtcaacattgccgctagatcgcccgctttctccagtactggtccggaagttgtgcggatattcacgcccatctcattggcaacaatattggctaaggtagttttacccaatcccggtgggccaaaaatcaataagtgatctaacgcctcatcacgcaattttgccgctttaataaagatctccatctgctctcgtacagacggctgaccgacataatccgccaataatttaggacgaattgcacgatcgatgacttcttcctcacgcttcggtgaggcactaattattctatctgcttcaatcatttaaggtatttttactttttaaagagaggcttttaatgcttcacgaattaattgttcgctggttgcgcccgctttattcactttcttaatcatcttctcagcatcagcgagtttatagcctaacgcaactaaagcatcacgggcttcatctgccggatcgtgtgaatgtgttgcaacaatcgtttccaccgaatgttcttcaaagaaatcactttgtggcacacctttgaatttgcctttgagctctactaataaacgctcggctgttttacgcccaatgcccggaattttagttaatttggctaattcttcatgttctaccgcattcgcaaattgtgaaaccgacatcgccgataaaatcgcaagggctaatttaggccctacaccgttggttttaatcaattcacgaaataaagttctatcttgcttttgtgcaaaaccaaataataaatgtgcatcttcacgtacgactaaatgcgtaaagattgtggcttcttcaccgacttgcggcaagctgtaaaagctcgtcatcggcagtagtacttcatatccgacaccttgaacatcaattaccatttcaggcggttgtttttcaataattttaccgtgtaatcttccgatcattgattttattccaaactaaaaaatttgccttagcataacagaaaactgtatagaataacaggctaacaagcggtctattttggctaattttttgcaaaaaaatagcccgctaatcagcgagccatttttaatcaaattaaattatgctttttttcttaccactaattggcttaagaccactaatgtcaatgagaaaataatcataatcgttgctaacgcattgacttccggtgtcacacccgttttcaccagcgagaagatttttaacggtaatacttcatagcttgggctagtaacgaatgatgaaaccactacgtcatctaacgaaattgtaaagcttaataaccaaccggaaataatcgatggtaatgccagcggtaaaataattttacgtaaaatcgttacttcacttgcgcctaaatccttcgcggcttccaacatcttaccgtcaaaatcacttaaacgagatgagatggtaattaccacataaggcaaacagaaagtaatatgcgcaattaataacgaaataaaaccaagttgcacacctaaaatcataaatagcactaataatgaaactgccattacgatatccggtgacatcatgacgataaacagcaaaccgccgaccatttgcttaccacggaatttatagcggtatagcgcaatcgaagttaacgcacctaaaatagttgaaaacgttgcggcaaaaaatgcaatcgtcaatgaattcatagttgcatgaaccagcgtatcgtttgcaaataaacgctcataccagttccaactgaatcctttccattgtaaaccgtaacggtctgcattaaatgagtttaccaccaaaataataatcggaatataaaggtaggcaaacaccacgaacataaaaaagtttcttaatgtctttttcattattcaagctccacctttttatttaataatttatttgcacggtaataaacatatagcattaatgccattagcacggtaagtgcaatacttactgccgaacctaaaacaaattggttggtatttaagaataagctcttaataatgttaccaattaatggcgttttaccaccgcctaataagtcagcaacatagaacatccccatcgctggtaataatactaataaacaacctgccacaatacccggcattgtcagcggaatggttactcgtacaaaacgttggaacgcattcgcacctaaatcttttgctgcttctaataaacgaccgtcaattttctcaattgaagaataaagcggtaaaatcataaacggtaacaagatatacactaaaccgatgataatcgccaattcagagtttaataaacgaagcggttcatcaattaaaccgattgctaataatgcctcgtttaatacgcccttcacgcctaagaaaattttaataccgtagatacgaatcagcgagtttgtccagaatggcaatacaactaaaaacaatagaattgggcgcaatttcgccggcatcttcgcaataataaatgcaaacggataaccgataattaaacagaaaaacgttgcaatcgcagacattttaaatgagttccacaatacggttgcgtaagtatcgttgaacaactgtttatatgcatctagactaaatacgaaatcaacaaagtatgcactttggcgattttcagtaagaaaactgattaacagaaccaataagttcggtacaagtacaaaaagtaacaaccaaccgaagataactgaaactgttccagcttggaatttgttactagcaatcttcattattgagtacaacctcccagccttcgtgccatgtcaatgccactttttgaccaacttcgtgatcgatattcggatcgtcttcattgaagaattcgcttactaatacgttcataccgttatgatctaactgtacgcttgactctagtgtcatacctttataattacgatcgataatatgaccgataatcgcttttgagctttcgtcttcgtctaattcttcaataacaatatcttccggacgtaaaagcactttgagttgttgatttggcgtcacatccatatcttcaactttaatattacaaatacggccttctacattcgctttaacattgcgagcgtccacacgttcaatcacggttgcatcaaatacgttgatttcgccgataaaacgagctacgaataaattgctcggttcttcataaatttcacgaggcgtaccgtcttgcgcaattttaccgccgttcattacgataatacgatcagacatagttaatgcttcttcttgatcgtgtgtaacgaaaataaaggtaatacctaattggcgttgtaatgcttttagctcgttctgcatttctttacgcagtttatagtcaagcgctgaaagcgattcatccaataataaaactttaggcttattcactaccgcacgcgcgatggcaatacgttgttgctgaccgcctgaaagctgagctggtttttgttccgcacggtcttccaaacgcaccatacgtaacgcttccattacacgaggtttgatttggtcattcggcactttttgcatacgtaaaccgaaagcaacgttttcaaaaatcgtcatatgcgggaataacgcatagctttggaaaaccgtatttacagggcgttgttcagcaggaacgttagatacatcttgaccatcaagaatgatcgaaccttcagtcaagtcttcaaagcccgcaattaaacgtaatgctgttgttttaccacaacctgaaggacctaaaatagtcaaaaattcaccatcattaatggttaaatttaaatctttaagaatcgttttgctaccgtagcttttagtaacattgcgtagttcgatgattggtttttgttctaacttttccatctacttttgtattccccctagggcataaaattaaaatgcaaaatctgaattattttcagggcgagtgtgcgtaactatacgctaaaaactaactgttaatgatatagcgaacagctcaattttaaaagcaaaaatttgatttttaaggaatttattttggacaaaaaccgtttaacaagcggtcaaattttaaaatttttttgcaaacggttgcctcaaaaaatttcgctaaatttgtagtttcaattttatcggctcataggttaactaccgcataaaacacaaaacaccgccataaagcggtgttttaatcttgtttagagagattgtagcaaagggactaaattcggttgttgttcgataatcgccaataattttcttgccgctccattagggactcgtctgccgatttcccaagattgcaccaaattggtactgacacctaacagctgtgcaaattctgcctgtttcaaatggtgttgtgtacgaatcgccttagtatttggaattttatgtgcatggatgcgatgcgatggtacttccacctcacctttttcaatagcaaccatttcttctaatccttgtacaaggcgctcaaataaacgtttttccatccttctactctcctattaatctcgaaataattttcttcataatcgctttttctcgagcatttagattaactttttcgctttttccatacatagtaattaggtaaattcgccctgttaaacttctaacataatagataattcgaacaccagcacttttccccttattattttccggtaagcgccacctgatcttttggcaaccacctgtatgggaaataaaatcccctaattcgtaatgctctaataaatatgcttggaataattggtactcatcgtctgccattaattgcttacgatcttcctcgaatgtaccaacctcaacaaaggttaaatattcatcagaattcatctttcatccttagtataacgtacccggtacaaatttcaacgctaattgattatttatccatgagtatttattgaacaagaaattgattttagttattcgatgcagatcgcaaaattctaaagaaattcgaccgcttgttgtctttcggctagaatatcgcagtttaaaaagtggctgaaaataaaataaataaaagtagataaaatgaaattaaatgatcaacaacaacaagcggtggaatatgtcacgggggcttgtctggtactagccggagctggttcgggtaaaacacgtgttattattaataaaatcgcccatctgatagctcattgcggttacttgccaaaacaaatcgcagcggtaacctttaccaacaaagcggcacgtgaaatgcgtgagcgtgttgcccattctatcggtaaagaaaacagcaaagggctaaccatttcaaccttccataccctcggttttgaaattttaaaacgtgagtacaaattactgggtttcaaatccggtatgacgttgtttgatgaacacgatcaactcgcattactcaaacatttgttaccggaaaatgtggcggaagataaagatttactcaaagcattgatttctactatttccaactggaaaaacgatctgctttcgcccgaaatggtattaacacgtgtgcgagatgagcgtgaacgtgtgttttcgcatttttatcagctctaccaaaatcagttaaaagcttacaatgcgcttgattttgacgatttaattatgctgccggtattgctgttccgccaatttccggaagcgaaaacccgttggcagcagaaagtccgctatttactggtggatgaataccaagataccaatactagccaatatgagctgatcaaattattagtaggcaatgaggcaaatttcactgtggtaggtgatgacgaccaatcaatctattcatggcgtggtgcaaagccggaaaatatgcaacgtttacgtgaagattttgatttgaaagtgattaaactggagcaaaactaccgttccagccaacgcattttgcattgtgccaatattttgattgataacaatgatcatattttccaaaaacgcttattttcgaatttaggcgaaggcgaaaaattaaatgttatcgaagcaaaaaatgaagaacacgaagcggaacgtattgtcggggaattgattgcccatcgtttttccaacaaaactaaatacaaagattatgcgattttatatcgtggtaatcatcagtctcgcttgctggaaaaattgctgatgcaaaaccgtatcccctataaaatttccgggggaacgtcatttttcgcccgtgccgaaattaaagatatgatggcttacttgcgtttagtagtgaatcaagacgatgatgcggcatttttacgtattgttaatacgccaaaacgggaaatcggtgcggtaacgctggaaaaattgggcttacttgccaatgaaaaacaggtcagcttgtttgaagcgattttcgattttgagttgattcaacgcctgacacccaagccctatcaagcactgcaagattttgcccgttggattgtcgaaattgccgatcaagcagaacgttctgatccgattgaagcggtaaaagatttattggcaaaaattcaatacgaagcctatttgtatgaaacggctacttcgccgaaagcggcagaaatgcaaagccgtaatgtgcaaacgctgtttgaatgggtgcaaggtatgctggaaggcgatgaaatcgaagaaccgatgacgttagtacaagtggtaaatcgcctgacactacgtgatatgctagaacgtggtgaagacgatgatgaagcggaccaagtgcaattaatgacactgcacgcttcaaaaggtttggaatttccgcacgttttcttagttggtatggaagaaggcattttgccgcaccaaaccagccttgatgaggataatgtcgaggaagaacgccgtcttgcttacgtaggtattactcgagcgcaacaaacgctgacattttcactctgtaaagaacgccgccagtacggtgaaattatcaaaccagaaccaagtcgcttcttacttgaattaccacaagacgatttagtttgggaaagtgaaaaaccgaaaatgaccgaagaacagaaagtcgaaaaaacttcagccaatatcgccaacctaatggcaatgctaaaggcgaataaaaagtaagattttcctcaaataacaagcggtgtaatttttgctaattctgcaaaaattgcaccgtttttctgtgctgcacgaatattccattttcttatactaccccatataaccgctgataattccgcctaatttgtgtgtgcattgtactttctgactctgttcttaatttcgctaattgcgccaatattgcttgtaattgctgtgaaatactcgcattttctaaactttcgtgttgccacgggctgtcggtttcaatcagcaaacgatcaagcggtaagttttgggcgattttttgcgttttcagattccataaaatatccggtgtaacactggcgaaataaggggtacgaagaaaacgttcaagcgaatcatcatcggttttaaaccaatggaaatgagcgtgttgaatttggtatttctccagcaaatccagcattatcgccacatcatcatgcacgatatgcaaatttaacggtaaatttaaccgcttgcttaatgcaacaaattgttccaataaggcaagatagggccgataatctagcttaggattctgcctttttagataatgcggtaatcctacttcaccgatagcggtcaaattcgcttgattttttacaatccaatcaaataacacttgctgctgtttatcatcaattaatacctgttcgggatgaaaacctgccgcaatttggattttcggaaatttttgttttaatgctaataacgtttccgcactcgctaaatcggtactgaccgccaatacgccttgcagtaaaggatcgctaactatctgttctatttggcttgcttcaagttggtctaaatgaatatggctatcgaacattccgctactcccttttccactacttataaataataaaaaagcggtgtaattttgcaaaatttttacaaaatcacaccgcttgttatcgcttaattataagcctgcgcctgcacgtaatgcttccgctttatctgtttgttcccatgggaagtgttcacgaccgaagtgaccgtaagctgcagtttcacggtaaatcggacggattaaatctaacattttgattaagccgtatggacgtaaatcaaagttttggtagattaatttcactaatgtttcatttgaaactttacctgtgccgaacgtttccaccatgattgatgtcggatccgctacaccgattgcataagaaagctggatttcacaacgatccgctaaacctgccgccacgatattttttgctacataacgtgctgcgtatgctgccgaacggtcaacttttgacgggtctttaccagagaatgcgccgccaccgtgacgagccgcaccaccgtaagtatctacgataattttacggccggttaaaccacagtcacccattgggccgccaatcacgaaacgaccagtcgggttaatgaagtatttggtgttttggcttaaccattcgcttggcaataccggcttgatgatttcttccatcacaccttccactaaatctttttgtgaaacgtgttcagcgtgttgagttgaaagcaccaccgcatcaatccctacgattttgttattttcgtaagcgaaggttaattggcttttcgcatccggacgtaaccagtctaatttgccagatttacgtactttcgcttgttgttccattaaacgatgagcgtatgtaatcggtgccggcattaatacatcggtttcattggttgcataaccgaacataataccttggtcgcctgcgccttgctctaacggatccgcacggtcaacaccttggttaatatccagagattgtttaccaatcgcatttaataccgcacaagaatgtgcatcaaagcccatatccgaatgggtatagccgatgtcgcagatcacttgacgggttaagttttcaatatccacccatgcagacgtggtgatttcaccaccaactaacgccataccggtttttacataagtttcacacgccacacgcgctttcgggtcttgttttaaaatttcatctaacaccgcatccgagatttggtctgcaattttatccggatgtccttctgatactgattctgaagtaaataaattaatcgccattgtaattatcctttggttatacctttatataggcaggagcgttgctccctcattaaaatttacaagcggtcaaaaatcacaaaatatttgcaaaattcgaccgcttatattaaattcttttggaagtttttccatctagacgtctataatatattttttgagcatctaaggcaaactatttttcaactttacttctaaatgattttatggggcaaaatatggcaatcacaattttagacggcggtatgagccgtgagttaatgcgtttgaacgcaccttttaaacaacctgaatggtcggctttatccctttatgaaaaaccgtctgcggtgcaacaagtccatgaagattttatcgcaaacggcgcagaagtgattacaaccaatagctatgcggttgtgccgtttcatatcggcgaacaacgttttagtgtggacggtaaaatgcttgccgatttagctgggcgtttagccaaacaagcggttaaaaatagcggaaaatctgcaaaaatagccggttcattaccgccgatgttcggctcttaccgtgctgacttgattcaagcggatcgttttgccgaaatcgcccaaccgattattgacggcctttcgccttacgtggatatttggttatgtgaaacacaaagtgcgattatcgaaccgacttcgattaagcctttattgccaaaagataaccgcccgctttgggtttcgtttacattaaccgatgatgagccaacacccgagccacaattacgctctggtgaaccagtagcccttgcgattgaaaaaatggtggaattagacgttgatgcgattttatttaactgctgccagccggaagtgattgagcaagcactagcaataacccaatctattctaaaagaaaaaaatgtgacacatatccaaaccggtgcgtatgcaaatgcgtttgcgccacaaccgaaagatgcaaccgccaatgacggtttagacgaagtgcgtaaagatttagatcctgaagcctatcttgcgtgggcgcaaaaatggacggcacaaggcgcaacgattgtcggtggttgttgcggtatcgggatcgaatatatcaacacactggctaaaaatttaaaataaccgaataagcggtcaaaattggcaagttttttgcaaaacatccgcaaaatttaactgcttgtatcaagcacaacatcaaaataagggcaattatgtcaaacaaaaaaattgggttactttctttaaccgcactggtgctcagttcgatgattggttctgggattttcagcctaccgcagaatatggcggcagtcgctggtggtgaagcgttaattctcggctggatcattaccggcatcggaattattttcctcgggctttctttcttctttatttctcgtctgcgtccggatttagatggcggtatttatacttatgcacgtgaaggctttggcgatttagttggctttctctccgcttggggttactggttgtgtgcgacgatcgggattgtcggctatttagtggtagcgtttgagggaattggttcgtttaccgattcggaaaccaatattatcttcggacaaggcaatacgcttgcgtcttttatcggtgcttcaattatcgtgtggttagttcacgctttggtagctagcggtgttaaagaagcggcgacggtaaacttgattgcaacttttgtgaaagtattcccactcgtgttatttatcggtttagcgatttggtatttcaaaggcgaaacgtttaaccaagatttacaaggtacagcattaaataacagtgtgtcggaacaggtgaaaaacacgatgttgattaccctttgggtatttaccggtgtggaaggggcttccgtgttatctgctcacgctaaaaagaaaagtgatgtgggtttggcgaccgtacttgggattctgatcgcattagttttatatattgcaattaccgtgctttcactcggcattttaccgcgtgaaacgattgcggagatgtcaaacccgtcaatggcaggtttattagaaacgatgattggctcaagcggtaagattttaattactttttgcttaattgtgtcggtgcttgcttcttatgtaagctggacaatgtattcggcagaagtgccttatcgtggtgctaaaaacggtgcattcccgaaaattttagataaattgaatgcgaatgaagtgccgattaattcactgtggtttaccggttttgtggtgcaattctgtttattccttgtgttattaaccggtaaaagctacaacgccttattattaatttcgacctcaatgatccttgtaccttatttcttaatcggtgcatatttattgaaactgtcattccaacaaaattcagcgtggtatataaaactgaccggttttatcgcatcaatttacggtttatggattgtctatgcggcgggtttagattacttattattgtcggtattactttatgcgcccggcattggcttattcctttactcacgctatcaacaccaaggaaaagcattaaatctctcgacttttgagaaaattttattagtgcttattggcatcttgtttatttgggcggtttataacagtttcaccaacgttgattggggctaaaaagataatatcctctaatgtttcaacattaggggattttttatttttatgctaaattatgcagtttgtgtgaataacaattataaggacattgcatgtcaaaaggcaaaatcggtctcttttctttaaccgcattagtactcagctctatgatcggttccggtatttttagccttccgcaaaatatggcggaggttgccggtgcgcaagcgctattgatcggctggttaattaccggtgtcggtatcatttttttaggcttatctttcttcttcctttctcgtattaaacctgagttagagggcggcatttacacctacgctcgtgaagggttcggtgattttatcggtggcgtatcggcttggggttactggctctgtactgcgataggcagcgtaggctacttagtcgtcgcttttgaagggttgggaacttttgttgatagtgaaaaccatatcatttttgggcaaggcaatactgtcgcttccattttaggtgcttcggcaattgtttggttagtccatcatctgattgcacgaggcatccgagaagctgcatttgtgaatttagttgcaacgattgttaaaactttaccgctattcttatttatcggcttagcgatttggttcttctcacctgaacaatttatacaagatttcaacggcagcaaattgggtgaaagtaccttagaacaagtaaaaggtacgatgctgatcacgctttgggtatttgtcggtgtagaaggtgcttcggtactctccgctcacgcgaaaaagaaaagtgatgtcggcttagccaccattctaggtattttgattaccttggttctctatgtgtcgattacggtattatcgcttggtattctccctcgtgaagtgattgccgaaatgccgaacccgtctatggcaggtttaatggaacaaatgatgggcgctggcggtaagatcattatcactttctgcttgattgtgtcggtattagcttcttatatgagctggacgatgttttcatcggaaatcccttaccaagcggcaaaaaccaaagtattcccgaaattattaaaccgtaccaatattaacggcacaccgattgccggtttatggttaaccaatattacgattcaaattagtctattgcttgttttgtttaccggcaaaggctacagtatgctaattcagctttcgactacgatgattttggtgccttatttcttagtcggcgcttatttattcaaagtggcaataaaacaaaacgaagcatggtatatcaaactgactggtgcgatggcgtcaatttacggtttatggattgtttatgctgcggggttagactacttattattatcggttgtgttatatatgccgggcgttcttttatttttccacgcacgttataaaaataccggtaaattacagctaactaagtcggaactgttattgctcgctattattttactgctatttgttggagcgatttacacgcttatcactcaataattcaggaacagacatgaaaacagcctttgcagaaaaagcggtcgcttttcttcgaatttttgcaaataaaatcgttgaagtttcacgtcaattacaagacttttttaacaacggatcatttggggttgccgtgtatccgttttttatgcacccgctcattcgcggttgtggccgttttattgttgttttattagccgccctgctttcatttatgggcgtgttctacctgtttgccgagtttgtggttaacctctttagcgaatcatcactcatcagttatattcgacatacagtgttagagttacttatccctttcggcacgattattgatggaaaaaccaataccttttcaccgttatcgcaagtgatgaatgcggtttttagcttacagggattagcttttgtaattgcatatcttgccgtgatcgtgcagctatctcgtcgtaaatattggttattagcgcttatttttgcggctttctttagtatcggaatgagcctaatcccttcatcacaagctaaaatcactgccggagggttacaaaatttaggggcaagtctaacctatttattcggtaacttagcaattattatggtgggaattgatattgttaaaccgcagcttgtctggctacgccgttttagtattcaagccggtacaatcggcgtattttgcgtactcataacaatctttttcccaaatatactaacaccaatacttgagcgaatagctatctatgcaattatgatttgggaaattctcgccggtctagcaatgttaaaacgtaaataaaaagagaaagtattatggcaaacacaaaatttatcgaacgttaccgcaatttaattgcgctgccgactatttccagtttagaagcggcggaagatcaatctaacaaacaacttatcgaattactggcaacttggcttgccgatttcggctttaaaaccgaaattatccgagtggaaggcagccgtgataaatataatttattagccacttacggtgagggcgaaggcggtttattattagctggacataccgatactgtaccgtttgacgaaggtaaatggactttcaacccgttcgcattaacagaacaagacggcaaattctacggtttaggtacagcagatatgaaaggctttttcgcatttattgtcgatgtggttagccaaattgatttaagcaaactaactaaaccattgcgtattctagcgaccgctgatgaagaaaccaccatgcttggcgccagaactttcgcccaacatacgcatattcgccctgattgtgcaattatcggcgaaccaacttctttaaagccgattcgagcgcataaaggccatgtcggtgaagcggtcagaattaccggaaaaagtggtcactcaagtgatccggatcgtggcattaatgcgattgaattaatgcaccaagcgactggttatctgatgaatatgcgtaatcagctacgtgaaaaatatcataatgatctgtttaaagtgccgtatccaacaatgaacttcggcaatatccacggcggcgatgcaattaatcgtatttgtgcgtgttgtgaattgcaattcgatatgcgcccgttaccaaatctatcggttgaagatttatatgcgatggtgaatgaaaatctgaaaccgatgttggaacaatacggcgatctaattgaaattcgtcacttacatgacggtattcccggttatgagtgtgaacattccgcacaagtggtgcaagtggttgaaaaactgttaggcgaaaaatgcgatgcggtaaactattgtaccgaagcaccatttattcagcagctttgcccgactctagtgttaggtccgggatctatcgaacaagctcaccaaccggatgaatttttggaaacgaaatttattgagccgacccgagaattactcagcaaactaattcatcatttctgtttataaagtctaaagagaatgaccgcctacccaattggataagcggtcattttttattgaaattttgcatatttattcaaatatatctatgcactacctatgcagacatatcgatgcaaaattcagggacctccctgcccctcttccaagaataaggcaaacggttattgtgtagagagatgactaaatagccgtttgcttacattctttgttagaagttgataccaaagccagcaaataatacaaccggatccagttttaatttcacttcgtgttttgcgcctaacgcatcaaattttgcagttgttttaatgcgtgtgtaccatgctgccgcattgaaagaaagtttatcggttaatttcacgtccacaccaaggtttgcaaccggtgcaaatgaatgttttttcacttctaaattggttaccgctgcgtgagttgatttcgcattaaagaaacgtgtgtaatttaaacccgcaccgacatacggacgcactgtcgaatccgcattaaagaaataatattgtgcatataagcttggcggtaattgtttcacaatcgctacacgacctaaaccagatgcagcgcctaaagccggcacatttgcattaattttatgcgagaatggggttgcacctaataactctaccgcaacattatcggtaaacatataagttgccgttaaacccaattgttggttatttttcacttttaaatctacttgaatcggtgttttagtcgttgattctgaatttgcattcactcttaccacaccggcacgaacaaccacatcacccgcttgatgtgccactgctgaacccgctaataacgcaccacttaacatcactgccaacgctacttttttcattttgacctctaatttgttgtgattgaaaataaaaaggtaaccaatctgttaccttgataacattttaagaacagatctgataagttttattgacgaaaatcaaaaaaactacaaagtaatacctataagggggtatttattccttttttgtgatctttttcacattttaacttgaaataaattcgactagctccatttattaaagcgttgaagcgagtataaatcttgctcgatacagattaatgaaatttaggagtaaaaatatgaatttcgaaaaatttactaccaaactgcaagaagctcttgcagaagcccaatctttagccatcggaaaagataataactatattgaaccggcacatttactttatgcgttagtcaaacaacaagacggttctatcgccccactatttaccgcgctcaatgtgcaaccgcaacgtattttgagtgaattagagacgattttaaaccgcttaccgaccgtatccggcggtacaacccaaccgtcacaacaactgattcgcctgttaaatcaatctgataaattggcacaacaattcggcgatagctttatttcatcggaattatttgtacttgccgcactggacgataacggcgatttaggcaaattattaaaacaatttggcttaactaaagagaaagtaaacaacgcaatcagccaaattcgaggaggagaaaacgtgaataatcaaaacgcagaagaaaccagacaagcccttcaaaaatataccattgaccttaccgaacgagccaaagctggcaagctagatccggtaatcggtcgtgatgaagaaatccgccgtgcggtacaagttttacaacgccgcactaaaaataaccctgtattaatcggtgaacctggggtcggtaaaactgcgatcgtagaaggcttggcacaacgtatcgtcaacggcgaagtgccggaaggtttaaaaaataaacgtgtgctttccctcgatatgggcgcattaattgccggagcaaaatatcgtggtgaatttgaagaacgtctaaaagcggtacttaatgaattagccaaagaagaaggtcaggttattttatttattgatgaaattcacactatggttggtgcgggtaaaacggacggcgcaatggatgccggtaacttactcaaaccgtctcttgctcgtggtgaattacattgcgttggggcaactacactagatgagtatcgccaatatatcgaaaaagatgcggcacttgaacgtcgtttccaaaaagtattagtggatgaacctactgtagaagatacgattgcaattttacgtggcttgaaagaacgttatgaaattcaccaccatgtacaaattaccgacccagcaatcgtagcagcggcaaccctttcgcaccgttatatttccgaccgtcaattaccggataaagcgatcgatttaattgatgaagccgcatccagtttacgtatggaaatcgattctaaacctgagccgttagataaacttgaacgccgtattattcaacttaaattggaacgccaagcgttacaaaaagaggaagatgaagcaagtcgccaacgtcttgcaaaattagatgaagaattgaccgctcgtgagcgtgaatattctgaattggaagaagtttggaaagcggagaaatcagcattactcggtacgcaacatatcaaaactgagttagaatatgcccgtattgaaatggatcaagctcgccgtgaaagtaacttcgaaaaaatgtccgaattacaatacggtaaaattccggcattagaaaaacagttagctgaagcggttaaacgtgaggaagaaggcggagagaatcaactacttcgtaccaaagtaaccgatgaagaaattgcagaagtgctttctaaagcaaccggtattcctgtttccaaaatgatggaaggcgagaaagaaaaactgttgcgtatggaagaagtgttacacagccgtgtcatcggacaaaacgaagcggttgaagccgttgcaaatgcgattcgccgtagccgtgccgggttgtcggatccgaatcgtccgattggttcattcttattccttggcccgactggggtcggtaaaaccgaactttgcaaaaccttggcgaatttcctcttcgaggatcctgatgcgatggtacgtatcgatatgtcggaatttatggaaaaacatagcgtttctcgtttagtcggcgcacctccgggctatgtcggttacgaagaaggcggctacttaaccgaagcggttcgccgccgtccatattcggtcgtactacttgatgaagtggaaaaagctcatccggacgtgtttaatatcttgcttcaagtgttggatgacggtcgtttaaccgatggtcaaggtcgtacggtagatttccgcaatacggtggtgattatgacatcaaacttaggttcgcatttaatccaagaaaacccagaattggattacgccagcatgaaagaagtggtaatgtcagtggtaggacaacatttccgccctgaatttatcaaccgtattgatgaaactgtggtgttccacccacttggtcaagagcatattcgtgcaattgctcgtattcaattacaacgtttaatcgctcgccttgcggaacgtggttacgaagtgacagtcacggataatgcgttggatcatatcggcaaagctggctttgacccgttattcggcgcaagaccgcttaaacgtgcaattcagcaagaacttgaaaatccacttgcacaacagatcttaagcggtaaattattaccgaatagccctgttgtggtggactatcaaaatgatcaattaagcattagcaacagctaatcttccataaacaagcggtcgaatttgcacaaaattttgcaaattcgaccgcttttcttttaggtgttataacgattaatccaccagactaacgacagcataaccggtacttcaaccaacacaccaacgaccgttgctaaagctgcgccggaatgtaaaccaaacagtgaaatcgcaacagccaccgctaattcaaagaaattactggtaccgattaaacaagccggcgcagaaatttctttcggtaaatttaaccatttcgagagtaaatggctaagaaagaaaataccgtaagtctgaaccaataacggaattgcaatcagtacaataatcagcggattggctaagattgtttccgcttggaatgcaaataataacactacggttaagatcaaccccatcatcgaaaatggctttaatttattgccgaattgggaaatagagcggttagatttcagcaaaattttgcgagtgacactgccggcaactaacggcaacaccacataaagtagtgtgctatataacaatgtttcccaaggaatcgtaatatcactcatccctaacagaaaaccggcgatcggagcaaaagcgaaaatcataataatgtcattcaccgatacttgcaccaaagtatagttcgggtctccttttactaattgagaccaaacgaaaaccattgcggtacaaggtgcaacaccaagtaaaatcataccggctatatattcctgagccgtttgtgcctcaacccatgaagcaaacaaaaagcggaaaaatagccagccgactaatgccattgtaaacggcttaattaaccaatttactacgatcgtcattgctaaacctttcggctttttacccacatctttgattgctgaccagtcaatttgaatcatcatcgggtaaatcatcagccaaattaataccgctactggcaaattaatatgtgcaatttccaataatgctactttttcgaccgcttgcggaaatgctacacctaatgcaactccagctgtaatagctaaggcaacccaaattgttaaaaaacgctcaaagatccccattttattcccttattaatgattaaatacaatatcgacatcttcggatttatcatgtacaccaaatttatcaacaagcgtttgactcgcttcatttaaaccgaatacttcaacttctacaccggctttacgatatttaagtaccactttatccaaagcagcgattcccgtaacatcccaaaaatgtgcgtgggtgagatcgatactcacttgcttaactgccggattgtcataagtaaaactattaataaaatcatcagacgaggcaaaaaatacttgtccgataacgccgtatgcaagcacagaatcattctctgtcggtaatgatttaatcagcatataacgtccgattttattggcaaagaacaatgctgccagcaatacgccggcaaaaacgcccaatgctaaattatgggtataaaccactacggataccgtaaccaacattactgcattaaagcctatcggatgcgtttttaaatctctaattgattgccagttaaatgtaccgatagataccataatcattaccgcaaccaatactggcattgggataatttttagaatatccgccaaaaatacaaccataattaataaatagataccggctaaaaaggtagaaagtcgtgttcttccgccggattttacattgataaccgattgaccaatcatggcacaacctgccattccgcccataaaaccacaagcaatattggcaataccttgccctttacattctctatttttatcactttctgtttcggtcatttcatcaacaatggttgccgtcattaatgactcaagcaaaccgactgccgccaaacttaacgaataaggtaaaatgattaataacgtctctaaattaagcggaatattcggtaataaaaacaccggcaggctatccggtaattcccccatatctccgatagtacgtacatctagccccataaaatagctaacaatagtcagtacaacgatcgcaacgagaggtgatggcaatattttgccgattttaggcaaataaggaaaaagatagataattcccaatgccgccgcaaccagtgcgtaagtatgccaagtaacattggttaactctggtaattgggcaagaaaaattaaaatcgctaatgcgtttacaaaaccaactaccacagctcttgcaacaaaacgcattaatgaccctaattttaagaacccggcaataatttgaattaccccggttaaaattgtggctgccaatagatattctaaaccgtgacttttcactagtgatgccataactaacgccattgcaccggtagctgccgagatcatagccggtcgtccgccggcaaagctgattaccaccgcaatacaaaatgatgcatataaaccgactttcggatctacgcccgcaataatggaaaaagcaatcgcttcaggaattaaagctagtgcaacgaccagcccggaaagggaatctgctcgaatattagaaaaccattgttgttttaaagtttgttgcataaaaaattcttacccctaagttgtttctaaattattaattatttcaccatcttctttaataaaaggtttattcaatgaaaccggtgagatttccaaaaatttttcagacggacgacaaagtcgaacacctttgcttgtgataacaatcggacgatttattaaaatcggttcagcaagcatcgcagcaattagttcgtcatcactcaattccatacggcttaaatttaatgtttcatagggtggtacattcgtccgaagcagatcccgcacacaaatccccatttctgaaattaagtttcgtagtgtcatctcatcgggaggcgtttcgaggtagtgaataatcgttggctcaatgcctaagtggcggattaacgctaatgtattacgagatgtgccacatttgggattatgataaatcgtaactttttccatattttctccaatatttcaatatttattgaaatgttaaggtaaaaaattttgtggacattcacccacaaaatttgcaattcggatcatcgctttctttacaacaattcgtagttaaaaaagccaccagctccatcataagtgctaaatttgcataataatgcacaaatctacccgcttgttggctatgaattaagccggcggtagccaatgtttttagatgaaaagaaaggttattcggtgcaatacccaactgcttagccaattctccagcaatcattcctttactgccttgagcagcaagcttctgaaaaatttgtagtctgatcggcgaattgagcgtaccaaatacttgacttgcgtgttcgatattcatagtaaaaattataacgttctatgtttatatttcaagaattattgaaatgtttaaataaaaacaagcggttgaatttgtagaaaattttgcaaattcgaccgcttgtcagtttataaaactaagctaaaactactcttcttcagtaaattttgcagctttataggttgggttcattaagttttcaacagaaagaatatcatctagttgcgcttctgtgagtaaaccacgttctaacaccacttcacgaacacctttgcctgtttgtgcacaaattttaccaacaatatcaccattgtgatgtccgataaatggattgagataagttacgataccgattgaattaaacacaaagttttcacaaatttctttgtttaccgtaatgccatcaatacatttatcacgtaaattcacacaagcattagcaagaatttcgatagattcaaacattgcttgaccaattacaggttccattacgtttaattgtaactgaccagcttctgccgcaaaggtgattgttgtgtcgttaccaatcactttaaaacatacttggttcacgacttccggcacaaccggattcacttttgccggcataattgaagagcctgcttgtaattccggtaagttaatttcgtttaaaccggcacgtggacctgatgaaagtaaacgtaagtcattacatacttttgaaagtttaaccgccgtacgttttaacgcaccgtgcaccatcacataagcaccacagtctgaagtcgcttcaattaagttttctgataatacgcatggtaaaccggttacttccgctaaatgtttaaccgctaattcagaataaccttccggtgtatttaaaccggtaccgattgcggttgcacctaagtttacttctaacaataatttagcggtacgttttaaattacgtacttcttcttccaataataccgcaaacgctttaaattcttgaccaactgtcatcggtacggcatcttgcaattgggtacgtcccatttttagcacatctttaaattcttccgctttcgcttcgaaacctttttgtaaataacggacttttttaattaaatgtaagatactattatagaccgcaatacggaaaccggttggatacgcatcattggttgattggcttgcatttacgtgatccatcgggttaaccacgttatagtcacctttttgatgaccgagtaattcaagtgctaaattcgccaccacttcattagtgttcatattcactgatgtacctgctccgccttgatatacgtctgacggaaattgatccatacagcgacctttcactaaaatctcatcacaagcttcgacaatcgctctagccacttttttcggaatcgcacctaattcgccattggctaatgcggttgcctttttaaccatgaccataccacgtacaaattccggtacatctgaaatggtgttttttgaaatattaaaattctcaaccgctcttagtgtgtgaatcccccaataagcatctgcaggcacttccctttcacctaataaatccacttcaacacgtacgttattcatatactcacctcaaaaaataaaaataataggtattaaatctggtggagatcataacgatttagcataaaaagaaatgtgatctatgtcatatttcgaaaaagagcgctaggatataaattaaggtttcggattagaaattttaatgattaaaaatcagaaagtagtaaccggcaggcaacgcaattagccaaaacagaccagaaataatcaccgctgcatgaaactgccaatgtttagttttatgacgaatatatttcattgcaagaaaagtcccgataaatcctccggaaaaacaaaggaagaatagattcgactcaggaacacgccatgccttgttccgcgatttttgcttatcagcatacattagataaaagctacttagattgataatgagaaaataaataaacagaaaaataaacataaatagtatctattaattaatcaaggatatccctttttacaattaaaaatggaagtaacagtaatgaaatccctaagctacaacatataactacggtaaaaaaaccactccaatgaaaattatctaggatcaatgctagagggtaaccagctaacccagctcctaaataagcgaataagccaacaaacccagttgctgcccccggagaaagtttatgtgaacattctgccgctgccataccaattaacatctgaggtccgaatacaaaaaagccaactgcaaagaataatatgcattgcaataaataactctcttttggcattaaccataatgccgtaatcgaaaagaaaatacctactgaaaaaattaatgccatcggacttcgattacttaaaaacagtttatcggatccccaacctgccgctaaagagcctacaaaaccaccgatttcaaaaaatgttattgcactattcgctgcaattaaatcatagtgatatttttctgttagatagatattaccccagtcattgatagcggtacgcacaacatagaccaacgtgtaactaagcgctagaagccaaatatacttattacaaaagacataacggcttaaaatatgtctccataaaagtgttttttcttcctcttcatgtaccaattcaagatgatcgtttctccattgacctattgagggtaaccccattgattccggcgtattgcgtaagcgaagaagcagaaaaaagccgataaccccccctaaagcacctaccgtaaaaaagccgactcgccagctataatgtaacgttaagaatcccactataattggaactagtgcgccaccaaaattatgtgccgtattccaaatagaccaccaaacacctctctctttacgggaataccacatcattaatagtttagcgcacggaggccatccccatccttgaaaacaagcatttacaataactaataatgtcagcaaaattaatgaactagagaaaccaaataaaagatttgttatccctgtcataattaaacctatcgccataaaatatcgaggatttgctcggtctgagaaaataccaaataaaaatttagataagccataagttaaataaaataatgttgaaataataccgatatcattcttatctatatgtaaatcattaattagtgctggtgttacataattaaatgttttacgcgtcaaataaaaccctgcataaccaatatacatcgcgaccattaaatggacgcgccaatattgatatttatgatctatataatttaactttgccattcctttccctatcaaattaaaggtaatgtaataaaaatagaggtaccttgcttatcattattttttatagtgttagatacaatcttaaattttccatctaagatttccactctctctttcattcctttcaaaccgaacccatccataatttcatcgggattaaatcctattccattatcataaatagataaccttatatccttttcaataataattgaaataccaatttctgatgcttgagaatatttaagagcattattcaatccttcctgacataaacgatacaaagtgatttctaaaacatgatctaattgatgcttaaatttattttcaaaaatcaactttgttcttactccttgcttagatatatcaagttctataaataaattttgaatcgcctgataaagacccaaatcatccaataatttaggtcgaatacgatttaatataccttttgtcgtatcatagatatttagagataaatgctcgatcatttctgcacatcgttgcgaatgctcagatgattccagtttctttaaaatactcgattgcatccgaatagcagtaatattttgtccgatttcatcatgtaattccctagagatatctttacgaatttcttcttctgtatttatcagttttttcgttagtaatttatttctgtttaattctatagataaataggtatttagttccctttgatattgcacggataaaccaagaaaaatcccagtaattgtttgcattagaataagcaataataaatctgtaatttcaacataagaaaagctatgagttgtcgcaattaaagcaatgctatttaataaagttccaagcaaagccccctgccagccataatgaaatgcaagcaaaacaataggaatagctaaacaaaaaatagcaaaccgagtaaactcactaggcataatggattgtataaggatatttactataaacagaatagcgtatattaaaatatatcctatgcgtagtcttattggtctttttatataatttgcagtaaatggaatccacgatttattaaaaacataatcgtaaataagtgaacaagcaggtaacatcaatacgccaccggttaaactgactaaaagaacagaagaaatcccaaaatcagcccaagccattacaataaaattgcataagctaataatggtaactaagcaggcttgaataaaaaactttctccattgttttcctgaataaaattttttaaaacaaaagacaattgggatagaacagacacttaaaatatataatattaaaatacttatatcggaatatgacttaaaaataaaataaagaaacacccattcagaaaaatagccgatccaccaataccgaatattggtatgtaaagataaccctaccctaaaagaaaaaggcaaaaataaaactgctaaaatgggatcttttaataaataatcagatatgacccacaaacacaaatagctacaaaatataaaaaaccaactgaaaatggcaatcatcttatcatccttgctgatgaaataattttgcaagttctacattattcttcacatttaatttactcattgcattatccctatgcacataaattgttttaacacttaaagataatttttctgcaatttcttttgtatccaatcccaaaattaataactcacagatttcatactctcgtttcgttaagtttctcgttaagcttaatttacttgaaactaacttcgtcgttaattcaggcattaaatatacgcctcctgaataaactgttctaaccgcttgtattagctcggatgggttacatcgcttactgaggtagccttttgccccgagttccaaagctttacgaatgataacagcagaatcattcacacttagcataatgcaatgaattgcagatggaaggtctttcagaagctccaaaccgttttcatccggcatcgaaatatctaagatacaaacatctggtttaatacttggcatttttaaacgagcttcttgcgcactggaaaattccccaacaacttgaatatcttgctctagtgataataattgtgaaaagccggaacgtacaatagtgtgatcatcgatcaaaacaactctaatcatattttctccttatttatatccgattataaacaaaaaaggctatcttatcagatagcctttatctattttcactatgatttcactttatttcgacgaattttacgttcctctgcaatagcaacaaaggcaagtaaaccgatacatatcaccgctgaaatatcaagggctgcgaaggtacccgcccatccggttaacccaaagattggcgtaccgtctgcaatcatacctaaacctaatttagcaaaactatcaccaatcaagtaagcaaatgtcccttttacaccgtcagccacagcaattgcttttttcggtacaaatccaaccgctgccacgccgataagaagctgaggaccaaataccaagaagcctaacacaaataatgctaaaagatacatatattcgtttgtcgcaaattgataaaactctagcatgaatacgatcagaactaatgccacaatcgcagttaaaccacgacgaccattggcaagatcagataaatatccccataagaatgttccgactaaagcaccgacttcaaataaaacaaacccagatgttgccgcttctttagtaaagcctagctcttgatatgcatataccggtgaccattgatcgataccaattcgaacaatgtaaaggaagatattagcaaagcaaagtagccaaattactttatttttcaaaataaactgaacgaagatctgccatttagttaaattatgtttttccgcagccaaatcttcttcgctggctggttcatcaaacaattcttccgctttacctaagccgtaagcttctggcgagtcattcccatatcgtaaaccgacaaagccaacaattagtgcaataattgatgggaaaacaaacattcctataacatgtccatcaaataatacatttgcaccgaataatgcaacaccggcagccgccgcaccacctacattatgtgataaattccaaaagcctaagtaagtaccacgttttttacttggtgtccattttgtaattgtagaataacttgatgaaccgccggtactttggaagaaaccgcttaatgcataaaatgcaatcattaagaagagtgcaacacttccaccgccgagactcatactaaaaccaagcatacaaatagcggagagaatcagcataaacggtacaaattgttttgtatttttgccatcggcgtaataagaaacgactgttttaccaataccatatgtaatcgaaaaacctagtccaatcatacccagctcggttttggttaaaccgtacgtctcaatcaaatcattttgagcaacgttaaaattcttacgaatcaaatacattgccatatatccaataaatacgactaaatatgattgcataaatggcttaaaccacatttttctgcgttcttcaattggtaaatctaaggttggttttctaacctcttttaaaaaatcaagcataggaacctcaattattactaatattgtcaatgagtgcgatcctatgctctatttacataaaaatcctgagaacaaattctagaaaacctaagaatttttcctatgtttcatttggtaatttaaaatttgtgatgaagatcacgttttattccccaaaaaaagaccgcttgtaatgctgttacaagcggtcagattttttagtttttttgcaaattagataatttcaacttgttctgagccatcacctaagttttcaattttaccgatcacccaagcgttttcacccgcttgttttaatacggctaatgcagtttcaacatctttttccggtaatgcaatcaccatacctacaccacagttaaaggtgcggtacatttcataacggctgatattgcctttttcctgtaaccatttgaatgcagccggccattcccatgatttttcatcgatcactgcttttacggttgccggtaatacacgtggaatattttcccagaagccgccaccggttaagtgcgcaattgcatgcacatccgcttgtttaatcaattgaagtactgatttcacatagattttagttggcgctaataaatgctcacttaacggtttaccttctaatgtatcggtagccggattcgcaccactaacttcaatcactttacgaattaatgaataaccgtttgaatgtggaccgcttgagcctaatgcgattaatgtatcacccgctttcactgctgagccgtcaataatttcagatttttctacaacaccgacacagaaaccggctaggtcgtaatcacctgcgtggtacatacccggcatttctgcggtttcaccaccgactaatgcacaaccagagatttcacagccgtccgcaatacctttaattacatctgcagcaacatctacttctaatttgccggttgcataataatctaagaaaaataaaggttccgcaccttgtaccactaagtcattaacacacattgctactaagtcttgaccaatagtatcgtgtttattcaaatcaatcgctaaacgtaacttagtccctacaccatcagtacctgatactaaaattggttctttatatttagtcggtaatgcacatagtgcaccaaaaccgcctaaaccgcccatcacttccggacggcgagtacgtttaacatccgctttgatgcgttcaaccaattcattgcctgcgtgaatatcaacgcctgcgtctttatagctaagttgtgtgttgctcacgattaacctcaacagaaaataaaaaactcgctctattgtatcacaaagcaaacgtttgcgttaatcaattaacataaaacttacaccgataagacaaactttaacctgttttaccgaaatcccttgcactcttccttgccatagtcttttcttagacctgaaatcagataaaataaacacctatcatttaaataaatgaacaagtaaaaaatgatatttttaatattataaataagaagaattattttaaattgttattgtcagacgtacacccttatttaattagcaaacacctatgaaaaaaataatctcattactgactttaatttttatcggattactttcctcctgctcatcatccactgttaatgcaatgaatcactcacaaataaaagaagcgggactaacccttgatatagctcgccgtttctatccggttgaaaccataaaacaatttatcgatacaattcaccatgcaggaggtacattcttacacttacatttttcggaccatgaaaattatgcgttagaaagtacttatttagatcaatcggaagcaaatgcgatagttaaagacggtacttattataatccaaaaaccaataaaccttttttaacctataaacaaattcacgatattatttattatgccaagagtaaaaatattgaattggtgccggaagttgatacaccgaatcatatgacggcaatatttcgactacttgaggctaaacacggtaaggattatgtcaaaaagctaaaatccaaaatgaatgatgaggaaattgatataactaaccccgaatcaattgaagttattaaaacattaattgccgaagtgatttatatttttggacatgccagcgaacattttcatattggtggcgatgaattcggctatagcgtagaaaccaatcacgaatttattagctacgtaaatacgcttaatcagtttattaacgagaaaggcaaaattacgcgtatttggaatgacggtttaattaaaaataatttaaatcaattaaataaaaatgtagagatcacttattggagctatgacggtgatgctcaagaaagtcaagatattgcagaacgccgcaaaattcgtgcaaacttgccggaattactcgaaaacggttttaaagtattaaattataattcgtattatctttattttgtgccgaaaggtaatgccaatattacgcatgacagtaaatatgcaacagaagatgtattaaataactggaaactcggtttatgggatgggcaaaataaagaaaatatggttgaaaataccaagaatattatcggttcttcgctttctatttggggagaacgttcaggatcattaagtagtgaggtgattgaggagtccacccaagatctattaaaagcagtgattcaaaaaaccaatgatccgaaatcgcattagaaaacgattgaaaattctgctattatagcctctcgacaagcggtctctttttgcaaaaaacttgcaaattcagaccgcttattctttctcgtggttcgaaaacctcccacgccaaagactctctttgaaaccaaaactaaggatacaaaatgaattcaactccaaaagccgtcgtgattttttccggcggtcaagactcaaccacctgccttttccaagccattcaagaatttggtgtggaaaatgttgaagtggttacctttcaatatggacaacgccacgcaattgagctggaaaaagcagcctggatagccaaagatctcggcgttaaacaaacgctaattgatacttccgtgatcaaagccatcacatctaacgcaatgatggaagaacgtgaaattaagcaagaaggtaatacgccaaatacctttgttgacggtcgtaatgcgctgtttttactttacaccgcgatttacgccaaagggcaaggtatccaaactatttttaccggtgtatgcgaaaccgactttagcggctatccggactgccgagatgtgttcgtgaagtcaatgaatgtcaccttaaatctggcaatggattacaatttcaatattcgcacgccgctgatgtaccttactaaaaaacaaacttgggcattagccgataaactcggtgcgttcgactatatcagacagcatacccatacttgctatttaggagtagaaggcggttgtcacacttgcccaagttgcgtattgcgtgaaaaagggcttaatgagtacttatcagaaaaaacaagcggtcaaaaaaatgtttaaaattgcaaaagaatttagtttcgatatggcacatatgctcgatgggcacgacggcaaatgccaaaacttacacggacatacttataaacttcaggtggaagttagcggcgacttagttgctgaaggagcgaaacgaggcatggtgatggattattccgatttaaaatcggtagtgaaacgtgaaatcttagacccgatggatcacgcctatatctacgatttaaatagcgacagagaaagccaagttgccaaactattaatcgatttaaactctaaagtttacggtattccaagccgcacgacagcggaagaaatggcgaagtatatgtttgaaaaactggaaaaagtcggtttaccggtcagtttaattcgcctttgggaaacaccaacctcatattgtgaatattctcgttaaacactcctatctaataatatagagtataaatcttaacctcgatattcccctctttagtaaagaggggttaggggagatttgtaaaaattatgacaaatactatttttacgacaacgactttcccgattgtcgaaatctttgaaagcctgcaaggtgaaggctttaatacaggcttaccttgcattttcgtgcgtttaggcaaatgtaatcttgcttgcccgtggtgcgataccaactataacgaatacgaaaaatggagcgtggcgaaaattcttgaacgagtaaaatcttattccgccaagaatattatcattaccggcggcgagcccacgatgtatgccaatttaagcgtattactcgatgtgtttaaagcggaaggttattggttggcaattgaaacgaatggattaaaagccgtaccgaaacagattgattatatcgccactagcccgaaactgatgtatcaagaaaaatatttgagagaatgtatttcgtttgccaacgaagttcgtatcgtgatggataaaggcgatgtacaaggtttttgtgaacaaatcgaaacacaaattaccgccgaacattactacctttctccatgcgaagtggacggcaaaatgaatttattggaaaccattacccaacttggtattttgaatcaacgagccaataaacccaaatggcaattgagtttacaaactcacaaattggtcggtattgaatagtaccaatatgataaaggcatcgaagatttctctccgatgccttttgctttaatcagtataagaaataataaacttattctgctgattttttattgaataatgtgatagcaataaagccgaacgctaagaagcttgaagcaataagtgcatagaaaccaccgtcccagccatataagtccaccaatttacccattacccaaccggcacttgccgaacctaataagtaaccaaataaaccggttaaacctgttgccgtgcctgttgcaacacgaggcactagatccgctgcctgtaagccgatcatcattaccggaccatagataaggaagccaattgctactaagcagatattatcaactaaaggattacctgccggatttttccaataaacaataatcgcaattaatacgccggctaaaaacattaacattggcggcgcacggtgacctttgaatactttgtcacttaaataaccgctggctaacataccaaagatacccgcatattcatataagaagtacgcccaactttgtttatcgaccgagaaatgttttacctcttttaagtaagtcggcgcccagtcaataatgccgtaacgaataaagtaaacaaatacgttagcaatcgcaatggcccataagaatttattattgatgatatatttacggaaaatatccattgccgaaagtgtatctgccgattcaactttctctaagactttttcaccacgccattcatctaccggcggtaaaccttgtgattccggtgtatcacgcattaaccagaacgtaacgaacgctaataaaatcgcaacgagtgccggtaaatagaaaagtgattgccaagtaccgaaaatagctaaaccaagaatcgctaacggaccgattaaaccgccacctaagttatgagaaacgttccaccagctccaccaactaccacgttctgatttagagaaccagttcgtcattgttttagcgcccggtggataccccataccttggaaccaaccatttaatgccgctaatacaatcatcattggaatagatgctaaaacacctggaactaaaccgaaaattaaactaacaattgccgaaccgagtaaaccaatagtaataaaatattttggatttgaacgatccgatacgttacccatcacaaatttactgataccgtaagctaaagataatgcaaccccaaccgtacctaaatccgctttagaaaagccatactcctgaatgaggtacggcatcgcaagcgagaagtttttacgaataagataataagctgcataaccgataaacacgccggcaaatacttgccaacgtaattttttatactccgcatcaatctcgcctgattttctcggtgcaggcggagatgcctttaagaacgaaaacatataagactccttattcataaaattgcaaaaacaacataaacacacacaaaagaaaataaaaaacgtcaaaatgtttgataacgagcattatatgtaaactaaatatcttcacaagcttacgaacttaaactagatcaaactttttacataaaaatacacatccatcttcctattgaacaaaaagccctcagatatcactatctgagggcttgcaaattttccttaaaaattgaccgcttattgattatttgctttattaatcaagaattggcttaacagtgaaaccggtctgccggttgcgcctttcgctgcaccggacttccaagccgtaccagcaatatctaaatgcgcccaagtatattttttggtaaagtttgataaaaactgcccagctgtaatggcaccgcctagacgcccaccaatattagcgagatcagcaaaattcgatttaagttgctcttgatattcttcacctaatggtaaacgccacgctttatcgtccgcttgttccgctgcatttaataaatcattcgccagcacattactggtcgacattaaaccgctgttgtgtgcgccaagcgcaatcatgcaagcgccggttaaagtcgccacatcaatcactaattccggctcaaagcgttctacataggtcaatgtatcgcataaaactaagcgaccttccgcatcggtattcaatacttcaacagttaaaccattcatcgtcgtcagaatatcacccggtcgatatgcattgccgtccggcatattttcacaaccggctaaaacaccgatgacattcagcggtaatttcatttccgctagcgctttcatcgtaccgtaaaccgaagcagcgccgcccatatcatacttcatttcatccattgagtcggatggtttaatcgaaataccgcctgagtcaaacgtcagccctttacccactaatacaatgggtttagcatccggattcgggtgattacgatattcaattacagacaaataagccggattctgtgaaccacgagaaaccgccaaataagcattcatcgataatgaatccatttccacttcatcaactatactggtttgaatattttcatattcagtcgctaaatctttcactaattcggcaagataagccggattacatacatttggtggacaatttgcgacatttttagcaaaagtgataccggttgaaatcgctttaccatgctctaatgctctttccgcatcagctaaatctttacgattagcgacgttaaaaatcacacgacgcaattcccgacgcacctcaggcttaatgcttttgaaatcattataagcatataaactttcctgaatcgcttctacggcaaaacgtacattccaataggttgatcgcccttttacatgtagctcagttaagaaacaaaccgcttccattgagcccgtttcgttgatggtttgcaccattttttgaataatctgcttatattggcgctcatttaactctcgttcttttccgcaaccaacaagcaatatgcgatctgcaggtacattcggtacgttatgtaacaaaagcgtttggcctgctttaccttctaaatcgccgcgtcttagtaaagcactaatataaccttcacttaatttatctaattggtctgctgctgcagaaaggcggcgaggttcatatacgccaaccactaaacacgcagtacgttgtttttctacgctaccattttttacgctaaattccatcactacctctttatctcaaatcggttaaggccaaaagtaacgctgagttactcgtatcacaagtaagctacctatttatcgagtaaattacaagtagaaaataacagaaatgaaaacttcatcgaaaaatctccctattttgaagaaaatcatagtttttctcaaaataccataaaggattcatagggttagtaatcttaagtcggtacaaaccacgtgagctcgcccatttttcaccgttgcaagaggcttgccttttcaaggtgttgttttatactaattaatctattatttatgatgaatttatcggcaaataaattgtcacaattaatctataaaatcataaatggaacttacaatgaaaaaattaatgaataaaacttttcttaccggtctcgtatgcctatttgtcaatgcgccagtattagcagacgacaatgcgttatttaatcgctacgagcaagctaaactccgtattgcttatgaaggacaagcgggtgaattattacaacaattagcacaacgcttaaaagttggctttattacttatgagttagatacaactcgttctgtatcgattccaaacaatggtgaagtaacgattaaatctcttactcaacaattggaatcgcaattaccgaatacggatattcgttttgaaaaaattggctctcgtttatttttagtcgcatcgaataaaggtggtgaaccgctagttgctcaaaaacaaagcactgaacaatttattggtgaagcgattttctcttctgatgaagaatcagcaccagttactgtaactactgcggctacagcgcaaactaataatacttcggcacaaaccagtgaaagtgcgcagaaattgcaaagtattattgatatagtgacgaataaagaggcgattgcaaaatcaaaaaataaaacgcctcaatatcaagttgccggtaaagagaagttaggtttacaaaatatccgagttacacctttagggactttcttagtgtttgccgataacgttaatgtaaaagctttgcgtgtcaccggcagatttgaagatatcgcacaacatgataatttaattgctatcgtgcataaagagcgagcgtcaccggcagaaatcgaagtgactgataagaatggtaaaaaattactcttaaaaaaatcaatagtaaaatctaaatgacctaaagccccggacttcggggcttattaatttaccggcagagaaaatcctttcgtgattttttaatgcaaaaaaggtatgattagtaacttttataagcggtctattttcactcattttttgcaaatatatcccctgttcggcaacaatgagcggaaacatatcgttttaccttatctagttaaaccgtattaacggtgaaattatctcaatgagagtgttatcgtgattttaagtcgatatttaacgaaagagatcttcaaaagccaattagcgatcttattcattttgttattaatgttttttagtcagcagctgattaccgtgctgaattctgctgtcagcgggaaagtaccaaccgacttagtactgagtttattaggattagggatgcccgctttagctcaatttatgttgccgctttcactatttgttgcgttactgctgactttagggcgcttttatactgaaagtgaaattaccgtgatgcgagcgtgcggtatcgggcaaagtttattaacccgagtagcgtttttcttatctatttttactacggctcttgcagtatataacgtgttttggctcacgccttgggctatcaataagcaaagtgaaatgttagcagaggcgaagtctaatccacgtttttcagcattgtcagccggtcaatttatgaccgcaggtggttacgttttatttattgaaaatattaataacgaacaaaataaattaaacgatatttatgtgttccaaccggatcaacagaagaaaaatcgcccttccgtagtggttgcggaatccggtcagttacaaggtttaccaaacggagatcaaattctcacccttgaaaacagtacccgctatgaaggtacggcaaataccgcagattttagaatttcccattttgacaattaccaagcttatctcggctaccaagatgtggattcgaatgaaaaattagtacaacgagcggatttcaacaaattaatgaccgattcatccaacgaagctaaagcagaattgcaatggcgctttgcactaatttttgccgtaccactcatggcattattagccgtaccaatgagtagcgtaaaccctcgtcaaggtcgtttcgctaaagtgattccggcagtattgctgtatttgatctatttcttgctacaaagctcactcaaatcttccggtgcttcgggcaaattagatgcgacattattaatgccgttagtatcgattgcattctttatactggcaatggtgatgaacttctgggatacaaaatggatgtcagcaattcgttattctttcagtcgtaataaggcggtggcgtaaatgaatttatttggtatgaatattcttgagcgctatatcggcaaaaccattattacgatgatttttgccgtgctgctcatgtcgagtggcttagtgtttatcatcaaattagtcgaagaatttaaagatgtcggtaaaggatcttatgacgctttaaccgccacttactattcacttttaatgctaccaagcgatattaaagagtttatccctgtggttgccttaatcggcggcttattaggtttaggaaaccttgccagccgtagcgaattagtagttatgcaatcttccggattttctcgttttagaatcggcttagcggtaatgaaaaccgcaattccactcatcgtttttacgatgctagtcagcgaatggggaatcccgcaaaccgaacaatatgcccgtaatatgcgttccatcgcacaaagcggcggttcaatgctatcaacgaaaggcggcttttgggcaaaagacggaaatgattttatttatattcgccatatcgaaaatgaacgtaaattaaataatctatcgatttatcattttgaagataaatctttaaaatcagtcactcaagctcagaatgcggtttttaacggcaaaaattggacgcttcagaatgtacaaacatcttcgattaccgataacagtattcaacaagcgaaagaaatcaacaaagattggcaaacgacaatcacaccaagcaaattaggtatcgtatcgctcaaaccggaatcactttctatttcaggtttatccgattatgtcggcttcttgaaagaaaccggacaagattccaaacgtttccaaattgcgttttggcgtaaagtgtatcagccgatttcaatggcggtgatgatgttgcttgcgatctcgtttgtctttggaccgcttcgcagtagcgcaatgggaaccaaattatttatcggtatcatcgccggcttcgtgttctatgtatccaacatcgtgtttggcaatatgacactcgtcttctcatggataccggttgcgatcggtgcattaatcccaagcttaatctgtttaagtatcgtttggtggctactgaccaaaaaacgtgattaatccataacacaagcggttaaatttctgcaacattttgtttctatatatggataaatgtctgcgttgggtatttgaagctcttaaactcattgcttaaaagtgcggtgacattcaccgcactttttaactttaatctttgtaatcctctttattcaaatcatatttcttcatacgtaaatacaatttcttacgcggaatttgcagatattccgccgcatcattaattcgcccttgaaaacggtttaacacatcagtaatcactgttttctcatattcttcaatccgttcatccaatgataactcgccttgattttcagctataaaatggagattatcgttttgtaccgtcacaccaacggcatataattccgctgtatgaatcagctggctaatattgcctaaccactgttgtgataataattgttttaagaaagtatcggttacagccggttttttctttttcagtttttgacaagttaaagttaaataatggcgaaataacggctcaatatctgaaggtctttgtgccaatggaatacactcaatttgagtaagagcaaaagcataaaataattccggcaatagaccgtattcagataacaactgctgaggcgaatattggctaattgcaatcactcgattttgctgatcctgctgaataaactgcgccagtagtttttgcgtaggtttgctcaaatactcaatattttttaaaataatgaccgcactttttaggtgaggtaactgactttgtaatgtctcactatcttcttgctccaacaattcaacaaaatatttttgttcaaaacgtgactttgccaatttatacaaataattcgccgctaaagttctccccgtaccaatttcaccaaaaataaaaatcggtaaattagtttcagataactgttgcaagcgtttacggtgagatttaatccaatgactttgtccaataaaatgggtttctagctcactttgttgccataatttagtggcaagttgcgtttgtcgttgttcacaggcttgtgccacttgctgtaagaatttttcaggtcgtacaggtttctcaataaaataaaaagcccccttttgcatagcttcaattgccataggcacatcgccatgtcccgtaatcaaaataactggtagctgcttatctttagcatgaatttgttccagtaattgccagccagacatttgtggcatataaatatcactaaccacaataccttgccaatcctcactaatctgttctagcgctgtaactggattattgaccgcaatagtgcgatagccttctagttctaacaatgattgataggcttgcagtacatcttgatcatcatcaattaataaaacggtgtagttatgactcatattctgttcctaataaatgtggctcatcagctggaaattctaaaataattaccgcacttttatgtaagcttgaagcaatataaagattgccattaaattgctgcataatgcgctgacaaatcgttaaacctagacctagaccgacttctttgttgctatagaaaggttgtaataatttatccgcactttcaagcggccagccctcaccgttatcttcaatacgcgcataaattttatgttgctgtgcataaagttgaatctgaatatgcgcttgtgttttgcaggcttccagagcattactcaataaattaacaaaaatctgctctaataaaatagcattacctttcacaacattttcaccttcaatggagagctgtgcctgcatgggttgatgacgtaacgctaataactcccatgctgtattaatcgcttgtgtgagtgaaaccggttgtaaaggatcttgcaatgtatggcgtttagtaaattggcgtaatcctttcactatatgtgcagttcgttctaccagtttattgatattctcggcataggtttctgcttgtgatagatttcctgtttgtaagcttttctttaaactgaataaataaatagctatcgcattcaaaggctgattaatttcatgagccaagctggtcatcgtttgtccaactaccgccactttggctgtttgaatcaactcattttgtgtatctcgaagatcttgttcgatgatacgtcgttctttaatcatatccgtatgatgtttcaataatcgattaatttccgcaatttcatcattaccgaaaacttgaattggcaattcttctttacctttattgagcaatttcactgactcgatcaaattttcaaatcgcttagtcaaatgtccttgtaaatagaaacgattgaaagcccaaataaaaatcaatgagataagtagagttgccacaataatgaagccactaacttttgtttgctgcttcatattctggttaagagcggtcaaattttcattggttttaaatagaataccttctgtaatatttcgcgtagaacgcaaaatattcgctttttgctggctaatctctgttgctgtctgttgaaattgatgaatattggcgaccaattcatctagatcttgatgaggagcaatcatattcgctaacatttccaccatttgttgcaaagtggcaatacttgcgttgtcagtttgtaatggttcactatgttgtaaacttacaaccagttctttcaaggtttgatatttcaatagaatgtcttgctgatcgagtgcatataaaaattgagcgatctctgttttaatattatcttccgtattctttagctgcgcgatagcttgtaattcattttgcaaattaaagatgtctgaactggagtgagagctagaaacgggttgtttcgctaaattaatttgctgccaatttaattcctgccctaacgcgacgatttcattattaaaatcatcatgcaaccattgcaatttcgtcacgagttcttgctttttttgttcaatatgaaaactttggtttaaatgcgaataaatctttacaattagcgcctttaaatctgcaatattacctaaaatcacgccctcatcatgagtatcatcagacagcatcaaagcatcctgttctatttgctctaattgtccatttaactgtttgaacattgtttgacgattcatattattttttaccgcagcaaagcgatctaactcattcacaaaagcggcaacattatcttccaatttcagcgcaagatgcgtttttggaaaataatcgtctaaaatataattcacttgtttatgttgctgataccaagaaaaaaggctcactatgcctaaaaccacacttaacatcaaactcatcgcaaaagcatgttttagcacctgtgtaatacttgtttttttcattctgttattccaatctaattcaattatcttattgttcttctattgcaagtaataccttattaatctgtccttggaaaaattcagcccattttctttcttgcgctaaggcaaaagttctattgtttttaagctgtgctaaaaagtttttgtcattggcttgtgcttcactcaatggcatagcggtcaactcagcacgaagtgcggtcaattttttacctattttcttctctttttcatttagcgcatgccaagcttctttgagttgtgccaaacgaaaggtaattgctacatcaaataactttttcaccaaatactccctcgcaagcagacgatcgtaatctaacagaggttcattcaataacttttgctgttccatatatagtgaatcctgagcgtctaatgaattaagtggatatttggcaaagttacgggcagcgaccattttctgccctcgttcagataataaaaaggcaataaatgccatagcatcttctacatgctcactactacgatgaattgctacaaacgtgggagaagcaatagaatgaggaaaatagacaaatcccacatcagaatgtgcggactggttaagtgcataagtatcaatgctcataccggctacggctaaacctgcttttactttatcagccacattaaaactacgggatgaaatcaaagagaaattacgagataacgtcaaaaagtcagtccagccttcattccaacctcgttgctgtagcaacatttccaacataatatgatttgaccccgaacgtgaaggcgaactcattaacacactattaaaataatcagggtgtaataagctattccaatctgttgggatagataaattacgttccttaagtaactttttattgtaaaaaataccataaccagagaatgctacagcggtagttgtttgtctcaattgaagcggcacccatttgtcatgctgctgtaaatgatctggtagagaaagtagtacctgttgctgttgcagctgttgaaataaaaatggcgatgaactcaacactaaatctacattctctatatttggttgagttaacaaacgttctaatgagctaactgtacggttaattaaacggatatgttgctcaggataaatttctttccattcattttgaatataattcattgtttccggagagaaagaagttgcgatgactaaactttttgcctgaacctgaagtgttagtaatagccctaataaactaccgaaatagctgataaattttctcattgttacatccatttttgtgatttagatcacaaaattaaaaaatttttttcattcacattttgccaaataggcaagttttatctcaattttcggccatcatatccacatacaattaaccaatgatgttttgagttaatcttgacacataaactttattaaaaatgtcaattttgacttaaatttcaatgtattgccttttgctttagacatattagcatagtgccaaatttctttaactagaaataaaaattccttattttttattcttacaggtattacattatgatttcattcttagcctcaaaacctggtaaacccgtaccagaagcagaacaattagagcgttataaccgtttaagatggcatgcactttttggcatatttattggctatgctgcatactatattttgcgtaataacttcttactttcttcgcctgaacttatcagcgagtttggtttcactaaaaaagatattggttttatttccggaacaatgttagttgtatatggcttaagtaaaggctttatgtctgcttttgccgataaatccaacccaaaacattttatgattttcggcttaatgatgtctgcagcggttaaccttatgatgggctttagcgcatcattctgggcattcttattcctttgtattctaaatggtatcttccaaggtatgggcgcaggccccgcttatgtggtgttagcaagctggttcccacgtaaatctcgtggtgtgacaacagcgatgtttaacatttcacacaacgtaggtggtggtttagtggcaccaatcgcaggcgcaagtatcgcatggcttggcactgaacattggcaagccgcgcactttactgttccaatggtgttagcaactattattgcaattattgtgtatattttcggtaaaggacgtacttataatgaaggtttaccaccaacaagcaaaatcttaggtacagaacaagaagaacttgtggtgacaaaagatgaaaatgtgaacttaactacatgggaaatcttccgtgattatattgtaaaagatatcaatgtttggttcgtatcatttatcgatgtgttcacttatatgatccgtttcggcgtattaacttggttacctctttacttattagaaaccaaaggtttctcaaaaggccaaatggcaaccgcattcgctatctttgaatgggctgcaatcccttcaaccttattagcaggctggttaaccgatacctatttcaaaggccgccgtatgccacttgcgatcatcacattaattggtgtaggcgcagcaatgtttgcttactggggtggacaagatttattaacggtaaccattggtgcaggtatcattggttgtttgatctatgtaccaatgttcttatcatcattacaaactattgaattagtaccatcatttgccgcaggttctgcaacagggttacgtggtttactcagctatattttagggagtttctcaggtactgcattattcggaatcttagctgaacgctttggttgggatgcaggtttttacctcttattattcgcagtatgtggttgtattttctgctgttatatgacccacttaggtgtattacgtttagaaaagaaaaaattagcgcaagcagcaaatcattaatatcaagtaaaagtgcggtaaaatttaccgcacttttttgtttattaaaaagctgataaatctcctcatctttatactctaaatagagtatagattgaataaagtgttgccaatgtacaaccatcaattattcatttacggcacaattgcgaaaattttgcaaaaaattaaccgcttatttgtgttaaaatcccttcaattttttcttatctgaatttaaatatcgtaatgactcaacaacgtttcgttcatcttaaagtccatagtgatttctctatgattaacggtttggctaaagtaaaaccgttagtcaaaacagccgttgccaataatatggtggcaatggcactaaccgatttcagcaacttttgcggattggtaaaattttatggcgaagcgttaggttccgggttaaaaccgattatcggtgcggatattttcgtgcgtcccgaaccggacagcgaagatttctttgagctgacgttactggcaaaaaacaacaccggttatcacaatattactcttttactttcaaaagcttatcaacaaggttatgttgaatttccgttagtcgaaaaagcgtggcttgccgagttaaatgagggcatcattgtgctttccggcggacgaaacggcgatgttggaaaagctctactcaaagaaaatgaagcggaagcagacgaattagttagcttttatcagcaatatttcccaaatcattactatctcgcgctctgtcgtactggccgtacggatgaagaacgctatattcagcaagcggtgcctttttcacaaaaacaccaattaccgttagttgcggtaaatgatgtagtgttcttgaaagaagacgattttgatgcgcacgaaattcgtgtagcaatccacgacagctacaccttagatgatccaaagcgtccgaaaaaatattcaccgcaacaatatttccgtagcgaacaagaaatgtgtgccttgtttgccgatttaccgcaagcggtcgaaaatacggtacaaattgcaatgcgatgcaatgtaaccgtacgtttaggcgaatatttcttaccgaatttcccaaccggcgatctttctaccgaagattttttagtgaaaaaatcacgtgaaggtttggaagaacgtttggaatttctattcccagatccggaagaacgcaaaaacaagcggtctgtttatgatgaacgtttgcaagtcgagctggatgtaattaaccaaatgggcttccccggctacttcctaatcgtaatggaatttattcagtggtcgaaagataacgatattccggttggcccagggcgtggttccggtgcgggttctttagtggcgtatgcgttaaaaattaccgatttagacccgcttgccttcgacttactctttgagcgtttcctaaatccggaacgtgtttcaatgcccgatttcgacgtcgatttctgtatggacggacgagatcgtgtgattgaacacgttgccgacacttacggtcgccaagcggtttcacagatcattaccttcggtacgatggcggcaaaagcggtaatccgagatgtaggtcgtgtgcttggtcatccgtataattttgtcgatcgaatctcaaagctgattccgcccgatccgggtatgaccttggctaaagcctttgatgccgagccgaaactgccggaactttacgaagccgatgaagaagtgaaagacttgattgatatggcacgtaaattggaaggcgtaacccgaaatgccggcaaacacgccggtggtgtggtaatcgccccaaccgctattaccgatttctcaccgctttattgcgattcggaaggacttcatccggtgactcacttcgataaaaacgatgtggaatatgccggtttagtaaaatttgacttcttaggcttacggacactcaccattattaaatgggcattggagatgatcaatcaacgcttagcccgagaaggcaaagagccggtacgtatcgaaagtattccgttagatgataagaaatcctttgatctgttactcgcatcgaaaacaacggcggtattccagctagagtcacgcgggatgaaagatttgatttcacgtctgaagcccgactgttttgaagatattatcgcattagtggcattattccgccccggtccgcttgaatccggcatggtacaaaactttatcgaccgtaaacatggtcacgaagaagtttcttaccctgatgcacaatatcaacacgaatcgcttaaaccgattttagaaccgacctatggtgttattgtttaccaagaacaggtaatgcaaatcgcacaggtgcttgccggttataccctaggtggtgcggacttattacgccgtgcaatgggtaagaaaaaaccggaggaaatggcggcacagcgtgaaatcttcgaaaaaggggcaatcaaacaaggtattgatggcgatcttgcgatgaaaatctttgacttggtggaaaaattcgccggttatggttttaacaaatcgcactctgccgcttatgcgttggtttcttaccaaacattatggctgaaagcacactaccctgccgaatttatggcagcggtaatgacttcggagatggataataccgacaaaatcgttggcttttatgacgaatgtatcaatatgggattaaccgttgttccgcctgatgtaaacagtggtaaacaccgtttttcagtgaatgaaaaaggcgaaatcgtgtacggtttaggtgcaattaaaggtgtgggagaaggcccagttgaagcaattttagaagcgcgtgaaaaagacggtatcttcaaagatttatttgatttgaccgctcgagtcgatctgaaaaaaatcaatcgccgtacctttgaaggcttaattatgtcaggcgctttcgataaattaggtccgcatcgtgctgcattgatgaaaaatttagaagacgcactaaaagcttctgaccaacatagcaaaatggaagcactcggacaaagtgatatgttcggtgtgctaactgaaacgccggaagaagtgcaaaatgcctatgcgaatacgccgaaatggtcggaacaaaccattttagaaggcgaacgcaccacactcggtttatatttaagcggtcacccaatcggacgattcttaaaagagttatcgcactatgcgccggtacgtctaaatgaactacaaccgacacgccgtgggcaagtggtcaccgttgccggtattattatggggtcgcgtatcgccgtaactaaacgaggcagccgtcttgggattgcaaccattgaagatcgttccggtaaattagatatgacactattctcagaagctctcgaaacttacggccatcttttagagaaagatcgtattgtgatcgcaaccggttcggtacaatttgatgattttagcggcgggttaaaaatgtcagtacgagaaatcgccactttagatgaagctcgcagtcgctatgcgaaaagccttgctttagcgattagtcaagaacagcttactccgcaatttgtaaaagaattacgagaaatcattgaaccgaataaggaagggacgttaccgctacatttctactaccaaagccctgaaggcagagccttattgcgaagcggcgtagaatggcgagtaaccccgaaagatgaaatgctcgaccaactcaaaaccttacttggcgaaaatgccgtagaactggagttcgagtaacaaaggcatagtagacaaaacaagcggttgaatttgcagatttttttgcaaatttgaccgcttgttatttggtgaaatggaaaaatatgtaacttttgtctattaaaccattaaagctgtaccgctaattttgcataggctcgttcggcttttgccaaggctttttcggtattctcgtcacgggccaagatgactcctaaacgacggtgaccgttaacctcacctttaccaaataaacgaatattggtgccgatttcttctaacactttatcaagattaccgaatctcacattatttgatttgccttcaactacaatcgccttggaagctgccgggctaatttgataaatttccggaatcggtaaacctaaaatcgcacgagcgtgtaaggcaaactgggacagctcttgcgaagccatggtgaccattcccgtatcatgcgggcgaggcgaaacttcattaaagataatttcatcaccacaaacaaacaattccacaccaaaaataccgcgtccgcctaatgccgttgtaattcgctctgcggtttcttgcgcacgttttaatgcaagttcagacattgcttgcggctgccaagattcacgatagtcgccatcttcttggcgatgtccgattggtgctaagaaagatgtaccatttacatgacgcacggttaattgcgtgatttcataatcgaatttgataaacccttctacgatcactcgtccgctgccagcacgtccgccttcttgcgagtaatcccatgcttgttgaatttgatcctcagatttaatcactgattgtccgtgaccggatgatgacataatcggtttaactacacatggaagaccaatttcagctacggctttctgaaaatcatcaaagttatcaacgaagaaataaggtgatgtttttaagccaagttcttccgctgctaaacggcgaataccttcacggttcattgttaattgggttgcctttgcagtcggcaccacattgtagccttcttgctctaactctaccaacgttgctgtcgcaatcgcttcaacttccggcacgataaaatccggtttctcttgttccactaatgcacgtaacgctgcgccatctaacatggagattgtataagaacgatgtgctacttgttgtgccggcgcattttcatagcgatccaccgcaatcacttctactcctaagcgttgtagttcaattacaacttctttacctaactcacctgagccaagcatcatcactttcgtagcattcggtcttaatggcgtgccaattgtggtcatttttgatcctctttaatttaaagcaaacgtttgcgtgaattatataataaaagcggtaagattttgtaaaaaatttgctaaatcttaccgcttgttaagtactagtcgagtgattatgccgatttatcgtccgctttctcaagctcttccgctttttccattgcaccttgaatagtgagctggatttccaccgaaatcaacgttctgagcatttcctccgcttccatgactttcgcaataaccgcattgccttgttcatcaaaataaccttgcgcttttaaacttgcactaaaggttgagaaaatcgccttatcaaaaaactcaggtgcattgataccatgcagaatcgaaagacgttgtgcgatagaacggctttctttttctaacgcattacgacttatttccggttgctccaacaagacacttaagctgatgtagtaacgttgtaaaatttcacgcacacctgccgcatgaagctgtaatgcacgtacacgagaacgattaatttttaatacatcactttcgtatttaataatttgctgacgagcaaactcggttaaaatcagttcaacttgctgacgaactttgctttcatcaaagtgaaggaataactcagcttttaagaacgggtaaatatgacttaccgttttcataatcagatctttggataccgattcgtggtgtaagacgatacttgcaaccaatgatggcaacacaaacagatgctgaatattattacggtaataagtcatcaataccgctgattcacgatctaagcgaatcatttcaccaaaattatctttctcactcaccacgccggaacgaggtaacgtaagcacatgctgtaacatttcttccgcagattctttcggaatagtgatatccgccgaataaggtacgtttttaaataattgtaggtagctatctacttgttcaattaattgttcgcttgctaaggctcgctgacgagaagctaacaatactgagccgatcaagtttttcgcattcactgccgctgcattattaatattcaccatcacttgctgagccacggcatcaaccgcctcatttagccatttcggacgcacatcttcagaaggcggttctttccattcagggaaatgctgattcaagtaattgtttacttgaataggttccccgaaattcacatagccctgccctaaattacgtaattttttaatcacacgtaacactaagccagcattttctttttctttctccgcacctcgcaattcttttgcataagtatctacttcaagcacgtgttcatagccgatataaaccggtacaatactaatcgggcgagttaaaccacgttgtaatgcttgtaatgtcatcgacatcataccggttttcggctcaagtaagcgtccggtacgagaacgaccaccctcaataaaatattccaccgaatagcctcgataaaatagctccgccaaatactcacggaaaatcgttgaatataagcgattgcctttaaatgtacggcgaataaagaatgccccaccacggcggaaaaacggccctgccggccagaaatttaagttaatacctgcagcaatatgcggtggtactaaaccttgatggtacaaaatgtatgataataataagtagtccatatgactacgatggcacggtacataaacaatctcatgcccttctaaagcaagcttacgcacacgatccgcattttgtacactgataccttggtacaacttattccataaccaacttagcactcgatccgccatacgtagcgtctcgtggctcacatcggctgcaatctcatccaagattttttccgcttcttgctgcgctttttctttggaaatctttttcgattttgcttcgtcttcaatcgcctgcacaatagccggcaattggatcagtttattaaacatcgcttgacgatcaggcaaacgcggtcccattgccgaataacgctgtttagcaaaatgcatttttgccactcgagccagcttttgtgccaatccttcttccgcaccatgctcggtcaccatataacgtaaagataatgcttgagaaaaacgcacaaaattatctcgaccaaaccagatcatggcaataatgcgttgaaaagtactcataaaacgcagagatggtgctttttctttacctggtgagcgcccccataacacagataccggtactagctgcacatctaaactttcatccgttcggtgtaaatccagataacgatagaagagagattcagtctcgcttttagctcctttcgatttaaaaaaacgacgaccttcatctaaaaagacataacgaggtaaggactgaccgttaatctcattagtttgtaatggatcaggtaaattcagtacttggcaattcttttgtagaattaataaatccgtttgggacgtataaggtaatacgtaaataataggttgtgatagatttaatgatagttcgttcaccggatcggtaggaatagaacgagacttaactaacaacgaaagcggaacattcaacactttccgataaaaatttaagaggctagacattttaatatccttaattgttatggtttatgccatctatatgtatacgaaatatagtctatcataaatttgtcagaattttctgaatttatctagttacaaataaaaaattactgtatataatgacacaaatttctgtatataaagacagtgaggaaaaaatgtcacgtaaacacttaactgctcgtcagcaagaaatctttgattttgtcaaacaccatattgaaaccaccggtatgccgccaacacgagtggaaattgccagagaaatcggttttaaatcacctaatgcggcagaagaacatttaaaagcactggctcgtaaaggttatattgaaatgctttcaggtacttcgcgcggtatccgtatcttagtaaataacgaaactgaagaagcagccaatgatgacggcttacctctaattggaaaagtagcagcgggtacgccgattatggcgattgaacacgttgagagccattatccggtaaacggtgctatgtttaatccgaatgcagattacttacttaaggtaaatggtaattcaatggaaaaaattggcattttagatggtgatttacttgccgtacataaaacaaactttgcgcgtaacggtcaggttgttgtcgcacgtgttgatgatgaagttaccgtaaaacgtttagagaaaaaaggtgatcttatttatcttcatcctgaaaatgatgaattagagccaattattgttgatcctcgtattgaatatatcgaaattgaagggattgccgttggtgtgattcgtaataacgcttggatgtaatctcaacattaggagaatatgcgataagcggttctcctaaatcattatcatacgcttatgcaactttccaccttttcacattccgaagcagaattacttgaaaaagcaaactggctcgctggttttacgctaggagaaatcgcacaacaattaaatgtagctgttccgccggatcttcgccgagacaaaggttgggtcggacaattaatcgaaacagctttaggtgccaaagccggcagcaaaccagaacaagattttgcacatttagggattgaactcaaaactattcctattaatcataaaggttttccacttgaaactacttttgtgagtttagcgcctttgacgcaaaatactggtattacttggcagacctcgcacgttcgccataaattacaaaaagtgttatggattccggtgcaaggagaaagacaaattccggttgcagcacgccatatcggacaacctattttatggacaccttcatttgaacaagaacaacagttgaaaaatgactgggaagaattaatggaatacattatttttgggcgtttaaatgagattaatgccacgcttggtgaagtcatgcaattacgtcctaaaggtcgaaacagtcgttcactcacaatggcaattaatcagcaaggtgaacgagtccaatctttaccattaggcttttatttacgtaaacaatttaccgccgaaattttacagaattttttacgttctcctctttaatttttatgcgactctcgctatgattagcgccttttaaattataggtaataacctattaaatcgttttcttttaaaaggatattttatgtttgattggattgcaaatcccgaagcgtgggtcgcactcttaacccttactgggcttgaaatcgtattagggattgataacattattgttatcagtattttagtttcacgcctcccgattcatcaacgccaatcagctcgtattattggtttagcattagcaatgggaacacgtatcctgctattactttcccttgcttggatgatgaaattagtcgatccgcttttctcaattgcgggtatgccgatttccggtcgtgatttaattcttttactcggtggtattttccttattgtgaaaagtgcgatggaattgaaagaatcaattgcaggcgaatcacacgaagaaaaagaaaattcgagtaaaaaagccagctttttgatgattttagttcaaattgctatttttgacgtcgtcttctcgcttgattcagtaattacagccgtcgcaatggcagatgatattccggtgatggttatcgcaatcattattgcggtagcggtgatgatgcttgcagcaaaatcaatcggtgatttcgtagataataacccaaccattaaaaaccttgcattagcattcttaattttaattggtgtggtattagtcggagaaggctttaatatccatattccaaaatcagcagtttacaccgcaatgggcttctctgttattgtggaattactcaatattaaaatgcgtaaaaatcaagaaaaacacgctaaagcataataaatcggcccttgatgaaaatcaggggcttttttaatgtaaaatagcgcatccttattctattgcaagcggtcgatttttcctccaactttgcaattacattttcgataaattatgttactgattgatataaaagataaagaactcagccaagaagaggttgaaatccttgaacatcctctcgtatctggcttgattttatttagccgtaattttcacgataaagcacaactggaagccttagtgaaatcgattcgccaacgagtaaaaaaaccgttattgattactgttgatcaagaaggtggtcgagtgcagcgtttccgtgaaggctttactaaattaccggcaatgcaagcgtttcatacacttgcaaaaaatccgcaagaatcaaccgctttagcccaacaaaccggttggttaatggccgctgaaatgttcgccttagatattgatttaagttttgcaccagtcttagatttaggtcatcaatgtaaagccattggcgatcgttcgtttggcgaaaatccggatatgattctgccgatagctgaagcgtttattgacggcatgagagaaatgggaatggcgacgaccggtaaacatttccccggtcacggacatgtattagccgattcacatctagaaacaccttttgatgatcgcctgaaagaattaattttcaaccatgatattttgccgtttaaacaattgatctcaaaaggtaaattgtcagcaattatgccggctcatgttatttatacacaatgtgatagccaaccggcaagcggttcggaatattggttaaagcaagtattacgtagtcagcttaattttaacggtgtgatattttccgatgacttaggtatgaaaggtgccggttttatgggtaattttgtcgaaagatcggagaaagcaattcacgcaggttgtgatttactactactctgtaatgagccagaaggtgttattcaagtgttggacggtttaaaatatcaaccaagcaaagcccaaactgaacgtcatatttccttgatgaaacgtaaaacagtaagctggaacgagcttgaagcaagtcctcgttatcagcaagcacagcaacgcttaaccgcattacaaaacgaatggcttgaatataaagcacaacattgctaatcaatgagttatcttagggcataaatccgttatgccctaacaaactactaaaaatatccctattcttttaacaaaatgatattaaattgcccacatttccaacagcaacactgtgtttcatgccaatggttagaaaagccatattctacacagcttataaataaagaagctgatcttaagcggttaatttcgccttttattttgcaaaaattcactgaaatcttaccgcctgttcaatcttcacaaaaacagtttcgcaataaagcgaaaatggtggtctccggcagtgtcgagcgcccgattttagggattttaaaagatcaaaccgatccgcaaagtggtattgatctgtgtgattgtccactctatccgactgaatttgaagcacttttcccgattcttaaagattttattgcccgagccgggcttgtaccttataacatctcaaaaaagaaaggcgagttgaaatatatcctgctgacccaaagccaatataaccaatccgttatgttgcgttttgtgctaagaagtgagcaaaaacgaccgcttgttgagcgtgaattgccaaatttattagctaagctgccgaaagattctgtggtcagtttaaatatccagccacaacacgctgcaattttagaaggtgaaaccgaaattttcctcaccgaaaaaaccacgattgaagaaaattttaacggcattccgttatttattcgtccacagggctttttccaaactaatccgaatgttgcaagtcagctttatgctactgcgcaaaattggataaaagagctgtcgattcagcaattttgggatctgttctgcggtgtcggaggctttggtttacattgtgcaaaagcgctacaagagaagaatgaaaatgtacaattaaccggtattgagatttcagcttctgcaattgccagtgccacgaaatccgccgagcaattacaacttaaaaatattacattcgcttcgcttgactcggcacaatttgcactgaacgagaaaggtgcaaccccggatcttgtgatagtgaatccgcctcgccgtggtattggaaaaccgcttgcggagtttttaaaccaattgggtacaccttatttaatttattcaagctgtaatgcccagacgatggcgaaagattttgaagcattgagcaattactcactccaaaaggtgcaattattcgatatgtttccgcatacttcacattacgaagtacttacttttcttataaaaaaataagcatatctcctaccgaaatattggtaagagtttatatttttagcaaaatttaggtataattagataactttagtttcatttatccgtattcgatcaaagaagcgctagattttgtgaactaaatcacttttttacaagacaaaagcgtaaaatatctttactatattattattctttttttcattaactctcaattagaggatattaacaatggctaaaatcgttaaagtaattggtcgtgaaatcatcgactcacgtggtaacccaactgttgaagcagaagttcacttagaaggtggcttcgttggtttagcagctgctccatctggtgcatctacaggttcacgtgaagcattagaattacgtgatggcgataaatcacgtttcttaggtaaaggtgtattaaaagctgtttcagcagtaaacaatgaaattgctaacgcattagttggtaaagaaggtactgcacaagctgaaatcgaccaaatcatgatcgatttagacggtacagacaacaaatctaaattcggtgcaaacgcaatcttagcggtttctttagcaacagctaaagcagcagcagcgtctaaaggtttaccattatatgcttacatcgctgaattaaacggtactccgggcgtatattcaatgccattaccaatgatgaacatcatcaatggtggtgagcacgctgacaacaacgttgatatccaagaatttatgattcaaccggttggcgcttctacattaaaagaagctcttcgtatcggtgcggaagtattccacaacttagcgaaagtattaaaatctaaaggtttaaatacagcagttggtgacgaaggtggctttgcgccaaacttagcgtcaaacgcagatgctttagcatgtatcaaagaagcagttgaaaaagcaggttatgttttaggtaaagacgtaactctagcaatggactgtgcatcatctgaattctatgacaaagaacgtaatgtgtacgatatgaaaggtgaaggtaaaacattcacttctcaagaatttactcattacttagaaggtttatgtaaagagtacccaatcgtatctatcgaagatggtcaagacgaatcagactgggaaggtttcgcataccaaactaaagttttaggtgacaaagttcaattagttggtgacgacttattcgtaactaacactcgtatcttaaaagaaggtatcgagaaaggtatcgcaaactcaatcttaatcaaattcaaccaaatcggttctttaacagagactttagctgcaatcaaaatggctaaagatgctggttatacagcagttatctcacaccgttcaggtgaaactgaagatgcaacaattgctgatttagcagttggtacagctgcaggtcagatcaaaactggttctatgagccgttcagaccgtgttgctaaatacaaccaattaatccgtatcgaagaagcattagcagcagcaggtacacctgcaccatttaacggtcgtaaagaagttaaaggtcaagcataatcttatttgattagcaaaaaatgccacagaaatttctgtggcatttttgcattctaagctagtataaaatagacaattaaatcaaaaaggaaaaacaatgttatattctgttttaactgaccaattacttatcggtcaaggttatcgtaatggagctcactcaacaaagtacgaacaccttgtggtaatgttcgaagatgatggcgaaacaggttatttctatgcgatggacttacaccaaacagaaaaccctgtggtggatagcctatttgtttatagtaaatctgatattgaagaaaagactttaatggaaccgcgccgcttagaaatttgttggtcggaagatggctatcaagcctttttactgattaatggctatccacatgcagtctttgattttagccaatttgtcggttataaccatacaaaattccctcagcctgaattaggtagtatgtgggtacataaagaaactaatgtcgaattagtcgacaaatggctaggataaaattagaggccggactgaccttatttattgtgtaataaatagacttgacactatagtatgctctgtgtacagtgtaaatatcaaacgcactttttgattctcattatcactgtgagtttgatatttgtctatttacgaaaatttattaggagttcattatgaaaaaattagttcttgcaactcttgcaacttttactttactttctgcaacaactagtacttttgcggctaacttcccaggtgcttgtacccgtgaatatgatccaacaccatacatcacaaaagaaggtaaattagtgtacgctccaaaccaatgcattgcagatctctgggctgaacaaggcaaataaataatatttttatcaataaatagattttaatttaaagtgagttgaattcttttcatcaagaatttagctcactttttatttaactaaagattacattctagaagttttttctaaaatactgacgtagaatccaagagagctgacaagttaaaatgttcaaataatacacttgacactataatcacctctgcgtaaaatttacgcatcaaatatagttattgataataattatcaagtttatatttgatgttttatgtataaaaacttattaggagttcattatgaaaaaattagttcttgcaacacttgcaactgttactttactttcagcaacgactagcgcttatgcggctaacttcccaggcgcttgtactcgtgaatatgatccaacaccttacatcactaaagaaggtaaattggtatacgctccaaaccaatgcattgcagacttatgggctgaacaaggcaaataattcgaattgataaactgcacttaacttcactttgagctcacgtgattttaagtgcagtttttttatttacggttatgacaatgttcttgaatcaagcttaaaaaagcaccaccaaaacgttctaatttacgttctccaactccattaatatccaacatttccacttccgtaagcggtaaaaattcggccatttcttgcaaagtcgcatcattgaataccacataaggtgggatattttctttatcggcaatttgtttacgcagaaaacgtagacgagcaaataagtccttatcgtagcgaaccgaagtttgtttctgtacataagccgttgctgaaaacgttaaacgaggcattgctaattcgagctttttctccgaacgcaataccggacgagcttcttcagttaactgtagagctgaatgattaacaatattttgacgaattagaccaagatgaatcagttgacgaataatacttagccaataatcttggctctgctctttgccgatgccgtataccgaaagctgatcatgattaaactgacgaattttctgattattcaaaccacgcaatacgccaatcacatgatgtgcaccaaaagtttgaccggtacgataaatcaccgacatcactttttgcgcatccaatgtcccatcatatttacggggtggatccaaacagatatcgcagtttttacacggttcttgacgtgattcgccgaaataattcaatagcactaaacggcgacaggtttgcgattctgcaaaagcaccgatggcttgtagtttatgttgttttatatctcgttgttcactttccggttcttccagtaacaccttttgcagccacgcataatcggcaggatcataaaataacaccgcttcagaaggtaaatcatcacgtcctgcacgcccggtttcttgatagtaagattcgatactgcgcggcaaatcgaaatgcacgacaaaacgcacattcgatttattaattcccataccaaaagcaatggtcgcaaccacaacttgaatattatctcgctgaaacgcattttgaaccgtttcacgttgctgaaccgacatgccggcatgataacccatcactgaaattttccgtgtcgcaagcttctccgtaatctcttctacctttttacggctattacaataaacgataccgctcttgccctgttgcttaccgataaactttgccaactgctccatcggcttaaatttttcttgtaccgtatagcgaatatttgggcgatcaaaactacctaaataagtatgcggatcggttaagcgtaggtgctgcagaatatcgtggcgagttgttgggtctgccgttgctgttaatgccataagaggcacattcggaaacgtattacgcaaattgcctaataaggtgtattccgggcgaaaatcgtgtccccactgcgaaacgcaatgcgcttcatcaaccgcaatcaggctaattttgcatagcgaaataaaatggaaaaagccttgggtcatcaccttttccggcgagagataaagtaattttagctgaccggaaagcgctttctgctcaacatcttgttgctcttcaaaggtttgcgtggagtttaaaaaaccggcttcgataccattggtaagcagctgatcgacctgatctttcatcaaagaaatcagcggagaaatcactagcgtaatgccatctaagcaaagtgcaggtacttgataacaaagcgacttaccgccgccggtagtcataatcacaaggcaatctcttcccgccaaaactgaatcgatcacctcttgttgtccgtgacgaaaagattgataaccgaagacgttatttaatacatctttggcagcagtttgagataattgcattgtgattccaataagataagctaaaaaggaaatagacaagcggtcaaatttgcaaaactttttacaaaaacgaccgcttattaattaaaagctgatttgttcaccgtgacgagcaaaagcctcttcaagatgcgtccagaaagagcgaccttctgcagtaacccattcaccatcacggtaagcgaaatgaaagccacctaatttgctagcaagccataactctaacatcgcttcttgtttattgatgacaatttgtgattcatcatcaaaagttaatgtacatactgcaccttgaatttcagtatcgacacctaaaccttcatcatcaattttttcttcgatttgttgccatacttgttcaattttttggtgaaattctgctacgttcattttttcctcattaagatctatatacttactaaatattttttataaaattacgtttatatttaatatggctctgaatattcttttctgcatcctttttatcccaaacttgtagttcccaaggataataaaagttactggcatttttaaagtaaatatgaattcctacatattcttctttatctctcaaataccaattttttaaaccatatttatctttccaatcatctaaacgttccataatctctgcgatttcttcactggaaacgattatcctcgcaccaaagatgtcattcataatgctattgactggatagccctcgctacgagactcaaaacgtttgattttatccaaaatagattccgaggcttttactcgataaaaataaggaatatcgtataaatccgcacggaataaataatcattgatagattcgtgtaaatttaaacggtaagataaaatatgctctatcggcactttagcaagcgtatgttttaagtttacttttgcaaccttacccgtttcaaaataatcttcggaaaaagctaaatgcagcttattaatttcaacaattaaacgctcaattttttctaacataaccttacccgatttttggtaattccgtcattggccagcgaggtttaacgctaacacttaaatcggtagtttcaccgttttttaagcgtaaaaagccggtataagcaatcattgcaccgttatcggtacagaattgcggacgaggataatacacttcgccttttaagtttttcatcatttcagctaaatcggcacgtaattgtttattagcacttacgccccccgccatcacaaggcgtttataaccggtttgttgtaaagctcgcttgcatttgataataattgtatccactaccgcttgttggaaagcgtgggcgatatcacagcgagtttgttcatctagctgaccgttctcatctaaatgggcattaatcgtattagccgcaaaggtttttaagccggaaaagctaaaatcaagccccggtctgtccgtcattggtcgagggaaaacaaaacgattcggtgtccctttttcagccaattgcgaaaccgctacgccggccggataatccaatccgagtaatttaccggttttatcaaaggcttcaccagctgcgtcatcaatcgactcgccgagaatttcatactgtcctacgccatctactttgactagctgagtatgtccgcctgaaatcagtaacgccacaaatgggaattctggcggattgtcttctaacattggtgccatcaaatggccttccatatgatgaacaccaagcgctggcacgttccacgcataagcaagcgaacgagcaatcgtagaaccaactagcaatgcgccaactaagcctgggcctgcagtataggcaacaccgtcaatatcatctgcggttaaattcgcttctttcaatgcttcttgaatcagcggtaacgttttacggatatgatctcgagaagcaagttccggcacaacaccaccgtaatctgcatgcatctcaatctggctataaagctggtttgctaccaaacctttgtgttcatcataaattgccactccggtttcatcacaggaagtttcaatacctaaaattcgcatatttttgtcttatttatgaaatgggaaaggggcattattcaaaaataacgcccctagaattgcaaaacttttataaaaatcaaccgcttgattagaactgttcgctatattcaggcttaatgatttctgggaagcttttatctttattcgcttcaattaatgcagcaactttctctgccgaatctttgatgccgatttgctcataagccttttgcatataagctaaagcttcataagtcggtttgctttccggatagaaacgcatcatttcttctacacgatttaccaccgcaacataggcttcacgatcgtcatagaatttcacaatcgctaactcgtgttctgccatacggttgattaaatagcccatccaatttttggcatcttgtgcatatttgctttgcggatagtgctgtacaatcgtctggaagctaccatacgcattacgtacgctatctaatgcacgagacgcacgatttacgccaaagaaatcttgaataaagttatcacctaaacgtgcattacttaaaccggctaaatagtaaacataatccatgctcgcactgtttggataagcacgcacaaaacgttccgccgcatctaatgctttataatactcaccgactttataatttgcataaattaaacttaattgagtttgctcaccaaacgcactttgttgaccgcctttggtaccaaccgcatctaaatagcgaattgccgagttataatcgccatcttgtaaataggtttgccctttagtgtagagatcttgtgcggatgattcttctaattctttattcgcactattagaacaacctactactaacagccccgctaacatcagcgaagcaagagatgtgaatttacgcataatgattttacctataaaaaagtgtctatgaccaaaagttaatgtacaatggtcaagtttgaccaatggcactttgctaagttcataccaatttctctattttatagaacctattcaaataagcaacagacaaattttggaatttatcgctaaatgactcaacaaatgacattaactgctgaagtttcagcagatttactcggcgcacgtttagaccaagcgctagcacagctctttcccgattattctcgctcacgcttaaaggtgtggatcgaaagtgatttagtgaaagttgacggaaaaattgtaaataaagcgcgtgaaaaagtattcggtggcgagctgattgaagtgcaagcggaaatcgaagaagaagtacgattcgagccacaagatattccgttaaatatcgtgtatgaagatgatgacattctagttatcaataaacctaaagatttagtcgttcatccgggcgctggtaacccggacgggacggtgttgaatgcactattacattactatccaccgattgcggaagtacctcgtgctggtatcgtccatcgtttggataaagacacaaccggtttaatggtagtagcaaaaaatattccggcacaaactcatttagtaaccgcattacaaaaacgccgtattacacgtgaatatgaagcggtagcaagcggtgtaatgacacaaggcggtaaagtggatgagccaatggcacgccatccaaccaaacgtaccgcaatggcagtacatccgatgggtaaaccggcggtaactcattatcgtattatggagcgtttccgtaactatactcgcctacgtttacgcttggaaaccggccgaacccaccaaattcgtgtacatatggcgcatattgcgcatccgttattaggcgatcagctctatggtggtcgtcctcgtccgccaaaaggcgcaagcgaagcatttttaacggtattacgcggcttccagcgccaagcattacacgcaaccatgctacgtttagaacatccgattaccggtgaacttatggaatggcacgcaccgctaccagacgatttcgttgagttaattgaggcgttaaaagcggattaccagttatataaagatgatttagattactaattaagtaactaaaaaacaaaggcgctcttacattgtgtatgagcgcttttttatccgaaaattaagcctatcataaaaataaggataacaggaaactcaaacattcctacctgcttcacattccaaccgaaactcggtacgacaattgcacgcgctaacgcaatcaaatacaccgcaaatagcaacaagtttcccaacattaaataaacaagcgaaaacagtagatgaaagccgatactcagttccatatacagcggatttttacgctctcgcaccatactttttacatataaggttgccccaataaaaaatagtgttgggtgaattaaaatgtcccaattaatctgttctgtagtgagatagaaacttgccatacctatcacaccgaaagttaaataaccggcaatatcattcaataaattgcgttcatctctttgttttgcataataaatttgaatcgccgcaagcggtaagattaacgctaaaaattgcaaaatttgaggcatcgcaagcaaaaccggtatcgcacagagtaagctaatcagaacataaatgagcgtccactttttgttacgagctgtcggctttttgctaaataatgaaagaaaagggtaagaaaataaataaagaaacagccaagctaagcctaaaaagaggtgattaagcgttggaaccgaagcaaacattccgtataaaaaaggaataaatgccatagctaatgcgccgtgctggtttgaaataactggcttatcattaaacataaattttccttatacaaataaaaaaggcgacttacttaagccgccttttgattttaagaaaaattagaataattttctagctgcatcgaataattcatctttgaacggacgacgcatattgttaattgcatcaatgatatcgtggtgtactaatttctcattttgaataccgacacaacgaccaccataaccttgcaataataaatctaccgcatatacgcccatgcgtgacgctaagatacgatcaaacggacaaggcgccccaccacgttggatgtgacctaatactgttgcacgtgtttcgtgaccaaaacgctcttcaatttcttttgctaactgatgcacatccgtcattaactcggtaatcgcaataattgcatgacgcttaccttttttaaagccttcatcaatattgcgcattaatgactctttatctaaacctttttccggcacgataatatattcacaaccacttgccagcgctgcactaatggttaaatcgccacaatggcgtcccataatttctacgattgaaatacgctgatgtgaagtagaagtatcacgtaaacggtcaatggcttccacagccgtttctaatgctgtttggtaaccgatcgtatagtctgtaccaacgatatcgttatcaattgtacctggtaaaccgatgcaagggtaaccaaactcttcggttaatagtttcgcgcccatgtaagagccgtcaccgccgataaccaccaatgcatcaatttcatattttttcagtgtttccactgcttgcttacgcacttccggatccttaaattgcgggaagcgcgcagaacctaagaatgtaccgccacggttgattgtctctgatacagaacgacgatctaattggatgactttgtcattatataaaccataataaccgtcttggataccatatacctctaaaccttcattgagtgctgcacgaacgacaccacgaatcgcagcattcatgccaggcgcatcaccaccactcgttaacacagcaatttttttgatttgtttagtcattttagacaccttttgctataaatttaaaattttaaaataaatcggaaattggcgtgaagattaccttatttagggtattcattctagcaaattttcatatttttttgatctaatccgccaaaatctccaatgctagatctaaagattccaaaaagcgctccaaatcttccatttggttataatgtgcaattgataaacgtaacgtcccgacttgttcaagatagcgcagataaggttttgcacaatgttcaccgctacgtaaagcgatcttacgttccgtcataattgccgcaatatcggcatgatgaattccttgaaatgcaaagctgatagttgaacagcccgactgagaaaaaatttgaatatttttataattttttaaccgcttgtaggtctctttcgctaaacattcaactgtttgattcaattcgtcgaaattccactgctccagccactccaaaattgcgccaaaaccaataataccggcaatatttggcgtaccagcttctaagcgataaggcaaatcagcgacggaaagcgttaattcggatacatcactcaacattttaccgccgaaaaatagcggtcgaatttgctctagactttgcaattttccggttaacacaccgacaccggtcggcccatacattttatgtgcagaaaaagcataaaaatccgcacccagtttttgcacatcgaccttttcacagcataccgcttgggcgcaatccagtaaaatttttgccttcgaatattggcgaatgattgggatgagttgctcaaccggctgacgtacaccagtaacgtttgaaactaaattcaaggcaacgattttagttcttacagaaatcgcctgctgtaaggcggtcggatttagctgaaaatttgcatctaatggcaaaacgatcaatttcgcttgcttacgcagcgctaattgttgccacggaataaaattcgcatgatgttcggctacggaaataatgatttcatctccggcctccagtaaatattccaaaccatacgccactaaattaattgcatgggaggtaccgctcgtccaaatgactgcattgcgagactcaacattaaaacgtgccgtcactaaatctctcgcccgttcataagcttggctttgtgcaagatcatattggctgcgatgtaccgaaccagccgaggcataaaattcggtagtgctatcaattaatacttggggttttaaggttgttgccgccgaatccaaataagtccactcggcttgctgcttaaaaaaaggaaactgagatctaaatgctactgtttgttgcatatccattaatgcaatgcctctcgatacaatttattacaaggaataccgtcatgattaccgtctattgttttggaaccacattggtcgaaataacgtttcgcactttggtaatcactaaaatcactacagcgtaatactttcttacaatctaatgcattatctgttacaagcggtcgttttttccaaatattttgccaattccagccggaatcagaccgcttgtctgcactatgttgcttccgccattccgctgggttaatcggcgatttatcttgccataatcctttctgcgcttgctttgcttttagcattgcctgctcataaatcggctgcgtttcgcgatacgcccatgccatacctttttggactaataataaattgatattgcgttcttgctcatcataaactactgctaataaacgttggtaacgatcataaccgctactatgcaatatcacttgttttttaaataccaaatttgctagcgcttgtttggctttattgccatacggctgagcggactccggcgcatcaatatataacaaacgcacttttaacggtttacgtttatacaagcaggtcagcgtatcaccatcactaattcctacgactttacagctgatggaattatcagaagccgcataaataggagacgtaattaaactcaaaaatagaaataaaacagaaaaataaatagctttcatacaaaataaaaaagtgtaggaattaccctacactttaacagattttcaatcactcggcgtaaatcttatttgagttcgccattttttaagcggaagaaataatttttagtttcttcaataatcactttgcgtaatgcaattaaagcgatcagattcgggaatgccattaaaccgtttacgatatcagcgatcgtccaaatcgtttttaactgtaagaacggagcagaagcaattaaggcaataaagagtaaacgatagaatttaattcctttagttttaccgttagtcaggtaaacaaagcaacgttcaccgtaataacaccaacctaaaatcgtagtaaatgcgaagaatgctaaaccaacagtgacgacaactgcgccgaatgaactttctaaaccttggttaaatgccaaattggttaattccgcaccttcagcttcgcccgtccaagcaccggttaatacaatcactaaaccggtcatggtacacacaataatggtatctaaaaaagtaccggtcattgaaattaagccttgacgcaccggctctttagtttgtgctgctgcagctgcaatcggtgccgaacctaaacccgattcattcgagaaaataccacgtgcaacccctaattgaattgcttgcatcacagtaaaaccaaatgccccgcccaatgcagcttccggattaaacgccgcatgtacgattaatacgattgcatccggtactttttccgcattcataattaatacgctaaccgaagcaatcacataagcgactgccataaatggaactacaattgatgcgattttagaaatacgttttaccccacctaatacgatagaagttacgactaaagttaaaataattgagctaaatacgaccggcacatcaaaagttgattctaacgaatgagtaataccgtttacttgcgggaaagtaccaatccctaataacgctaccaatacaccaaagaaagcgaatgcttttgccagccacttccactttttgcccattcccatttcgatataatacattgggccaccggcaataaaaccgtctttatcacgaccacggaatttaatcgctaataagccttccgcatatttggtcgccataccgaataacgcaatcagccacatccaaaataatgcacccggcccgcctgagtgaatagcagttgccacaccgacaatattaccggtaccgattgttgcagccagcgcagtagaaagtgccgcaaaagcagagatatcaccggcttgaccttgccctttttcaggtttgaacatatacacgaaagcacggcctaattggcaaaattgaataccttttagtgcaaaagttaaatatagaccgacaccggaaagcaggattaaaagcggagcgccccaaataaggctattaatagtgttaagaatatcgtcaaatgacatctgtgtaattcctcgtaattgtatgttacaaggaaagaaaagtaacaatagagataagcggtaaaatcgataaaatttgactaaaaatgaccgctagttaggtaggtatcacttttctcccctgtccttttgcctgagcgtttcatgcattcgcacttgcgccttcggcgtccattttccatttacatggattggatctctccaagggttcgtccagtaactgtcctcgctatcgctagcacctgaaagattttacctcgtcggtagagttttcactcttctccagctaccttcatccgaacaattcttcgttaaaaagaatgggcagattttaacgattctttaaaaatcgtcaagtaaaaccctacaattttaacgcaaacgtttgccttttgatgatagattaaacaatataagaaaaagcagccctatacataataaacaagcggtcgaatttccctaaaaatttgcaaattgcaaaaaatttaagaaattcgaccgcttgttattttgccaaacagcttaataaaaatattaacgtttaatttcatctacgtcgccaagtaatatcgcatatcggcgagaacttggattcgattctaaagcaattttcagcgccattgtgagcggaacagaaagcaacattccgactgttcctaatagccatccccagaaaagcaaggagagaaagactaccaatgttgaaagtcctaaccgtttccccatcattttcggttccaagacgttaccaaataacatattgacaccgactataccggctaatacggctaagccaacagaaaaaccatttaataacaacgcttgtaagacaatcggaatgccggctaaaaaagaaccgatattcggaatataatttaataagaaagccaatacgccccacaatacggcatattgcacatttaaaatcattaacaagatccaaacagatagaccggttaaagcactgatcaccgttttaatacctaaatagccaataacaccttctaggacttgatcaatataatatttctcattagaaaggtcattatctggactcaacgccaacgctaatttatatttagccataggtgattctaacaacataaaaatcaccactaaaaataaaacaaaaatattagataacacgcctgaaaaacctaataacaaacggctaactaaattcatcacggcactcgggtcaaatttactgagtatatcttcctgactaatactaatcggtaattgatactcattaactaaagcgaatatcgtttgcaaacgtgcagtaagcaataacttatattgtgggatagaagcggtaaattcctgaatagcattatttaccataccggtcaaaaataaaaaaactaagacaatcacccctaataacaggctgatggcaatgcctaaaggaatacgacgtatcgtcataaatttaatgataggcgaacaaataatcgcaataaatagtgacaataaaaatggtacgacaatttctgccgccgatttaatccccgctaagatgataataattgcggcagtggcaactagcgctttggttattgatacttggtgttgttccataattccccgaaaatgagataaaaagcaagcggtcaaattttaacatttttttactatgaacgctaaaattcaaccgcttaccattttgttacttatactctgagtgatatttttgcttcatatcatcaagtgcttccagcgtttgttttgcttgttctaaatttcctgcttgagcttgttgctccgcttgcttcgcaacatcaatcacttgttgcattgccgcttgatagccaacaaaacgttcttgatcaccgtccagacttgccggcatcgtctctttcgctttttccgcttgcagtaaaaatgcagcaacagaagtttggaattgttccgtggtttcagcatcttgcaatatatttaactgttttttcatttggaacatttccatcataaccccttttgaaaaagccatactcgaaaatgtcaaaaatgtcgctacaactagccatttaaattttttcataattttcccacatttcaacgaaatgaattaagcacaaaaagtcgcatcctaatctatctattgcttgctagaaagcgatatttcttggaaaatagacacttttacgccttccacttgtggagggtactgacttgttatcagaagagaataaacctatgtccgaattaaaataccctaaacccgaattactttcgcctgccggcaccttaaaaaatatgcgttacgcttttgcttatggcgcagatgccgtttatgcaggccaaccgcgttatagcttacgtgtacgtaacaatgaatttaaccacgctaacttacaaatcgcgattgatgaagcgcatagcttaggtaaaaagttctatgtggtggtgaatattgcgccgcacaactcaaagctaaaaacctttatcaaagatttaaaagttgtggtggatatgaaaccggatgcactgattatgtccgatcccggtttaattatgttagtgcgtgaaaacttcccggaaatcgatattcacctttcggtacaagcgaatgcggtaaactgggcaacggtaaaattctggaaacaaatgggacttactcgagtaattctttcacgtgaattatcattggaagaaatcgaagaaatccgccaacaagtaccagacatcgagcttgaaatcttcgtacacggcgcactttgtatggcatattcaggtcgttgcctattgtccggttatatcaataaacgtgacccgaaccaaggtacttgtaccaacgcttgccgttgggaatacaaaatggaagaaggtacgacagatgacgttggtaatattgtgccacaatctgccgttcaacgttacgagccggagatcgaagtgaaaaatattgcgccgacattaggtgaaggctcacataccgataaagtattcttatacactgagccaaatcgcccagacgaacaaatgactgcatttgaagatgaacacggcacttactttatgaactcaaaagacttacgtgccgtacaacacgtagaaagattaacccaaatgggcgttcactcactcaaaattgagggacgtactaagtcgttctactattgtgcgcgtaccgctcaagtttatcgtaaagcaattgacgatgctgcggcaggtaaaccgttcgatgaatcattaatggacaccttagaatcactcgcacatcgtggttataccgaaggtttcttacgccgtcatacgcacgatgaataccaaaactatgaatacggctactcaatttcggaacgccaacaatttgtgggtgaattcaccggtaaacgtaacgctgaaggtatggcggaagtagcggtaaaaaataaattcctcgtgggggattcggtagaaatgatgaccccgaaaggtaatatcgtgtttaaaatcgagcgtatgctaaaccgcaaaaatgaacaagtggaagcggggcttggtgacggacattttgtctttttagatgtaccggtgaatattgaactagattatgcacttttaatgcgtaatcttatagattctaatacaagaaatccgcacaaagcgtgatcaatctcacaaatttagcaatatattgtaaagattgaaaatttattattgcagttatgaattaaattcatataattaagattcaatactcatagaagtatgactccataataagttttacccctctggaatgaggggtttttttatgcttattagaaatttacacgattaaatcgtctttcctttctttctcgatttttaagtataatatttcgttaaaattttttatgtgggactcttatgctagcgcaaattaaaaataataaaagccaaatctattcgggactaattgctctgttctttattttaatacttcaatttaaacttagttacagtcttatccctatcttattagcattatctgggatcgcattactgataccacacataaaaaataaatcctatcatttagccaaatccgataaatggctaattatcactttcgtctgttattttttactcttcgtcgtatcacttattgtgcataaaggaaaaggcagcgaattagatcttgctactcgagcgttattagccttacctattttaacgatattttataaacatcagctcaaacagctatggattgtgtatgcgatcttaatttcagggattggtaccggtattaccagtatgattcaagtatttggatttgattttatcagaccatttcccaaagttatgcatattcaagccggtgatatcgcaatgtcattagcgatgttctcattttgtacactattttatttttatacacaaaaacagcgtcttgccatgtatttcagcttaattgctgcattatttgcgattattgctagctttctcacgaccgctcgaggagcatggattggcgtaccgtttgtactgttcattatcttttggctgaaccgtaaatcactatcaaaatggcttatctcaggtgtattattcattacacttgccggcggcatttttactagtgaaacaattcataaacgttaccttgatgcacaaagcgatattactgcttatgttaatggttcaaataaaagtacctcggttggcgcgcgtttcgatatgtggaaaagcgccgttatcggtattcaggaaaaacctatattcggctggggactccaaggtgtgaaagaaatgcgcaaacagcatttttcggaaggaaagatctctgaatatgctgcaagttttggtcatgcgcataatcaatatctacatgatgcttcaactagaggtattgttggacttatcgcattgcttgcgacattattcgtaccgctagtcctattctggaacggattaaaacaatcggaatccaattcccttgcacatttatggggcgtgttggggattacccatattttattgatgatgggttattttctaacccaagcttttttatcacataactccggtgctatgttttattttattacaaccgtgatttttttaggcttgcaaaaaaatgcgctaaatagaccgcttatggagaccaaatagtgctacgttttttttatacgattttaagctacatcattcaaccattgattttattaatgatgtggaatcgtgggcgtaaacaaccggcctatcgccgccgcttattggaacgttatagctactataataacgataagcagccgcatgaaaatggcataatcgtacatgctgcatcggttggagaagtgattgccgccacccccttaattaaggcaattcaaggtaaatatcctacgctaccgatcaccgtcacgactgtaacgcctactggttcggctcgtgttcgtgcagcttttggtaatagcgtaacacacttttatttgccttatgatctgcccgatgcgatggcccgttttttggattttataaaaccaaagttgattattgtaattgaaaccgaattatggccgaatttaattcatcaatcgcataaaagaggcatttcattcgtgattgccaatgcacgcctttcgcctcgttcagcgaaaagatacggttggataaaatccggtttaacaaatatgttaaatgaaatcgatttaattatggcgcaagatgcggtaagtgcagagcgctatctggatctcggattccacgataagcacctcattaataccggaaatttaaaatttgatttagaaataaccgatgaattgcgtaataaagtcgagctgactaagcaggaactcgagttaaatcaacgtccagtttggattgccggaagtactcacgaaggcgaagaaaaaatgttgcttgatgcacataagcaactattaatgcgttggcctgacttagtattaattttggttcctcgccatccggaacgttttgacagtgtcgaagatttactgattaaatctgaactaaattacaccaagcgcactgataaattacctttaaaagcaaacactcaggtgttattaggtgatactatgggtgaaatgatgacgctttacggcttagctcaaattgcttttgtcggaggaagtttggttaagcacggtgggcacaatccattggagccgatagcctttgaacttccggttatatctggtgtacatacatttaattttcctgaaattttctcaaaattacgctatgtaaaaggtgttgttgaagtaaaaagcagtgaaaatgatcttgcacaagcggtcaattttttactcgagcatccaaatgcttgccaagcgattagccaagcaggctttagcgtgttacaagaaaatcaaggggcattaaagcgtcatatgcaactacttgcaccttatttagagaaataatatgagttataccgttatctatgccggcacatttgatccaattaccaatgggcatttagatattattgaacgtgcagcaaaattatttggtcgtgtgattgtcgctgtggctaagaatcccagtaagcagccactcttctcactagaagagcgaaccttattagtgcaacaaagttgtgcacatcttaacaatgtacaagcggtcggatttagcggattacttgcagattttgctgtacaacatcaggcaaaagcattagttcgaggtatacgtggaagcgatgacattgaatacgaaattcaattagcacagttgaatgaaaaactggaagaaggtttagaaacgatttttcttccgccagccgtacaatggcgttatctctcttcgactatggtacgagaaatttatcgtcaccaaggtgatgtcgcacaatttgtaccgccattcgtgctaaacgcgttaaaagagaaggaataaatatgagtaaactagacagtcaaaatctgatttggattgacttagaaatgaccggtttagatccggaaaaagaacgtattattgaaattgcaacaattgtaacggataaagatttaaatattttagccgaaggccccgtgttaaccgttcaccaatcggatgaactgcttaataaaatgagtgattggtgcattaaaacgcatacggaaaacggcttaatcgaacgagtcaaacagagtaagttaaccgaacgcgctgcagagctacaaacgctcgatttcttaaaacgatgggtaccgaaaggtgcttcaccgatttgtggaaatagtgtgccgcaagataaacgcttcttatataaatatatgccggatcttgccgactattttcactatcgtcacttagatgtcagtaccctaaaagagctcgctcgccgttggaaaccggaaatacttgaccagtttaccaaaaaaaatacccatttagctttagacgatattcgagaatctatcgaagaattaaaattttatcgtacacatttcatcaaattagattagaatacgctcttttttcactaaaattgaaaaattggcttgcaagtttatattttttaaccgatataaacttgcgttctaaaaagaaattcgtataatcctaggcgttttgctagtcgacaaaatgccttatgcgggaatagctcagttggtagagcacgaccttgccaaggtcggggtcgcgagttcgagcctcgtttcccgctccattttctctccgaattttcttccaaatttttcaatttttatttcttaattaacattattagtcttgtaagtactcattacggaaatgtcagattcaatcactttttattttccaaccgagcaacaaatgttgcaatttgggcaaacattggcaaagcatatgcaaacctatttaaactgctcgcctcagtatgcattagtcgtttatttaaacggtgagttaggtgcgggaaaaacgacattaacacgtagtatcgtgcgtgaatttggtcatattggaaatgtcaaaagtccaacttatacgttagtggaggaatatcaacttccgccttataccatttaccattttgatctctatcgtttaagtgatcctgaagagttggaatttatgggcattcgtgattatttccgcccacaaacggtttgtttgttagaatgggctagccgtggtaaaggaatgattcccgaagcagatatcattattcaaattgattatgccgaagaagggcgcaacattacgttgctaccgcaaacttcagtgggtacacaacttttagtaaattttaatctaaattaaaccgcttaattgaaaggaatgagatgaacaagttagtaaattatattgctgttagtttatttggcttattttttagtcttagcagttatgctaaaaccgtggttgtaattgatgctggccacggtggtaaagacccgggtgcaattggtgccacactcggcgtaaaagaaaaaaacattactttagcgatttcaaaagagttaaaagcattacttgattcaaatccgaaatttaaagcagtaatgactcgtaaaagcgactattttattcagcttccagaacgtactgaaattgcgcgtaaaaataaagcaaacttactcgtctcaattcacgcggactcatcgcctaaatcgaatagtttaaagggtgcttctgtttgggtgctttcaaaccgccgtgctagcgatgaaatgggtaaatggcttgaagatcatgagaaacaatcagaattacttggtggcgctggttctgttctttcaaatactaacgaaaaatacttaaaccaaaccgtattggatcttcaattttcgcactctcaacgttccggttatgaattaggcaaaacggtattatcacgtttgggaaatgtcacttctcttgccaaaagtgcgccgcagcacgcaagtttgagtgtgttacgctctcctgatatcacctctattttggtagaaaccggctttttatcaaatccggtggaagagcaaaaactttcaacgccagcatatcgccgaaaaatcgctcaagctatttataatggcttagtagcgtatgtttcacgcagtacaggcaataccaaagcagtctataaggaagtgaaagacacttcgacagatactaacaaaaaagaggctaagcagaaaaaatctggtcatccggagaattcatctaaaaaagataattcgaaaactaaagtcgaagacaaatcgactaaagataagagaaatagtaaaaataaagagcaaaattccacaaaacaagaacctaaaaaatccaataacggttatcacattgtgcaacaagatgaaacgctctactctattgctcgtgtctataatacaacaccggaaaaattgagtaagctaaataacatcaaaaacaataagattaccgtaggtaagaagcttaaagtacaatagtaaaatcaagcggttaaatttgtaaaaaaatttacaaatttaaccgcttatttttttgcgttcaataaaaagcaaaaacctcactgaaaacagtgaggtttttatcagattacctgaagttcagcaaggattaacccataccgtatttttttaattttttacgtaatgtaccacggttaatgcctaacattgttgccgcacgagtttggttaccacgtgtatattgcattaccatatctaacatcgggtgttcaatttcagataatactaattcgtataattctgttggatcttcaccgtttaattgagataagtaattttttaatgctgcttttacgttatcacgaagtggtttattcacttgttgagcttgagcatttaacattgatacagttaatgggttttgtgtaggttgttgttctaacattgtcctctatccaactaaataaggattctaacgaatcgatttcacaaaatcttccaatgccaaaagctgttcttttgtcgattctaaggcattgaaagtacgtttaaaattcgagcctggcgcaagttgttctacataccaaccgacatgtttacgtgcaattcgataacctttctcctcaccataaaactggtgaaggtcttctatatgcttcaacattagttcgcatttttcatcaagtgatgagtttgaagaacgtccattctctaaaaaatctttaacttccttaaataaccaagggcgaccaaaactgcctctaccgatcataaccgcatctgctttggtgtaatctagaacatattttgccttctctgcggaagttacatcaccattagcaataatcggaatagaaactgcttgtttaacggctttaatgctttcatattcggcttcgccattgaataaacaatcacgagtacgaccatgaatcgttaaagcggagatacctgttttctcggcaattttcgcaatctccaaacaatttctattttcttgatcccaacctgttctaatttttaatgttacaggcacatcaacagcatttacaaccgcatctaaaatttgagcaacgagttccggttcacgtaaaagcgcagatcctgccatctttttgtttacctttttcgctgggcagcccatattgatatcaataatctccgccccatactcaacattcacttttgcagccattgccatttcttgtggatcagccccagcaatttgcacggcattcacgcctatctcttcatgatgcgcaagcctcaagcgagatttttcggtatgccatacatcggggttagtggacatcatctccgaaaatgttaaaccggctccaagttgactacacaaacggcgaaacggttggtcggtaatacctgccatcggcgcaaggaaaatacggtttttaaattcatactgtcctatttgcatcttactcacaccgtaaatgattaaaattaaagcgattttaacgagagagacatccaaataaaaagtacggctaaaaaaccgtactttcttatttaaacctttcaggctaacctgattttcgaggtgcgtatgatacgcacttttttcctattttggaagtctatttattcgacaatttttaaaaatatttaaaaattttgcataattccgcaaaataccgcgaatttatggcttttcaaccgccgttattttgccaaaattactctgccaatcaatttcagcgatgatcgcaggataaaaatgcaccgtttcttgctgagcagttaacgctaagaccaaatcatacaccagtggcaaatgagaaataatcaatacattctttgccccttcttctcgtaaaaaagctaaatagctacaaacattatcaagatcacctgacggtgtaataccttcccaaatttcaatcaagttttcatttgtgaaatttttacctaaatcgaccgcttgcattccttggaataagcaatcaagcgtttgctgtgttcggcgataagggctgactaaaattttatctaacacaatttgctgagcgttcaaacgcttagcaagccattctccttgctttttagccacactctctccttgagaagttaaagtacgttcactgtcagaacttgcattaaaaccagcctcaccgtggcgcataacccaaatattcataggaaaacctcattactgtatttaaacctaaaagatttaggcgtataatgtgccacgattgagacagaatcaagccctgtcataaaaagaatttttaatttcgacaaatcaatacattacggagtctattaatgtctagaaaactcagaagaaccaaaattgtttgtacaatgggtccagctacagaccgtggcaataacttagaaaaaattattgcagccggtgcaaatatggttcgtatgaacttctcacacggtgtgccggaagatcacatcgagcgtgcaaataaagtacgtgaaattgcagctaaattaggtaaaacagttgcaatcttaggtgacttacaaggtcctaaaatccgtgtatcaactttcaaagatggtaaaatcttcttaaacatcggtgataaattcactttagatgcagatttaccacgtggcgaaggtcaccaagacgctgttggtttagactacaaaaacttaccaaacgatgtagtaccgggcgatattcttttattagatgatggtaacgttcaattaaaagtgctttctgttgaaggtgtaaaagtgcacacagaagtcactgttggcggtcctttatcaaacaataaaggtatcaacaaattaggcggtggtttatctgcacctgcattaacagacaaagataaagaagacatcaaattagcagcgaaaatcggtgttgactatcttgcggtatcattcccacaatcaagtgcagacttacactacgcgcgtcaattagcacaagaagcaggtttaaatgcaaaaatcgttgcaaaagtggaacgtgctgaaacagtagcaactgaagaagcaatggacgacatcattttaggttctgacgttgtaatggttgcacgtggtgacttaggtgttgaaatcggtgatgctgcgttagttggcgtacaaaaacgtttaattcgtcgtgcacgtaaattaaaccgcgtagtaattactgcaacgcaaatgatggaatcaatgatcaaaaaacctatgccgacacgtgctgaggttatggacgttgcaaacgcggtgttagatggtactgatgcggtaatgctttctggtgaaactgcaaacggtgactatccggtagaaacggttaaatcaatggctgaagtatgtttaggtgctgaaacaatgcctagcatcaatatttctcgccaccgtatggaaggtactttctcaactatcgatgaagctgtagcaatgtcagcaatgtacactgcaaaccacttagaaggtgtttctgcaatcatcgcattaacacactctggtgaaacagctaaattaatgagtcgtatcagctcaggtttaccaatttacgcattatctcgtaaccaaaaagcattaaatctttctgcgctttaccgtggtgttacaccggtattctacgatgaagaaagccgtacgattgatggtgcgaaaaaagcaatcgcattattaaaagagaaaggttacttaatgtctggtgatttagtgttattaacacacggtgatgaattaaaagaaggcggtacaaatacttgccgtattttaaaagttgaataatcactgaattcaatctaaaaagcccacgctaatgcgtgggtttttattatgtacctcaatttcaatacgcaaattccaatgaaaaaacaaccgcttaatatctgtattttacgcctctccgctattggtgatgtatgccataccctagctgtcgttcaggcaattcaacgtcaatatcccgatgcaaaaatcagctggataatcggcaaaaccgaagcaatgctgatgcaaggcttggaaaatgtcgaactggttccctatgataaaaaaactggatggaaaggaatatttacactttggaaagctctagctaacaagcggttcgatttcctgttaaatatgcaaactgcttttcgtgcttctatgatctcgttaggcattaaagccactaagaaaattggttttaatcgagatcgtgcacgtgaaatgcagtggctttttaccaatgcaaaagtagaaatgaccacttctccacacgtattagatgggcaaatgatgtttgctaaagcaattggtgtaactgatttagctccccgttggtcactgcctttagaccaatctgatcttgattacagtgctacttttatcgataaaaccaagaagaatgtcttaatttcgccttgttccagtaaaaaagaaaaagattggagagcagagtctaatgcggaaatcgctcaatggcttaccgctcagaatatcaatgtgattattgccggatctccttctgcttatgaaatggaaactgcaaataaaattcaacaacttgcgcctaattgtatcaatatcacagggaaaaccagcctaaaacaacttgcagcattaattaaacaagttgatctagttatctcgccggataccggtgcggcacatattgcaacgacacaagcgactccagttatcggcttatatgcgatccataatcctcgccgtactgcaccttataatgctcaacacaacgttgtctcggcttatgatcaagctgtcttagattattatggcaagccatggaatgagttaccttgggcaactaaggctcgaagtaaatcaggcgaaaaattaatggaacgaatcagagtagatgatgtgaagaaaaaaatagttgaaactctagctgtaaaattgtaaagtagccctgtattattttttttacacatacaggaaacaaaaatgaacaccgtagttaaccaagatagtttacataatgtaaatattgctgatgaaaaagtattgctcacaccggctgaactaaaagcggaatttcctctgccggaatatttacgtaaacaaattgaaacatcacgtcgtgagatctcagatatcattcataaacgtgatccacgtaaactaattgtgattggtccttgctctattcacgatccggttgcggctatcgaatatggaaaaaaattaaaagcattagccgacaccgtttcagataaactttatatcgtaatgcgtgtttactttgaaaaaccacgtaccactgtgggttggaaaggtttaatcaacgatccgaaaattgacggtacttttgatgttgaaaccggtttacgtgtcggacgtaaactatgcttagaactcgccgaattaggtttaccgctcgcaacagaggcgctagatccaatgacaccacaatatttagcggatctctttagttggtctgcgatcggtgcacgcacaaccgaatcacaaacacaccgtgaattagcttccggcttatctatggcggtcggttttaaaaacggtacggacggtagcttagcggtggcaatcaacgctatgcaatctgctgcgcaaagccatagctttatcggtatcaaccaaaaaggtcaagtaaacttattacacaccaaaggtaatccggacggtcatgtgattttacgaggcggcaaaacaccaaactttgaacaacaatatgttgaagaatgcgaattagcgttacgcaaagcaggcttaccggaagcaattatgattgactgcagccacggtaactccaataaagattaccgccgtcaaccattggtagcggaaaatgcattagcacaactgttagcaggtaatacttcgattatcggtttaatgatcgaaagtcacttaaatgccggtaatcaatcatcagaacagccgtttgatgaaatgaaatacggtgtatctattaccgatgcttgtatcgattggcaaacaaccgatgaagtattaactaactttgccgaaaaattaagacagaaataacgaccgtaaataatttggtaagattcacataaattaaataagcggtcaattttgcaaaattttatgcaaatttgaccgcttgtttaatgagtcttccgacagaatgaaggaacaatcaatgagcccattaaatcctttacgagaaaaaatcgatcaagttgaccaacaattaattcaactatttgccgagcgcttaaaactggttgctgaagttggaaaagtaaaatcggaacacggcattccggtttacgcaccggaacgtgaaaccgcaatgattgccgcccgccgagaggaagcagaaaagcaaggcgtgccagctgacttgattgaagatgtattaagacgtgtcatgcgtgaatcttatgcgaatgaaaacaagcacggcttcaaaacaactaacccgaatatcaataaaattgtgattgttggtggtaaaggtaaattaggtgggttatttgctcgttttcttgggctttccggttaccaagtcgaaacattgggcagcaaagattggaacaatgcagaacaaatccttagcggcagtgatttagtgattgtctgcgtgccgattaacaaaaccttagatacgattgagcgtttacaaccgttcctgactgaaaatatgattctagcggacttgacctcggttaaagctcaaccgcttgaaaaaatgttggaaatccacagcggcccggttgttggtttacatccgatgtttgggccggatattgcttcaatggcaaaacaactggttgcctgctgccacggacgtttttccgaaaaatacgaatggttaattgaacagataaaaatttggggtgcaaaaattgaagtgattgatgctcacgagcacgatcatgcaatgacttatattcaagctttgcgtcacttctcgacttttactttcggtctgcatctatctcgccagccggtaaaattatctcaacttttagcactctcctcaccaatttaccgtttggaattagcgatgatcgggcgcttattcgctcaagacggtggcttatatgccgatattatttcggataaaccggaaaatctggcggtaattgaatcactaaaagacacttttgcaaccagcttagagttctttaaaaacaatgatagagccggttttattcaagcgtttgaagaggttcatcattggtttggtgattattcggagcagttcttaaaagaaagccgaatgttactgcaacaagcaaacgataaccgcaaatagtaacaaagctcatctgataagtgatctgaccccaaaaagttagactgtttaatttaaggactgagttctgtattgtacagggctcagtccttttaatttcacttgaatacgctcattgttgtaataatgaatgtactcgtgaatcactttctcaagttgttcgaaagtttcaaatcgcttaccaaagtaacattccgttttcaatcgcccaaaaaaactttccattgccccattatccaagcaattcgcttttctcgacatactttgtttaatatgatgttttctcagcatgtcttgatagcctgccatctggtattgccaaccttggtcggaatgtaaaatcggtttagcgtccttaggcagtttcgcgaccgcttgctttagcatccgcatcacttgctcaaagttagggcttcttgctaaatcataagcaagaatttcactattaaacaagtccttaataggcgataaatagagcttgccttccgcacatttaaactcggtgatatccgtgacgagcttttcatttggcgccgttgcgtgaaaatcccgttgcaatacattctcggcaattttaccctcttcaccttgataagaacgatatttcctctgcttacatttcccttttaaatcaagctgttgcattatcctttgaatacgcttatggttaatcgcacccaaaaaatcacgtaactttaacgtaatacgacgatagccgtaattgccatcattatcttgataaatctcaatcactttctgcctaatcactgcatttttatcgattttaggcggtaagtgataaaagaacgtactacgttttaaaccagtcaaagggaggaggatttctaagggaaaatccactcgcaacgtttttacgatggctgcttttgccgcattttttgttggttgaactcccgcaacttttttaggtaagctacctctgcttccagctctaaaatacgataacgtaagcgttcttcttcagttttaggtggaggaggcattttcgggtatttcggtttcattgtcggacgacctttgggcttgggtaataagccgtttataccttgttcttcaaagatgtgcaaccattggctaatcgaacctgaattagcaatgccaaaatgaagggaggcgctttccgcagaaaattgcccctttttgaccgcttgtatgacggttaatttgaattcgggggaatatttttgcttcttacctatcaccgctagcccattgattccgttatgattaaattgagcaatccatcgagttaaggttttcttggataattgaaaatatcgttgagtgaataaacggtttttgtcattttgaagataaaactcgatgacttgttgtttgaattgttggttatatttagtcataaaaaatctgcaccttaatccgttggaggtttagtccaacttttggggggcagatcaaagatgagctttttctttattgattaactaccgcttgaattttctgctcaatgcctgccgcatctaagcctaaatctgcatagctttccgcttgggtcgcttgtggcacaaagaaatcaggaataccaagcatgacaagcggtcgaattttaccgattttttgcaaatattcattcacaaaactgcctgcaccaccttgaattgcattttcttccaaggtcaccaataaatcatgcgaatccgctaattccgctactaattgttcatcaagcggtttcacaaaacgcatatctaccagcgtgtaattatgtttttctgcaacaatacgtgcttcatttagcaatggcccaaagtttagaatcgccactttttgcccttgctgaatcagcttacctttaccaacttcaagtgcttgcatcggttctaacgccacaccttgcgcattacctctcgggtaacgtaccgctgttggtgtattcatgcgataagccgtataaagcatttgacgcatttcattttcgtctgacggacacataatcgtcatattcgggatacagcgcataaaactcacgtcaaacgcaccttggtgagtctgcccgtccgcaccgacaatcccagctcggtcaatcgcaaaaatcaccggtaaattttgaattgccacatcgtgaatcagctgatcgtaagcacgttgcaagaaacttgaatagatcgctaccaccggtttataaccggcaatcgctaaaccggcaccaaaagtcaccgcatgctgttcagcaatcgcaacatcaaagtattgttcagggaagcgttttgaaaactccaccatgcccgaaccttcacgcattgccggtgtaatcccaattaatttgctgtcttgttccgccatttcgcatagccaattaccaaaaatatccgaataagttggaatcgtttttgatttcggcaattgcccacaagtcgggtcaaatttaggcacgccgtgatagccaatcggatcattttccgccggctcgtaacctttaccttttttggtacgaatatgcaagaactgcgggccttttagctcacgcatattgctaagcgttttgaccagctcatcaatattatgaccgtcaaccgggccgatatagttaaaaccaagctcttcaaacaaggtactttccggcgagatcacccctttcatatgctcttcacttttcttcatgaagtttttaatggtcggaactttatccaatacttttttactgccatcacgcacggttgtatagattgaacctgagaaaatacgagctaaatgattatttagtgcgccgacattctcggaaatcgacatttcattgtcatttaaaatgactaacatatccgtatgcatcgcaccggcatggttcatcgcttcaaatgccatgccggcagtaattgcaccatcgccgatcacacatacggttttacgtcctgcattttctttttccgccgctacggcaataccgacaccagcgctaattgaagtagatgaatgaccgacgcttaatacgtcataaaggctttcttcacgccaagggaaaggatgaataccatttttttggcgaatagtatgcatttggtcacgacgaccggtaagaattttatgcggatatgcctgatgaccaacgtcccaaatgagttggtcaaaaggtgtttgataaacataatgcaaagccaccgtaagctctaccacccctaaaccggaggctaaatgaccacttgtttggctaaccgattcaagtaaataagcgcgaagctcatctgccacaggctgtaattgctcttttgcaagcaaacgcaaatcttccggagagttgatttggcttaacagaggatatttgttttgcatagtgttttcttttttaatttaaccacgagccatatggattaacacgggtattgcaaaataagccggaaatttgaccacttgtttgttttacccgtgaaatctatggtttaaatttttaaattagtttttaagatcttcagttaatgccggctgaatcgtatttaaaatctcttttaccacacgagcctgacctgcaacaacattacctgattttaaataatctgttccaccaacgaaattcgtaacgatagcaccggcttcacgcgcaattaaatcgcctgctgcacaatcccacggttttaaaccgatttcaaagaaaccgtcaacacgatttgccgccacataagctaaatcaagcgctgcagaaccggtacgacggaaatccgccacgccgttattcattaagccttcgagcatatttaagtgcgcaggacgatgtttagctgctttgaaagggaaaccggttgcaagtacagtaccgtttaaatcacggcgatctgtttctacacgtaaacggaattcattgagttttgcaccttcaccacgaacagcagtgaaaagttcattacggattggatcgtaaacaacacccaccgttgtacgaccattttcacgtaccgcaatcgaaactgcaaaatgaggtaagcgtttcacgaagttagttgtgccatctaatggatcaatcacccattgcacattttcgttttcgcctgccaaaataccagactcttcaccaacaatagcgtgatcaggataagatttacggagcacttcgataatcgccgcttccgccgctttatcaattgcagttacataatcgtttgtacctttttgagccacttcgatttcactcgcggcttgctcatagcctttagcaataatattgcctgcttttcgtgcagcacgaatagcaatgtttaacattgggttcataattccaccagattttaaagaacataaaaagacgagtgattataaagaaacttaccaaataaaggaataacaagcggtctgattctcaaaattttttgcaaaaaagcgatattttactatacgaataaactataatagtcccaaattttccctaaggaacgatagaatgaaaccaaaatttaatgaaaataaacctcgctttcaaactgttgatgagcgccgagataacaaattccaaaccaaatcaaaccgattcaacgatgaacatcactcaaatcgtcgcgaacaacgtaatgatcgtgcctccaaccgattcgaagataaacctcgttttgataaaccgaaattcggtggcgacaaagcccgctttgagcgtaaagatcgccaagaagctcgtgaagtgctttacccgacaagcgctaaaaaagctagcggcgaaggcaatgtgcaaattagcgtaaaaggcggcaatagcacaattaaagagaaaaaaaccggcccgctttctccccgtgcaccggaaaaaattaagaaaaaccgtgcggaagaaatgaaagtgtacggcgaaaacgcttgccttgcattgtttaaacaacgaccggatgcgattgtgcgtttatgggcaactgtagaaggggcgaaaaagttaggcgatatgcttagctacttagccgaacacaaaaaagcttatcatgtggtagatcgtgccgaaatggaacgtgtcaccggcacagaacatcacggtgatgtctgtttattagtgaaaaaagcagtgccgttctcattagaaggctatttacaagtgccacgtaaacgtgattgtttagtcttactggatgcagtgaacaatgcacaaaacgtaggaggtattattcgtacttgtgcgttctatggtgtaagcggtgtgattgtagaaagtgccgatacgcttaattcaagcgctgcagctcgcgttgctgaaggtggtttagaatttgttcgtccgctcgaaactaaacataaacaaatcgcactgacgcaattacgtaacgccggctatcaaatcgtccatttaactcgcaataaacaagcagcatcactggcaaaaacgaaattagctgcaaaaacggtattcgtattaagtgaaattccggcacaagacgttgagtatccagaagataccactgtacagctttcttttgaaaacccgcttaacagtggcttaaatgttgcggtaagtgctggtatcgtgctgaatcaatggtatcaaacgcatatcgtttaagattaaaactaaaaaaacaggcttacgcaaaaacgtaagcctgttttactttagaactttgttagcttattagcccttttattccatcaaaaattaaaatcatcccgaataaaataaaaatcacaccggcaacattatcaatatagcggctatattttgtataaaattcttgtatcggtcggcgagaaaacagcaatgccactaatataaaataaattagcgttgaaaataaaaacaaaaataataaaagaaatagatcagaagtttgagtaaattgagcaaggaatgctgaaacaacacttgtaaaataaacaccagcctttgcattaaagatattgatcaataagccttttttaatttcagtcacattatctaatactctaagattcgttggctcattcgtgaatattgcattttttgtaacccttaccataagtgaaccgatataagataaatagatgccaccaatcaccataattaaaaattggaacaccgtaccaatcgtattactcaaccaagccaagccgaaaatggcaaaactcgcccaaaaaataatccctaatgaaatcccgatcgccgctaaaatgcccgctttagttgaatgacttgcggattggcgtactacataaaaaaaatccggaccggggctggctaagcctgctagatgaaccaacagaatggtaagcatatactctcctaaataaaccaataaattaaatgtaaaacaatcagcgcataaacagctgcaagaatatcgtcaaacataatacctaaaccggtttctaatttttcatcaaaataacgaatcggataaggttttaatacatcaaagaaacgaaaacaaataaacgttagtagataagctaaccaattatattcaggcaaaaatgcaaacatcagaaaaattgccacaatttcatcccatacgatacgcccgtcatcatgcacgtttagatcacgactggttcgctcgcaaatatggcaaccggcaataaagctcacaagagttaaaccaataaagaataaagcactctcggttaaattccacaataaaatggcaatcaaaacaccagcaagtgacccccatgtccctggtgctggctttaataaaccggaaccaaaaccgcaagcgaataaatgaataggattttttaaattaaaatgttgcatagctattttttattatgatttgaaatgatcaaaaccaacttgagatggtaacggcacctgtttgccattttggcgtaaaatcagaccgcttactgctgggatgattttaccgatacagctaaccttaatcccttgagaacgtaaaatttgttccatttccgaccgcttgtcatccgatacggtaaagcataactcgtaatcttctccaccggttaacgcaaaacgaagcgcttcttgctcactatatttggtcattaaatgtgcagaaagcggtatgttatctagttcaatctcagcaccaacttgactgcgttctaaaatatgacctaaatccgctaataaaccgtccgaaatgtcgattgcacaacgagaaaacgctcgtagtgccagtcctaactccactcttggcgtaggtcgtaaatggcgttgcactaaatagcggtcggattcgtccgaaattttacaatgattcaacaacagcgataaaccggctgcactatctcctaaactgccggaaacaaaaatccaatcaccgactttggcttgatgtcgaaacaatccttgatctttaggtaaaataccttgtgcggtaagcgttaaagaaagcgggccgccagtagtatcgccaccaatcaaatcaacatgataacgatctaacacagcaaataaactttggctaaactcagtaagccattgatgatcaactttcggaagcgttaaagctaaagaaacccaagcgggagttgcgcccattgcggctaaatcacttaaattaaccgccaatgttttataggctagatccgcagcggaaatagacggaagaaaatgggttccagatacaagtgtatcggtagtaatcgctaaacgttcatccggctttaaggtagtaaccgcacagtcatcacctacggataaatccacgtctgaacgtacattattacgtttaaaatattgtgcaatgacttcaaattccgtcatttttcctccgtaacagaacaaaaaaagaaggcgaacctacgctcaccttctttttatccataaattatttacgacctaaagccggtgctaatttatctaaaataccattgatatatttatgactatcgtccgagccgaatacttttgccacttcaataccttcattaatcactactttataaggtacgtcaagttcatattttaattcatatgctgaaaggcgtaagatagtgcgctcaatcggatctacctcatcttccgcacgatctaaaaatgggcgaagatcgctatcaatcgcttctacatataaaaccgtaccacgtaataatttacggaaataaggtaaatcaacaccattcatatcttggtctgttacaaacgataattcaacttcttctatactgttttgcgagacataccaagaataaagagcctgaaccgcacactctctggcacggcgacgtggagaaactttcataaaacctctgcgtttattataaagagcaaaatggcggcatttgaataaaccgccacacaaaaattcatacgcaatcgataaataacttattgcgatttaagagagagattttaacacaatttatcttattttggcggtaatttctgtagagaatgcgaggaaatttgctgtttttcgcttttgataatataaggtgtaacgaaaataactaattcacgcttactgatcctatcactggaatggctaaataattttttaagtactggaattgaacctaaaattgggactctatcctcaccttttgcagttaaatgctgaaaaataccaccaagtacaatagtctcaccgtgttgagcaaatacctgagtattcagttcctgcttatcaatcgtcactaaaccgtgtaccgttgaactggttgaatttggtgaattttgtgtcaccaccagatcaagcaaaatttgattatcgtttgaaatatgcggtgtaacctgtagccctaaaacggcttctttaaattcgatatttttcacttcatctttacggttataaagcacataaggaatttcagtcccttgtttgatacttgccggtttcttattagtggtcagtaaacgtgggctggcaataatttctacatcattttcttgttccaaagcggtaagttccaaatcaagcactcgcccattaatttttgccacttgtagcgcaagtgaagcagcattatttaccggaaaattgacgtttaaatgattagtattcggtagcccatttgcttcaagcgaaccggcaattttatgatgtccgtttgcaggagaaaacattccccaacgcacgccaagctcttgtaaattctcactactgattgtgactattctcgcttcaattgcaatctgttcggtcggtctatccaaatttctgattaatttcacgatatttttcattgattccgggctatctttaataatcaaactattactgcgatcatcaaaatgtaaatagccgttttccgataaaaaattaccgctacctttagttaaagattcaattacttccgctgctttagcataatctaacttaatggttttagtaatcagtttaggttttaataattccagatttaatcccctgttaggatccttatcgtcttttttatgaccaataaaatagatttggttttcatacgcactggtcaacttatttgctcgagtaatactttttaacacactatcaaaattgctattttcaattcttaatgtggtattcgtttcaatattgtcgcttagcacaatattttttccgtgctcttccgctaaataactcagaatttttgcggtcggcgcattttttaatgaaatagaaaacgcatgtgcaatcacagggggcaatataaaaaagagtagcaaaatcattcttttcatattttccacctataactttaaggtaattaaagtcggaaattgacaatttttctctgtttgccaatgtatataactaattgattttaaatcaatatctacgatctgaatcaactcattatctagccaatcattcacttgtagatcaaacagttgcttttgcgtatccataaaaatcgctttatatttatcctgttttttcagtactccgataaattttagctgtgccaattttgccggcaaatagcgggaatttcgttgtgacggtaagttacaagcggttaaattttctgtatttattgcaatctctgattcaggagaaaatgtactattttcatcgtctaatttctctccataaaacgggtctgcactacttattgatgagaaaaataataaaatcaaaatatatttactcatttttgtcctctgttatgataacggtagcttttaattgtaattgcttttcttcatttaactttaccaaatcaatctgtttaaattttaactttttaagtttagagagttttctaattaaattaaatattgtaaaaacttgatgatttaaagataaatatattgctttttcttgccctaaattccattgcatttgctctaattttacttgatgaagcttaaataaatgttgtaattgctgattaacgccactaataaactgttcttttcttttagagtcatcattatgcttggtaaagctctgatagagtaattttttttggtttattacttccgttaattgctgctgaaccgataataattccttctgccgatattgttcataaaaataacgataggatggataactcacaatggaaataaataagccaactagtatcaccttaaaataactttcaacaaaggataatattttaaatatataaccttgaggaaataaataaaacttactaatggaaaacatatttactcccttaatacgacattcaaactaaattccacttgatgctgttcatttatttgaaaattaactaatgaatatttaaatgctttttgttcggataaatatttttctaaccgttcaaattggattgactgcagtaatattccgcttattgtcatacttggaatctcattatgttctaacatgacagcctctactccaccttgcgctaaaggcaaactttgtaacaaatctaaaaaactatttatttggctttcactcaacgtttcacttgaatgaacacttgctaagctttttccttgttctaacttactatttaagtgttccaaatctattttcagctgctggttttgacttacaagcggtctattttgctgagaaatttgccaagcacttaattgcaaatatatagcaaggcaaaaagcaatcatgctgaaagtaaataaccaacaacatcggttataaatttttcgtttccattgctttactcgccaatcagttaaatttatcccttgccattccataaacacgctcctaatgcggttaaatataaaaaaggatcttttatcgattcgggtaattctagatgacttaaattgcagttggctaacgtaagatccgagttaaactcaagtgcttttgctgttaatctaaaagttttattttctaaagcataaattcgatcttcttgtgctaactcagaagcaaataagtgattaaaaccacgagcaaagcaatagagttcacaatctaaaatcgtatcggtttgaagtagaagtgaatcggcataatttctgcgtaaggcataaataagtacacgaactagaccgtcattcggcaatggaaagctttgatagtcaaaataaacgtcttccagtgcaagcggtaattcttgacgtaacacttgcagaatctggctgtaaatcattgtttgattgtaactgagaggtaggaaaagatattttcgccaaatatattgaaaaggtacagagcgaacaaatgtagaatttttaggaaatttgatcgcttgtagccatgaaaaatcagtatcttccgattttgtttgccaagaaacttcgattttattttccgatacgttttcccaaacaaaacagcgataagtatgattttcgctaaaaccaattaaggaaaatttctgtgtatttttcagcaaattggcgaaacttttcacaattttactcctttaaatatactttgtttgatttttaagcggttttttaggtggttttcgcttatacttatatctttatagtatctgtatattggctataaatttttatttcgtcatttaccaaaagagaatttttcgatgaagatcgcaaaaataatattaagtgcttttctttctctcattattttgggagggattgtcgcaggtttagcgtatttccatatcaaagaaagcctaccaaatgtttcaacattaaaaagtgttgaattacaacagccgatgcaaatcttcacggctgacggcaagctcattggtgaagtgggtgaacagcgccgtattccagtaaaactggcagaaattccacaaacacttattgatgcaatcatcgctactgaagatgttcgtttttatgatcataaaggtatcgatccaaaaggaatcatgcgtgctatctggcgttctagccaaggcgatactcaaggtgcgagtacgattacacaacagttggcaagaaacttcttcttaacgcctgagcgtaatatggagcgtaaaatcaaagaagctatcttagcgcttgaaatcgagaaagtattgagcaaagatgaaattcttgaactttatctgaataaaatctatctaggttatcgctctcacggtgtagcggctgcagcaaaaacctacttcggtaaatctttagaacaacttagtttaagtgaaatggcaattattgctggtttgcctaaagcaccttctaccatgaatccactttactcggtaaaacgtgccgaggcgcgccgtaatgttgtattaggccgaatgttagaagtcggtaaaattacccaacagcaatatgatcaagcaaaagcagaacctgtaaaagcaacattctacggtacggctttagaatttagagcggattatgtaaccgaaatggttcgccaagagatggtgaaacgttatggtgaagacgttgcatataacaaaggttttaaagtgtatgcaaccgtactttccactgaccaaaaggcggctcaggacgcattaagtgagaacttaattaattatgaccgccgccacggttggcgtggagctgaaaagctttggaacgacaaaaatgcttgggatgatgagaaaattatcgaacacctaagcaaattaccaaattcagaaccatttgtcggggcagccgttgttgcgactagcaaaaacggttataccattatgttggctaacggcgataaagccgaattgaaaaaatcaaatgcaacatttggcaaatcaattaaattaaatgttggtgaacaaatttgggttcgccaaacaaaaacaggtggcgattggcaactaggtcagattcctgaagtaaactcagcattggtgtcattaaacagtgataacggtgcaattgaggcaatcgtaggtggatttagctttgaacaaagtcgctttaatcgagcgactcaatctttagttcaagttggttcatcaatcaaaccgtttatttataccgcggcaatgaataaaggtttaagcctttcaaccacactgagcgattcaccaattacaattattaagcgcgggcaaaagccttggacgccgaaaaatgcagataatcgctacgaaggcccgctgcgcttgcgtgttgcgctaggtaaatctaaaaacatggtggcaatccgaaccttacaaatggcaggtttagactatgttgcagaatatttagaacgttttggtttcagtcgtgatcaatttatggcaaccgaagcactagcactaggtgctgcttcttttacgccgctagaaatggctcgtgcctacgctgtattcgataacggcggttacctgatcgatccttatattattgatcgtattttagataaccaaggtaacgagttattcaaagcaaatccggccattgcttgtgtggaatgtgctcatattccggtgaaataccctgaaccgacttattttgatggtgtaaaaatccatgatgaagaacaactacgtgaagcattaggtacgactggagaagaaaatattacggaagaggccgaaacagaaattgctgccgaggctgaaccggaaatcaaaccggcagtgaaaactaatgcgccaagcctaatgacagaatccgcgcaaaactcttcagaagttcgttatgccccgcgtgtgattagtggtgaattagcattcttaatgcgtagcgcattaaatagtgcaatctatggtgaaccgggacaagcttggaacggtaccagtaaagcacttgctaatgatttcaaacgtaaagatatcggcgggaaaactggtacaacaaacaattccaaagtgacttggtatgcaggtttcggagctaatatcgtcacaaccgtttatgttggttttgatgataacaaacgtgacttaggtcgtggcgaagccggagcgagaacagcaatgccggcatgggttaaatacatgaaagtagcattaaaagataaacctgagcgtaacttcccgatacctcaaaatattgttgaagcgaaaattgactcaacaagtggtttcttaggcagcaatttaactgagtactttatcaagggtactgaaccaacgaaaaaatatatcgttgaaaaagcctataaactaccacaatcccaggataaacagctacatatcgagcaacgtttaggcttaccgcctaaaggcgttttaagctcacctgaaggcagtgaattattctaaaaaaataatgtaaaaatttggagataatctctcctataaggttgaaattaggtgtgttttcttgagataatcacacttaattttattttgggcgatttgtggcatctatactatttgaattaatcgaaaaatcataattgtaaaatttttcgcaaaacagaccgcttgccattgccaattgaaggcagtaaggcataagcggtcgttttctttccacaagtcgagttgtttaaattagttgtcgaataaatgaagaaaaaataatggctgaaaaacgtaatattttcttagtgggtccaatgggagcagggaaaagcactattggtcgccagctggcacaaatgttgaatatggattttattgattccgattctgtaattgaagaacgtgccggtgcagatattgattggatcttcgatgtagaaggtgaagcgggctttcgtaaacgcgaagagagaattattaatgaattaacccaaaatcaaggggtagtactttcaactggcggtggttcggtattatcaaaagataaccgcaatgtgctttctgccagaggtattgtaatctacctagaaacaaccgtagataaacaatttgaacgtacgcaacgtgataaaaaacgacctttacttcaaacggaagatccacgtaaaacccttgaagagttagcaaaagttcgtaatccgttatatgaagaaattgctgacataacactacaaaccgatgaacagagtgcaaaagttgttgcaactcatatcattgagctaattgataatttacagtaaccacaaggggcaagatatgttacaagtgaatgttgaattaaaagaacgtcgttatccgattattattggagccggcctgttaacggatccgcaaagttatgctccgttaaaagccggtgataaagtaatgattgtctctaatccaacggttgctgaacattatcttgccacggttcaagacactctaaccgaattaggttgttgtgtagattacgtattgattccagatggggaaaaatacaaaaccttagactctctcaatatgatttttaccgcattattggaaaaaaatcataacagagatactacgctaattgcattaggtggtggcgttatcggagatgtcgctggctatgccgcagcatcttatcaacgaggcatccgttttattcaaatcccaaccactttgcttgcacaagtggattcttccgtaggcggtaaaacggcggtaaatcatcctttaggcaaaaatatgatcggtgctttttaccaaccgatttcggtaattattgatacgaatagcttacacactttagctaaacgagaagtcagtgctggtctagccgaagttatcaaatacggggctatttttgatctcaccttctttgaatggttagaacaaaatattgataaacttgtcactcttgatcaaaacgcactggaatactgtatccagcgttgttgccaattaaaagctgatgttgtcgcacgagacgaaacagaaaaaggtgatcgtgctttattaaatttaggtcatacgttcggccatgctattgaagcgcatatgggatatggtaactggttacatggtgaaggggtatcagtcggtatgcttgaagcagctgaattatctcgaattctcggtgatttaaccgaacaagacgtagctcgtcttgagaagttattagctcgagcggttttaccaactatctcaccagataatatggaaccagcggaatatctcccttatatgtggcgtgataagaaagtactaggcggtcaattacgtttaatcttacttaaatcacttggtcaagcctatgtcagcgcacaagcaactgaagcgcaagtattggcagcaatagaacgcttcacccaacgctaatttatgagcaatcacaaacgtgcctttttaaaatgggcgggcggaaaatatcgtctgaccccagaaatcaacaaacatttgccccctaagcctgctcagggggcttgtttcgttgagccatttgtaggtgctggctctgtatttttgaatactgattatgaccgctatctgcttgccgatattaatccagatctcattgatctgtttaatatcgtaaaacaagatgtcgagtattatattcagcaaacaaaatcgctctttcacgcgccaaacgccaatagcgctgaattttattacgcacgccgtcaggaatttaatcaatctcaagataaattccgccgagctgtgctcttcttatatctaaaccgttttggctttaatgggctttgtcgctataaccaaaagcgagaatacaatgtgccgtttggtgcatataaaacgcactacttccctgagcaagagttacgttttttttctgaaaaagcgcaaagagcggagtttatttgcgctgattttgaagaggtgttcaacttattggaacaaaagccggataactatattgtttattgtgatccgccttatgctccacttcagcaagaaagtaattttactaattatgcaggaggaggctttagtctcgcacaacaagaacgccttgcttcttatgccaaacaagcgcaagccaaaaatattccggtattaatttcaaatcatgatacggcttttacccgtagcatttataaaggtgcaaaaatcaaaaaaattcaagtccagcgttctattagccaaaaaggcgatgctcgtataaaagtcgatgaattatttgcactttttgcataaacctatctttgtaaaaaattttaaaaatcagaccgcttgtcggtctttattagccctttaggagtaataatgtcaaataaacctgtagaacgccaatcgtggtcaaaccgattggcttatgtgatgactgttgccggtgcaactgtcggttttggcgcaacttggcgctttccttaccttgtaggcgaaaatggcggcggagcttacgtatttctattctgtatcgcaatgattgttatcggtatccctatgattttggtggaaaatgttatcggtcgccgtattaaagtaaacgcaattgatgcatttagcggaacagcaaacggtaaaaaaattgcctcaggttggaaaattctcggctatatgggcttactcggcgcatttggtatcttagcttactatatggttttaggcggatgggtattaaattatatcggtagcttattaagcggtacccttgatttatcttctccggttaccgttgaaacgacggcggcttattacaaagaaagtattcaaaacagcccgcttgcgatcattggttacacggcgattttcgtattagtaaactactttattttagtcaaaggaatcgttgacggtattgaacgttcagtaaaatatctcatgccgattttatttatcttcctacttgtgatggtgattcgtaacgttacattaccgggtgcggcagaaggtatttctttctaccttatgccagatttttctaaaatcacacctaaactgtttgtgtttgtgttagggcaggtattcttcgcattaagccttggctttggcgtattaattactttatcaagctacttagataaaaatgaaaacttagtaaaaacagctacaattaccggtattatgaataccctaattgccgtgcttgctggttttatgatcttcccatcattatttagcttcggtgttgcgccaaactctggaccaaccttagtattccaaagtttaccgatcgtgttctctaatatgtggggcggaagtatctttgcggttattttcttcagtttattagtggttgcagcactcactacttcacttactatttacgaagtaattatcactgcattacaagagaaaaccaaaatgagtcgtaaaacggcaattgccttaacgcttggtactatttttgttgtaggtaatattccatccgtattaggtgataatgagtggaaacatatcacaattatgggcaaaagcatctttgatgccttcgactatatcagtggtaatatcttatttatcctaacagcattaggtagtgcgattttcgttggctttgtcctaaaagatgaagcaaaagcagaattaggtgcaaataaaactttcaccaatatctggtttaactacgtaagatttgttatcccggtcattattttagtgatcttctttaattcactttaaatcacaaaaaagctattcaataacgaatagctttttttataaataacacataaaaaagcggtcggaatttgcaaattattcgcaaattctgaccgcttgtttttttctcacttaatctttataaagcctagcgccacgctttaaattgattgattaatccgttagtagagctgtcgtggctggtaatttgttccgcattttgtaactcaggtaagatacgatttgcgagttgtttacctaactctacaccccattggtcgaagctgtagatattgaaaattaccccttgtacgaagattttatgttcatacatcgcaattaatgcacctaaagtgaacggtgtaattttttgtactaaaattgagtttgtcggtttattgccggtaaatactttaaacggtacgatttccgcaacatctgctaaatccttacctgctgccacaaattccgcttctacagtttcttttgatttaccgaacgcaagcgcttctgtttgtgcaaagaaattagataatagttttgcatggtgatcgccgaccggattatgtgtttgtgccggagcaataaaatcacaaggaatcagcttcgtaccttggtgaattaattgataaaaagcgtgctgaccgttagtacccggttcaccccatacaatcggaccggtttgatgcgttaccggactgccgtcacgaccgacaaatttaccatttgattccatattaccttgttggaaatatgcagcaaagcgatgtaaatattgatcgtaaggtaataatgcttctgtttccgcaccaaggaaattactgttccaaatacctattaacgctaatgttgtcgggatattttgctcaatcggcgctgtacggaaatgtttatccattgcatgagcacctgaaagtaatgcttcaaagttctcaaagcctaatgataaagcaatagaaagaccaattgcagaccataaagaataacgaccgcctacccaatcccagaattcaaacatatttgccgtatcaatcccgaatttcgctacttctgtcgcattagtagataatgctgcaaagtgttttgctactgcagattcatcttttgcagccgctaataaccactcacgagcagttaacgcattggtcatggtttcttgagtagtaaaagtttttgatgcaactaatactaatgttgtttcaggatctacttttttcagtacttctgcaatatgcgtaccgtctacattcgacacaaaatgcatatttaaatgatttttatatgggcgtaacgcttcggttaccatataaggacctaaatccgaaccaccgataccgatattaatcacatcagtgattgcttttcctgtgtagcctttccagctacctgaaataacacgctcacagaaatctttcattttagccaatactgcattcacttccggcatcacatctttgccatcaacaagtaccggagtatttgaacgattacgtaatgcggtatgtaataccgcacgattctcagtacgattgattttctgaccagagaacattgcttcggtcgcagaagctaagccgcattcacttgctaactgacgtaataggtctaatgttttttgattaatggcatttttagaaaaatcgacaagaatttgctcttcaaaatttaagtgatatttatcaaaacgatttgtatcttcggcaaatagctgaggaatgtttaagttatctgctttatgttgttctaaagcagcccaagctgctgtttgcgttggattaatattttgcatattaaaggtccttttgctaattaaagttaaaaatgggattaatcttctgattgatgtttttcaagctcttctagacgtttttctaattcattgagcttttcacgtgtgcggagtaatacttgagattgcacatcaaattcttctcgggtcacaatatcaagtttagctaattgggcttgtaaaatttgtctaaatttttcttcaagatcattgccaacattttttaaaggctgaggcaatgcattatggagttgctgagccaaggactcaaggttctttggatttaacattcattttctccttatagaatagcggttaattttaattaatttttagctaaatctaaagaagagaataagaataattaggaataaatcaaaaataaaaaacaaatattaataagaaaaaaataagataagctttggataataagaaggatggctggggtactaggattcgaacctagggatgccgagatcaaaacccggtgccttaccgcttggcgataccccaaaagaaaaaactaacatttagttagctttattttgaaatgaaattagatggctggggtactaggattcgaacctagggatgccgagatcaaaacccggtgccttaccgcttggcgataccccaacactaattttttttcgtaagacaatgaatggtgcgggaagagggacttgaacccacacacctcgcggcgccagaacctaaatctggtgcgtctaccaatttcgccattcccgcaaatggtggctacagcgagattcgaacttgcgaccccaacattatgagtgttgtgctctaaccagctgagctatgtagccatttttcatttttgcgttcacctcatcggcttacggggtgtattatgctgattttattccgcttcgtcaaacacttttttaaaaaaagtgaagaaatttgattgtttggctacacattgctcattttgtcataaaaataactaaaaactgcttattttataataagttataaaatactattttgcattttccatctcagatttaagcctaacgagaactgtttctatatcaggaaattcattttcccatagtttaaaggcaaaagcagcttgtccaactaacatacctagcccatcttgataacgtagagcgccgcaatcacgagcataatttaaaaatggtgtctgcatattaggcgcatattgcatatcataaactgcagcgccctttaaaaggtgggccgcaataggtacatattttccttgtaaacctaatgatgttgcattaataaccaaatcaaactcttgttcagcaatttgctctagagaggcggtctgaatgtttccatattttgcaaatttttctgctaaatgaaccgctttctctaaggttcgattatagatagtaatctgctgtttcgcttttaaaagaggaaaaagtacccctttagtcgcaccgccagcacctaagataagcacacgttgattaggttctagccaacctaaacgctccaaatccgagcaaagcccaaagccatcggtattatctgcatataaacgaccgtcatccaaccgcttcaatgtattacacgcctcggctaataaacatccttcactatgctcatccgctagcttaaatgctcgctctttaaatggcgcagtaatatttgcacctttagctccctctgcaaaaaattgcttaagttgcatttcaaattgctgctcatcacctaatttagcggtataacaaacattacgtccggtttgttctgcaaagaattggtgaatttgtggcgacttactttgcgcaatcgggttcccccatacggcataacgattcatgcttattacccttgtctaaaaatatgttgtgtaaaaatatctcgaatttcagaaggattagtttttccagccgtatcagcttctaatactggaaaatccgctccgaattgcaattttacttcgtctgccgttcggcatggttcttgtccggttaaattgcaactggtcgaagttagagcaaatccggtacgttcacaaagctcaacaacagccgacatacggcataagcgtacagcaatcgtatcaaattgcccggtcaaatattgaggaacttcctttttagccggcattacccaagtaatcgcctgttcagaaggtgtttcaaaaatttgccaatgttctgcggttaatttgctctcatcaatataaggaagtaatagctccttggttggagcaataagaatcagccctttttcttcagggcgattttttaattttaataaagctcgtacggctgcctcgctattaggattacagccaagaccaaataccgcttcagtaggataagcaaccacattattctgttttaattgctcgacaatattttctaaattattcattttcttcattaaatagatattggcatgacttatttgcacagagatacatcgattttccacgctgtttcttaaccgtcacaatggagcactgacattgaggacaagtttttgctataggtttagctgccaaagtaaacttacagctaggaaatccgctacagccataaaatgttttgcctgagcgcccttttcgcgccactaatttattcgttttgcactctggacaatcaaattcttcttgttcttccgcctcatcatgtacagtaaaatggcactctggataatgactacaaccaataaaaatcccaaaattaccctgttttaattgcaaaaaatgtccacattcaggacaaatttccgttaaatctttaattacgtggttagtctgatgtagcggtttcatatagtcacattgcggataactgctacaacctaaaaataaaccttgtttccctcgcttaatttgtaatgcagaaccacaatcaggacaaagttctacttgtttcgttgatttaaaaatactcattaaattaattcaaactcaatcacaaaaaagtcattatcattcggataaatatctctgatgacttgcttcaattcagctaacgacatattttcttgtttagcgtgttgctcatttaattgttcaaaatggataggcgtaacagaaattactcgaatatcagcaaagaaacgattagtttcattagtaaaaacttttagctcttgctgaggttgaaaataagcttcggatttatctcgaatggtaatagttttcttaccagctaaaatatcagactcgaaacggctaaaaaaagtaatattattcatattctgcatcattgtaatctatgtccattagatggctaaagtgatcattataaaagcctcggctaagcataaaacgccacattttttgcttagcttttatatcccaaacaagcggtcgttttttctcaaaaacttgctcggcaagtataaaccaatcaatctctgcattatctaattcttgacttatcagccaatctttaatccctttgagtttcaactcttgttttaaacggcgaggcccgattccttgctgagaacggtaacgaataaagctggcgcaatagcgttcatcactttgccaattatttgcttgcgcgcgttcgatagcctggtctatttcttcttggctatattctttttgaactaattttcgtcgtaaatcttgttcactataatctcgcttagagagtaaatataacagataatttattgccgtgtagttagccatacttaaaatcattcagtataaaaaacaaatgcggtttctacctccgcagaaaccgcatttttattatagttcttcttcgttaaactcttcgtcttcaaaatcgttcacatcatcggcatctaatacattctgctcacctgctgatgttttttccggtgttgaaatgagtaactcacgaatttcttgttcaattttatttgcaatctctgtattctcttttaaccatttgattgcattatttttaccttgaccgattttcgtaccttcgtatgagaaccatgctcccgctttttggataaagccatttgcttcggcaagaattaataattcattcatacgtgaaataccttcaccatacataatgtcgaattgaacttcacggaacggcggtgcaactttatttttcacaattttcactttcgtttcgctaccaaccacttcatctccgtcttttactacacctgaacgacgaatatctaaacgaaccgaagcgtaaaatttaagtgcgttaccgccggttgttgtttcagggttaccgaacatcacaccgatcttcatacgaatttggttaataaacaccactaagcagttagtcgccttaatgtttgccgttaatttacgtaacgcttgtgacattaaacgtgcttgtaagcccatatgagaatcgcccatatcgccttcaatttccgctttcggcgttaatgcggctaccgagtccacaataattacatcaaccgccccggaacgcactaacgcatcacaaatctcgagcgcttgttcaccgttatccggttgtgaaattaacaatgcatcggtatccacgcccaatttacgagcataaaccggatcaagcgcgtgttccgcatcaataaacgcacaagttttacctgatttttgtgcttgcgcaatgaccgataaagtcagcgtcgttttacctgaagattcgggaccgtaaatctcaacgatacgtcccatcggtaagccgccgatacctaatgcggcgtctaaaccgattgaaccggttgaaaccgcttcaatatcaagcgcttgcgtgtcgcctaagcgcataatagaacctttaccaaattgtttttcaatttgggcaagagcagcagctaatgctttttctttttgttccggatcgatttgttttgttactgtgttcttttgcgcttttttgttatccgctgccatagtattgtcctttgcaaacttttctgaaaaaacgaccgtttgtcgtcaattaactgtgtattattatagtgtttacttatacagtttcaagcacttttttactgtttttcgatctatccggcaaaattgattgccgaaatcggtaaagccctttgtaaatcaaaaggattaagcgcattcaccatcataatttgttcgtactgggtcaaatcttgcggtgtaatttgaaccaattcgacaatactggtttcaaccagcttggttagctgcgtaccctttaataaataatcttgcgagctgaaccactttcctttcctgtaaaaaagcaaatttccgatcgtacaatcgctcactttgccattattgataataattatttcatcggcttgcaaagttttgagcgaatccaaccgcttgcgatcactatatttaaagcggtaatccaaatcctcggtgtaaacacattggaaagagttgatcttacgtggcgaataaagggaaaattgctgctgaaactcgctcgcattgtaatcaatgcggcagcgtacactgccctgctgaaattcgtccggcacacaaatcacctctgctaattgccactgtggttgcgcattaaaatattgtttaatcgcactttcaaagcgttgctgatgataagctaaattttgcggttcaccatcaataattgcaatcgtttcaaacaatggaaatcggcacataaactttctccaacagttcatcatattcatcgttcagtacgctttttgcagtaataccgccgccactacggaacaaaatttgttcgccattttgctcaataaaacgaatcgccaccgcactctctaaattttcaccgtcaaaatagccgaaaataccggtgtaataacctcgctgttcgatttccgctttttgaataatctctaaggttttttctttcggcgcaccgctaattgagcctgccggcaggagcttggctaatagtgaacccacactcgcttgccaattttcgtttagctcgccgcaaatttcagaactggtttgataaattgcgccacggtaggtatccactttctctaaataacgatacttcgtcacctgaatattttgtgaaactaacgccaaatcattacgaatcaaatctacaatcgtattgtgttcggtaaattctttatccgattgcatcagcttttccgccgcattcggctcattcgcattaatcgtgcctttcatcggataagagtagattttattttgttgaatccgcacaaaagtttccggcgaaaaacaaacaaactgccctttcagccacaatttatattttgccgaactggcgaaaaacagttcttctaaactgtaattggtttgaatttcggtcggataagtcaaattcaataaatagctattaccggcttggatttccttttgaacaagctcaaaaccttgctgataagtttcaaacgagatgggattgatctgaaattcaaacggcttgcgaacgttttgtggttgaacattcgatttgcaaaaaaaatcgaaaaacagaccgcttgccgccgcttgttctagcggacaaataatcggtttttgctgttcaaaatcaattaaaaagaagaacgggcttttctgttgcccgagttgatcggcggtttggataaaatgttgcataaactcaaaatgtgacaaatattgttgttattctaggggaatttccgccaatttagcaacgttctttcacttttcatttttcgccagattgctataatactgtatatttttctattagattcaggtttacctttatgattattgacgaaatatggttttatgtggcgattggcgtgttactggttatcgctgtttttctgttttttctgcaatcacgttaccaacgtgatgcgtttgaacttttgcaagatttggctaaagcacaaaccgatctcgcacaaattaaccaaaaatttgagcaactttccgttgaaaaaaatcagatcgaacaatgggcaattcaatataaaacccaagcccaagcaggtatcgaacgaatcaacgaaaaagaaacacaaattagccgtttacatagcaaaattgaagaggcggaacagcaagaacaacaattagaacgctatatcaatgagctgaaagagcgtatcggtgcattccaagccaaagcggaaagtttagaagaacaattacaagttaaccaacattcactttcacataaagaacgtgaaaaccaatctcttgttgcccagcttagccagacgcaaaatgaattaaccgaattgcgaacttcactttcagagaaacaagcgaattttgaagcgcaacaacgtaattttattgaggtaaaacaacaacttaatgttgaatttcaacatttggcacagcaagttttggaagaaaaaaccaaaagttttactgccagcaatcaatcttcattagacgccctgttaaaaccgtttaaagaacaaattgaaggtttccaaaaacgggttaatgaagtacatagtgaatcgcttaaaggcacggcaagtttagaagccgaactgaaacgggtactacaaatcggtgtgtcgatgtcggaagaagcacaaaacttaaccaacgcacttaaaggcaacaataaaatcgctggtaattggggcgaagtacagcttgaatcggcactacaagcggcgggattattagctggtgagcactatgtggctcaagaaagtttccgagatcaggagggcaaacgcttcgcgcctgactttgttgtacatttacccgctcaaaaacacttaattattgatagtaaagtatcgttgttggcttacgatcaagcggtcagaaccgaagaaaattttgcaattacccaagccttagatgagcattgcaaatcactccgcacacatattgacggcttatcgaaaaagaattacagcagtttgcaaggagtaaaaagcccagatttcgtgttaatgttcgtaccgattgagccggcttatattgaagcaatgaaacacgatccgcaactgtttaattacggttatgaacgtaatgtcattttggtttcatataccaccttaatgccgattttacgcaccgtggcaaatttatggcgaattgagcgaggcaatgccgaagcacgtgaaatcagtgaaaaagcaggcgaaatttataatcaagtttgtaccgttgccgaccgtttggccaaattgggcaatacgctaaatacggtcaataaccaatataatcagacggtaacctcattggttggtcgccaaggcttagtcggcaaggtggaacgcttccagcaactttccgccaaagcgagccaaacgatgccggcagttgaaatgctcaccaatgattttgataccaataaactcacattaattgcagaaaagattgaagatagtaatgaagcaaacaatgaagaagagcgctaatttattaattattgataaccacgattcgtttaccttcaatctggttgatctgctacgcaaaatcggcgtgccgatgaaagtggtgttagtggaacaattaggactggatgaggtggaaaattttagccatattctgatttcacccggcccggatgtaccgcaagcttacccgcaaacttttgcaatgttagaacgttttcatcaaaccaaatcgattttaggcgtctgtttaggtcatcaaactttatgtgaattttttggcggcgagctatacaatttgaatgaggtaagacacgggcaacaacgtccgttaattcaaattagcaataacccgatttttaacggtttacccgagcgttttaagatcggtttgtatcattcgtgggctatttcgcaaaaatcactggaaaacacaccgcttgttgctactgcggtttgcgatcaagatgtattaatggcatttaaacaccaacatttgccgatttacggtgtgcaattccaccctgaatcatttattaccgaatacggtgagcagatgctacgaaattggctaaacgcctagcgtaaaatttcgctgtaagagaaataatagattgcagtctaatattggcttattttaaccgaggacaagtcaatgaaattaaaagccttactactgacatctttattagctaccggttatgcaaatgcggaaaccgatttaaaacccgcagtgtttaaaagtaaatttagctttcagcaaacggtagataccttagagactacatttaaagacaaaggcatggtagtctttgcaaaaatcgatcaccaagcagcggcaaaagctgccggtcttgaaatgcaaccggcaaccgtgattatttacggcacaccaaaagccggaacaccgttgatggtaaaagatccgagcttagcattacagttgcctttaaaagtattagtgactgagccaaatgctggagaagttgaagtgatgctaaatcgtgcggaacaagttgtagcccattcaaatacgccataccaagcagttgaaaatagcttagccaaagcggaaaaactgattgaagccactgtaacaaaatagcccatgacttataaacggcaagcggtcaaatcttgcaaaaaaattgcgaaatttgaccacttgtttgtctctaaaacgaaatcagtaaatcggctaacgtttataaatatcctcaccgtttcggcgggtcttgagtaaacgtaaaatccacacgtattgctccggatttttcgtcacaaaatactcaatcactttattcatttctcgagcagattgcaccgggtcaccggaaaattctaatgccggcaaaatttccatttgatatacacccttttccgcattgtaaatcggaaacatcgggatcacgaccgcattcgctacttttgccattttattcagccccggtaaagttgctttttccgtcgcaaagaaatcagcataaacgctaagctcttcaccataatcttcatccggaaggaaataaccgacatcacctttacgcacatcatttaagaatttcttaatgccgttttggcgagtgtgcattttgccgccgaagcgttcacgggtaatattccaaagccaatcgacaagtgcatttcgatgcggattatacattgaggtcatcgggaatccgtgggtgtacatcgccacaccggcagcatcaattgaccatgtatgcggcacaagcaaaatcacattttttccctttgcacgcgcatctctcacatattcaaagccgttaaattcacaacgcttttgtaaataagcggttgaacgtaatgccgtttcaccaattgccagcattgtttgagaaacggtaacaaacattttctcaatcacttccgcacgtttttgttccgaccattcggggaaacaataacgcagattcacattagcacgatgatattgctttttacctttgcgctttaaataatttgcaacaacacgtccaatccatgcgcccaatttatcacgtacacaaggaggaatataagccagaacaaccagtgcgaagacaccaagccatacgccccaatacttcggatacaaaaattccgttaaaaatttatgttcatacccatctcgggcagtaattcgttctgtcattaggttctctatttcttatcaatcaaattctttactgccaaaattaccccaagtccaataaaagccccaggaggtaaaattgccagcaataagccggaatctaagtgtaacacatcaacacgcaaagattttgcccaatcgcccagtaataagtccaagccatcaaataaggtgccgttgccaatcagttcacgcattgcacctaatgcaacaagacttaacgtcatcccaagccccatggcaaaaccgtcaaaggcagaatgtgaaaccgcgtttttagacgcaaaagcctccgctcgtccgatgacaatacagttagtcacaatcagcggaataaaaataccaagcgattgataaaccggataagcaaaagcattcattaataattgtactgctgttaccacggtggcaattaccatcacataaattggaatacgaatatcatgcggagtaaatttacgaaacagcgatactgtggtattggtacaaaccaacactaataatgttgcaagccctaatccaagcgcattagtaacattatttgataccgccaataacggacaaagccctaacagctgcactaaagcaccgttatttttccacacaccttcggcaagcaaattacgccaaactgacggttctgccggcgttgtggtatcgatttccgtcaccggaatttgattctcagtattcatacgattctttcttatttacaacttgcaaaagtttctaattgttcgggagatttagccaattctgtgacgatccatttcgcactttggcgtacattattcaccactgcacggggagtaattgtcgcaccggtaaattgatcaaactgaccgccgtctttttttactgcccataatgattcattttctaggctaaataacttgccgctaaaggacaaaatccaatctgaaacacgagtttcaatcttatcacccaaccccggcgtttctttatgttctaacgttcttactcctagcactttgccgtccggttgaacccccatcagcaaaacaatattgcctgaataaccgtccggtgccgttgcttgaatagcataagcggtcaaattttccgatttttttgcaatataaatacggtttaaataaggggcgttcggtaaatccaccattttacaagagccaagcaaatcattatcaaaatggtttgccggcacaacttcttgtaaaaattggcgttgctgagcagcggtcacttcatcaatccgccctttggtaagcaaataaacaccggtcgaaacagctgtgcaaataagcgcaattacgcctaataataacgcatacttaacggtaatttttgaggtattcattatcttccggttccatataatcttggttgagtgtaatggtcaattaacggtacgcagatatttgccagtagcaccgaaaacgctaccgcatccggataattgccgtagtaacgaattaaatagacaaataaaccgattaagccgccaaaaatcaatttgcctcgaggtgtaatcgaagcggttaccggatctgttgcaataaagaaagcaccaaacatcattgcaccgctgaaaagctgactaacgacatttaagtgtgtatgcggtaacaataaatcggttagtccacttaataaagcaaacattgtcaacatcgcgaccggaatttgccagtgaataatgcgtttataaattagcaataaaccaccggcaagaaaggctaaattaatttgcaaccaaccatttgcaaacatgccgctaaaaatcggggattgtaatacaccttctacacctaatttctgcatactggttttggcactatcgagcggtgttgcttgtgcgataccatccacgctgcccaataattgatgtacgctaaagccgtcactggttaccccggaaaaaactaatgaaatcgcatcgcttaatgtcggcggttcatttaacaaatcaatcggcaccagccaaccggtcatttgcaccggaaaagaaaccaataataacgcataagcgaccattgcagggttaaataaattctgtcctaaaccgccatatacatgctttgccagtaatagggcaacgctcacaccaatcacaacgatccaataaggtgcgtaaggcggaatcgacatcgctaaaattaacgcagtcaacaaaccgcttaaatccgaaacataaaaagcggtcggttttcggcgcaattttgcaagtgcgatttcaatcaccaccgccagtgatattgcaataaccacttgaataaacacaccgtaaccgaaaaaataccactgcacgcctagtgccggtaacatagctaccattacccacagcataaatttcgccgttaaattagacgaatgggtatggggagaactcaccattttaaacatcaaataattcctttcccgcttaaattctcggtaaatgtagattaaatcgaattgctaataaacgtatcaaaataacggtactaaccgtagcgatatccacccagcggccttcaacgccggcagaataaaacaacacaaaaatcaccccgccaaccagactggctgtaacatagacttctttttgtaacacaatcggcacttcgttacgtaaaatgtctcgaattactccgccgaaacaacctgtcataccgcctaatgcaattgcaatacacgggtgaagcccaaaatctaagcctttctgcacaccaattacagtaaacactcccaagccaatcgcatcaaaaatcaatagccctgtttgccattctttcttactgattttattcctaaaaacggcagtaataataaccgcaagggtaatcatcaatacgtaaataggttgtttcatccagaaaaccggggtactaccgatcatcacatcacgcagcgtaccgccaccgacaccggtcacaaatgccaaaatgaacattccaaaaatatccattttatgctgacgagcagccattgcgcccgatacggcaaacacgatagtgccaattaaatcttgaataaacaagaatgaccatggctgagccggcaataaattgtcgaacaaactcgtcattttattgtccttgactcatttttttcgccttcgctctggcaattgctgctgcaaccgccgccttgcgtgggtcttccgcttctgctgcagttgcaactttttcagcattttcgaccgcttgttccggcgcttgctgggcaacttgttgcgctgcttttttcgctttcgctctagctagcgctgccgcaaccgcagctttacgagagtcttctgcttctgttgcggttgcaactttttcagcattttcgaccgcttgttccgacacttgctgagcgccttgttgcgctgctttcttcgctttcgctctagctagtgctgctgcgactgctgctttacgagggtcttctgcttctgttgcggttgcaactttttcagtattttcaaccgcttgttccgacacttgctgagcaccttgttgcgctgcttttttcgctttcgctctagctagcgctgctgcgaccgctgctttacgaggatcgtctacttctgctgcacttgcaactttttcagtattttcaaccgcttgttctggcatttgagccgctttcttcgcttttgctcttgccaacgccgccgctactgccgccttgcgtgggtcttccacttctgttgcagttgcaactttttcagcattttcgaccgcttgttccggcgcttgctgggcaacttgttgctctgctttcttcgctcttgcacgcgctaatgctgctgccaccgcggctttcttaggatcagtctcttctacttgctgcacagcattgatagagagattgtcatttacttcatttataacttcagcttgttttgccaaacgtcttgctcggcgttgcgccattaattcgctattatccggctctccattggcttttatatcagcttttgcatgaaccggttccgctaattgtgcttccgcttttttcgctttgatacgagcgagtgcggctgccaccggatcttctccggcagaatttgcaatttcttctcggcgtttatctgctgcttgtgcgatacgtgcagttcgagcgtctttttctttttgtaaacgagcttctctggcttcaaaacgaattttcgcttcttccgcttttttcgctttttcctcgatttccgctattttggctttttcttgacggaaatattgaatcaacggaatgtagctcgggcagacataagcacaaacgccacattcgatacaagcgtctaaatgatattctttcgatttatcgtgatcatccgaacgagcaaaccaataaagttgttgtggcaataacccgaccggacaagcatctgaacaacttgagcaacgaatacagctacgctccggctccggcggagcatattcaaaatgatccggcgcaataatacagtttgcggttttggtaatcggcgcttgtaatgattgcagaataaaaccggtcatcggcccgcctaaaaaaaccgggaaacggctatccgcttgataatccacttgctccaataaatgttgaatcggcgttccgagtcttgcccacacattacctttgttgcgaattttatcgccggtcagcgtcaccactcgttcaatcagtggttcatcgtccattaccgcacgtttaaccgcaaatgccgtaccgacattgtgcatcacaatgcccatttcgatagtacgtttaccctgcggaatttctaaaccggttaagacttgtaccaactgatccgatgcaccggaaggatatttggttgggatcggttgtacatgaatatcatccgaaccttttagcgctttttggatcgctttaatcgctttcggtttgttatcttcaatcgccaacaccacctcttccggacgcaacacatagcgtaaaatgcggataccttcgatcaattcagcagtgtaatcttgcatcaagcggtcatcgcaagtgatataaggttcacattccgcgccgttaataatcagtaatttacaacgcttatccgctaagcttaatttagatgcagtaggaaataccgccccacccaatccggcaatgccgtattggtaaactttttggataatttgatcgcttgtcagtgttaagaaatcatcaatcggctggcgctcaacccattcgtctttgccgtctgtttctataatcactgtgacttccggcaatcctgacggatgtgcggacacgtgtggttcaataccgagtatcgtaccggatgtcgggctatgtaccggcaattgacgaaaattatcacctttagtcagcgcctgaccttttaaaactttatcgccaacattgacgattaattcgccagcccagcccgaatgttgaactacagggacatagaaaaacctaggtaaatgtaagctgcgaatcggcttttgattcgattgctttttgttttccatcgggtgaataccgcccggatacgcccacaatttaccagtttgtttagtttgacgaatgcgttcaagaactaaattaggattagacatttttttctcctttttcagttccgataatcatttttttctgtaactccgtagtatttacgatagggataatcagattttcatcaaattgccaattccaagaacgagcggtcggcttcactttaatcatttcaatacaattggtcgggcaaggcgctacgcataattcgcaaccggtacataaatccgcaataatggtgtgcattgctttatttgtgccgataatcgcatccaccggacaagcttggatacacttggtacagccgatacacatatcttcatgcacaaatgccactttcacttccggctcttccacgccgtccattgccagtacttctacgcccatcagatctgcgattttcaccaccaacggctgaccgccgggtacacatttagtgatttgatctccattagcgatagcttccgcatacggtttacagccggggtagccgcattgaccgcattggctctgaggcaacaatgcgtcaatttggtcgacaatcggatctgcttccactttgagtttaattgacgaatagcctaataccgccccaaaaattaaagcaatcacggcaatagcaattaagatgtaggtgataattggtaagtctaacattagattttcaccaatcctgtaaagcccataaaggcaagagacattaatccagcagtgattaaagcaattgaagcgccttggaagggacgcggcacatccgccgccacaaggcgctcacgcaatgctgcgaaaagcactaacactaacgaaaatccagctgccgccccgaaaccatataaaaccgattccactaaattatttgctaaatttacatttaataatgccacccccagtaccgcacagttagtggtaatcagaggtaaatagatcccaagtaaacgatagagaatcgggctggttttatgaacgatcatttctgttaattgcactatcacagcaatcactaaaataaaaactaaagtacgtaaaaactgtgcttcaagtggagctaagataaatgtctcgaccaaataagctgataacgatgccaccgtcaacacaaaagttgtcgccattcccataccaatcgcagtttctacttttttcgacacgcccataaatggacaaagtcctaggaatttcactaggacaaagttgtttattaaagcagtactgataactaacaatatataatcgagcatagaatccacaaaagaaaggttcaattcattacaaaacaagcggttaattttacgccaaattttgcaaaaaacagcaaaattttaaccgcttgtaatacatcaagctaaaaattccggttattatcctgtcttttgctatttctaacaataaaaaatattcactatcttgatctttattagttttgcttgcattactgtatgatttttatgaatttttttacgcatttttttagaacatatttccttattttcagtctaatgcgtgctagaatatttgctacccattttatttctgctgaatatttctccatgaaaaaatcttattatactttattaagtgttggattatttttattcaccccatcactctctcaggctgaaagtttaaaacaaattttacaatatgctttagctgaagatcccagtttagaagaagctcgcgcgcaaattcgtattgcagagagccaaactaagatttcagaggcaggacatcaacccgttatttctttaagccaaaatggtgttattgctcaaaagcatacttaccagggcaaacgccgttcagagccaagtttaaatggacgtgtaaatctctatgcttggggcgcaattgaagcagaaatcgatcgcgataaatatagaacggattattatcaacataaattttatgaaacccgagaattaatagggcaacgaatcggccagctttatctaagcgcattaagagcgaaagaaaacattgcgatctatcaagaaagtttcgaccgccatacaaaattagtagaagacttaaaagtgatcgtttcttacgataatggtcgagcctttgaattaaccgaagcactctctcgtctgaatcaagttgaatccaatattgcacgccaagaacgagtactttctaccagcttgagtcaattagctcgctatactaagaaaaacctcgatgaacattcattacaagatcctttttcttcacaggatacgcatgcttttctaaaacgctaccaaaataatgatctctcagctaacccaacctttttagcacaacaaaaagaagtgaaaagtagtgagtcggcagcaaaagcagctgaagctcgccgaatgccatccattaacttagaagggtctgcaagtcgccatgagcgagaagtttatgttggtgtatcttgggatatttataaccaagcaagtaaatatgaagtggaaaaaagccaatacactaaagcagcggctgaagcaaaattacgtgaaattcaattagatgtgacggaaaaagctcgtacggcagaattagaaatgttccgctcacaaaaactggcgaaaacaacacaacgtcaaattaaattacaacgaaaagttgtcgatgataccgaactacaatttgatattgcgacaaaatcattacttaatttgctggatgcataccaagaattaaccagtgtacaagcggaagaagttgcagcacgcaatgattatcgagatgctgctttactctatttggtttctcaagccaaagtagcaagttgggctggttttagcactctgaacttaacggaagaaaaaggtaaataaattgaaagcgattatcgaccacttagctcatatcactcaattacacggttcgccggttgctaaagaggcgctttccgcgcaagtgatacgagaacaaaacctcaatgtaaattttcagtccttagtagaagttttacgttcacatggatttgaaaaccaaatttctcatcgtgacttaaaagatattccttcgctttcaaccccagtattgctggtcttacaaaatgaagaagcggcgattgtcacaaaaattgaaggtgcaggtaaggacagaatttatcatctgtatcaaaatggcatcacacatagtgtatctgccgattcacttgctcagaattatttaggatattgttggtttattaagcctcaaacaggcaaagatcaacgttccgaattgccggaataccatatgccaaaagcttggttctggaaggtagtttggcgtttccgttcttattattatcaagtgatcttagcaacgtttatcatcaatttcttagccttagtcagctcactttatgtgatgaacgtttatgaccgagtaattccaaataaaacgtatgaaaccctttgggcattaagtatcggcgtagtacttgcgattagctttgaactagcggctaaattaattcgagcacatctcactgacatcgccggcaaaaaagccgacttactgataagttcagctattttcagacgggttatggggctacgtttagtcgataaaccggcatcttccggttcttatgccaacaacttacgtgaattcgaatccgttcgagaatttatgactagcgcaagtttactggtattagttgacttgcctttcgtattgttatttatttttgtgattttcttggtgggtggttccttagcgctcgtgccattgatcattatcccaattgtgatgattgtcggctttgcggtacaaccgaaaattgctgaaaacattaataaaaccatgcgcgaaagctcgcaacgacaaggtttagttgtggaagtgattgacggtattgaaaccttaaaaaccaataatgcggcaaattgggctcagcaacgttgggattcttatacggcaaaaacggccgcaacacaaattaaggtcaaagatttaagtaattttgtcgtaaatttttcaacggcaatgcagcaactgaatacagttttcttagttgtcgtcgggacttaccttatccatgcggaaaatgaagcctctcgtattacgatgggtgcattgattgcttccgtgattctttctggtcgggcattggcaccattatcacaaattgccggactggcaacgcgtttccaacaagctcgtctagcattaaaaggtttggatagtattattgagcgcccgaccgagcgagatccggaacgtaaatatattacgctgtcatcggtacagggacatattcaatttaaccaagcacatttccaatattcggagcaaggtaacgatattgtttcagggttgaatttacagataaaaccaggtgagaaaatcggtattttaggcagaatcggaagcggcaaaacaacactacttaaattggcttcaggtttatacgaaccaagcaaaggtaacgttacattagataatgtagatttacgccaaattgatccaaacttcttacgtaaccaaatagcactgtttagccagtcgcctcgcttatttttaggttcattacgtgaaaacttagatttagcacgtactgacaatttcgccagtgaccaagagctattactagcgctacgtcgtttcggcttagatcgcattatccagcagcatcctcgcggtttggatatgcctttaggtgaaaatggacaaggcttatccggcggtcaaaaacaattagtagccttagcacgcttaactttaaaagatccaaaagtagttttgcttgatgaaccgaccagcgatcttgaccaaggctcggaaatgatggtgttaaacgctttagcgaattggacgaaaaatcgtacgatgctggtagttacgcatcgtccgcaagtattacgaattgttgagcgagtaatcgtggtagaaaatggcaaaatcgtattagatggtcctcgtgataccgtgttagcaaaattgcgtgagaatgaacaagcaaaaaaacaacaaaattcgaccgctagtactaaacaagcagaacctgtagcaacacaatctcaaggaagtgaaaataatgagcaaccaagaaaaaattagtcaagcagatcttgctttaattaacgatctgaatgctgcgatgcagaccgaaaaacatcgtggcatatttgctgtgattatcttgttcttcgcttttctcgtggtcttcgtaatttgggcatataatagtccattggaagaagtcactcgcgggcaagggagtgttatcccgaccagtcgtgaacaaatagtacagagtcttgatcccggcattattcgcgaaatgaaagtaaaagaaggtgatattgtcgaaaaagatcaaattttactaactttggacgatacccgtagttctgcaatgttgcgagaaactaaagcgaaagtgcttaatctacaagctgtttcaactcgtttacaagctgaagcttatggtatgccgcttaaatttagcgctgatattcctcgtgatattcaagcgcgcgagaaagccgcttatcaagctcgtttacgagctatgagtgatgcggtgaaaggtttaacacacagtaaagcactattggatcgtgaaattgcactcacctcgccaatggtaaaaagaggtgtaatgtccgaagttgaattactgcggactaagcgtcaatcggccgatttagcacaacaaattgcagagcgtaaaaatcgttatgctgctgaagcgaatgaggaattagttcgaacagaatctgaattagcacaagcgaaagaaacgctggcgatgtatgcagatccggttgaacgttcgcaaatcaaagctccgctacgtggtattgtgaaaaatatcaaaatcaatacagttggcggtgtggttcaagccggacaagatattctggaaattgtaccgttggatgaaaaattgttagtacaggcctatattagccctaaagatgtcgcatttattcgaagcggacaacctgctctagttaaaatcagtgcctatgactatgcaatttatggcggacttgagggaaaagtgacgcttatcagcccagataccttgcaagatgatcgaactcagagtacgttaaaattaaatccggatgagtcttactaccgtattttagtcgaaaccaacgaaagtaaaattttcgacaaaaatggcaatccgcttgagattacgccgggtatgaccgctacagttgatatccgaaccggagaaaaaacaattttccaatatctgatcaaaccgattacgcgtatgaagcaagcaatgcaagagcgctaaatcattctcattttaataaggctgtctgatcttcaggcagccttttttatcacaaaaatttacaatctgttatccgctttatttttccgtcacttagcaaattgcaacccctcccctgcaaattttttgattttattttcaaaaaaaataactacaatgcacaacatattgtgctagcaacaagaaataacacaatatatagtaacaattttataacaaatgaaaaacctcagattctgctcagaacaaattgtttggcaagaagtgccgcacgaaacctcactcgccttcttaattaccggctgcccgttaggctgtaaaggctgccatagtacagaaagctggaaggttggaagcggtcaaattttgacaaaaaattacctcatcgagcaattaaataaataccaaggcttaatcagctgcgtactttttatgggtggcgaatggctacccgaacaacttattccgctactgagttactgcaaacaaagagggctacagacttgcctttatactgggcttgaacgaaatgagctttctgcagagttgctttcgcaattaacctacctaaaaactgggcgttggatagcagaaagaggcggtctaaatagtcttaccaccaatcaacgatttatcgatttacgcaccggcgaaaatctaaatcacttatttagcaagggagtttaatcatatgattcgcttacaacctaatcaacttgaaggcaaattaggctttattgatcattatctgcacgcaaaaaatgcggcggacggttccaaaatggatgcgaatgccaatgtgacccaaaaaaacattgccaccatggaaaatgaaatgatgaaagacttctttgtgcaaattaaccgagcaaaagtaagcaacaaaattgccgaattatttgatgaagaacttgcgggcgaatacctacgtcaaattgaatcacacgaaatctacgtacacgatgaaactagcctcaagccatattgtgtctcagtaacaatgtaccctttcttacgtgacggactcaccaaattaggtggcgaatctaaagctccaaaacatcttgcttcattttgtggttcgtttgtgaatttcgtgtttgcggtcagctcacaatttgccggagcggttgctaccgttgagtttctcatgtattttgactatttcgcacgtaaagattttggtgataattatcttgaaacccaccgtagtgaaatcgaaaatcatctacaacaagtagtttatagtattaatcaaccggctgccgctcgtggttaccaaagcgtgttttggaatatttcactttatgacaaacactactttgaagcgatgttcggtaattttgtgttccctgattttgaacgcccgaattgggaaacgactgccgcactacaaattttctttatgaaatggtttaaccaagaacgcactaaagcgattttaactttccctgtggtaacagccgcaatgctgaccgaaaatggtaaatgtaaagataatcaattcgccgatcaaatggcagaagagctttcgcaaggtaattcattctttatttatcaatcggataacccagattcactcgcttcttgttgccgtttacgtaatgaaatctcggatcacacattctcttattcattgggtgccggcggcgtggcgactggttcgatcaacgtcattaccatcaatatgaaccgtttagtgcaagatgggcgtaatttagaagaagaagttggcaaaattcataaatatcaatacgcttatcgtaaattaatggaagaatatttagcagcgggaatgctccctgtctatgatgcgggatttatttctttagataagcaattcctcacgatcggcattaacggaatggcggaagctgctgaatcacaaggcttaaccgttggttataatcctgattatatgcagtttgtacaaagccgtttaaaagtaatttttgaagcaaatcagaccgcttccaaaaaatatggtgtgaagttcaataccgaatttgtaccagcggaaaatctcggtgtgaaaaatgccaaatgggataaagaggacggctattttgtgcctcgtgactgctacaactcttatttctatgtggtggaaaacgaaaacaccaatgctttggataaattcttactgcacggaaaagaactgattgaatggttagatggtggttcggccttacacctcaacctagacgaagcattaacccaaactggctaccgctcgttacttgatattgcggctaaaacaggttgtaactatttctgtattaatgtgaaaatcaccatttgtaacgaatgtgcacatattgataaacgcaccttatgcagctgctcaaaatgcggttcacaaaatatcgactacggcacacgcgtgatcggctacttaaaacgagtatccgccttcagctccgcccgccaaaaagaacacagcttgcgtttttaccatagggaagcggcttagtcccctctctctgcaaaaattgcctgacgcaatttttactgtctctctccctcaaggggagagagtgttttatattgaaaagtcgaacaaatatcaaaagactaaataaaactgaaatgctggcgctagtgtcctcactcgtgccttttctttttaaagcttaacaccgcttaagaggaaataagacaaacgagatacttatacaattccccctctttagcaaagagggattaggggagatttgataagaaattatcttgcctttgtaatctgattggttctcacatcaaacacatccattccgccggcaagggcggcttggataccaagatcagcgtcttcaaatacaaggcagtgtttcggctctacgcctaaacgctcagcacataataaaaaggtttctggtgatggtttatgttgtttcacatcatccgcatcgacaatcgtgttgaaatacgggcgtaggttaaatttatcgagtaatttatacgcctgcacacggtgagcgcctgtaccgaccgctaacggctttttgcccgaatagtgttggataatctcaaatgccggtagcaacgaggaatgttcgtaagtgagatccatcgcaattttacgtttcatctgtaccacttcttccaacagctccattggcatattcgcacgctgcataatttcacgcccaatggtgtaagtggttgccccacccaattcatacattaccgagctatccacttgatagccgaaatgttcgccggtaatctcccacgccttcgcatggcttggcatcgtatcaataatagtgccatccatatcaaaaatgagagcctgatactggtccaaaatttctgtactgactaacatcgctttctcctaaattcgttctttaatgccaccaaattcttcaatcattttttgggtaaataatttaagttcttcggtcattaacaagaaatctgcatcaaaacgctgagcaatatcttcctttaaaatatcgtcattcttttcacgcacttcatcagcaaatttcacacgggaaagggttgcatcttcattcaatacgcacgcaaaatgattctcccaatcaattgcaagttttgtgacaaatttacccgcttgtaagtgttgagcgatctcctcgctttccagatcttgacgtttgcaacggatcacgctgtctgtatcaaacgatttcaattctgcttcttctaataaatttaaccaattcggtgtatgtcctttggcaatccagttcgtcattacttcacttggtaataaagcaaaagaaatcggtacaacaggtaatgatcctaaggttttacgcaataatgcgagcgtgtcttccgctcgtttacttgaacctgcatcgacataaactagctgtgcatctaaatccaaccaaattgcggtgaattgatgtttactaaatgctcgaggcaacaacattgccaccacatcatctttgatcgcttgtttttcggttttcttgagcttacgagcttctttttcttctaaaacggcgatacgttcttccgtttcttttttaaccacattcgccggtaatagcttatcttctttatgtgaaactaatagaaactgtttaccttgcgaaaaatgtaataattccgaaccggaaagtggactcgaccagccgaatttactcatatcgctttgtgaacaaggggtaaatttggtttgttgcagttgctcttccagtgaatgactttccaacgaaagcggcgaagtcaggcgataaatcattacatttttgaaccagaacatttttatgatccttttagggtgttagaatgggcaaaattttaacagatttctcttttgggctctaatcaaatctctcctccctcttttctaaagaggggcagcttgggatagagaaacgatttatccccctattttccgccgaagcggttgcgtaaacttttgaaggcaacttttcgtgtttgagtttgcttgcaaacgagtttgaaaagttcgcctcaaaagttagcaataagcgtaggaagaaggaaaatctgggggcgcctttctttggttactttctttggcgaagcaaagaaagtgacaaaaaacagataaaatttatttaacgttagctggaaataatcatgaaacactacccacttctaagctttatcggcaccggcaatatggcatacgccatcattcaaggcttactcaaaagccattatcctgcctcgcaaattatcgcttgcaacaaaagtaatttagctcgccgagcagaattacaagcggtcggaattgtgacaaattttaccaatcgtgaagcggttgaacaggcggaagttgttgtgttagcggtcaaaccgcaaatgatggcggaagtttgtagtgaattttccagcgtggatttttcgaataaaaccgtgatttctgtcgcagcagggatttcagtagctcgtttagaacagcttttaccaacagcaaaaaatattatccgcaccatgccaaatacgccctcgctaatcggtgagggaatgactgggttatttgcaaaaaaatcagtaaattcgaccgcttgtcaatttgcagagagcttaatgtctgcggtcggaaaatgctattgggtcgaacaagaacaacaaatcaatcatattattgcggtaactggttccagcccggcgtatttcttccgttttatggaagcaatgcaacaaagtgcaatgcaaatgggatttagcgaagctgatgcacgtttactggtgcaacaagcggcattaggcgcagcaaaattagtcgaagcgaatccgaatacttcacttgccacactacgagagaacgttacatcaaaaggcggtacgacggcacaagccttagcgatatttgaacaacaagcattagtaaaaacagttgatcaagcgatgtgggcagccattcaccgtgcagaagaaatggagcaacaactatgataaaaccaaccccattccagtgggcggcatttaacttctttggtttcttttgcgcttacggtgtactgctcccctttttacctgtttggctaaaacagcatggctacagtaccgaaatgatcggcttacttgcatcattcggttatctattccgttttggtggcggaatgttgtcgtcacaacaggttaaatcgcccaatcaattaattccaaccgcacgtgtactcacgttattaaatctgcttgcgattattctcattgcgtggtcggtagattctatttggttactattccctacgctaatgctgttccatatttttaacgccggtgcgatgcctatcggtgacagtatcgcttcgctttggcaacaacaagtcggcattgattacggcaaagctcgcttattcggctcgattgcctttgtagtcggctcattaagcacaggctatttaaccggctggctgggcgaaagttcaattatttggattatgttcggtttctttatcttattaggttgtgggcaattacttacacctaaggttagctttgaaaaccagcaagataagaaatcttcatcaaacctcagctattggcagattctcaaagaaccgactacgctacggatgatgcttgccgtgtcgttaattcttggctcacacgccgcttactatacttatagtacgattcactggtcagcggctggtatctccacccaaaccagcagcttgttatggggctttgcggtatgtgccgaaattttatttttcttattttccaaccgcttatttaaatcgtggcgtatttcgcacttaatgataattgcaagtgttatcgcaattattcgctggtcaattttagcttcaactactgaaattagtctgttggcgctctcacaaacatttcatgccatcacattcggtatggctcactatgcgatgattcgttatatttccgcccaaaatccggaaaaaatcaccaaattgcagggcttatattttgcattatcgaattgtggctttacggcgatttttacctttatatcaggcatgctataccaagatataccaaactttgtcttctggttgatggcgattatcgtggtgccggcaattttgatcgtgccgaaaaaatttgaggtgaaactagtgcaaggagaaaatcatgtctgaatatagtattggcaaagtatttgcttccgataaaaccacttatcaggcaattgatcggctgctcgaacaagaaggcattcgtagagataataatcttgattacacctgtgcgatgtataacaaggatgatgaagtgattgcaaccggtagttgcttttccaatacgttacgctgcttagcggtgtctcatcaacatcaaggtgaaggcttaatgaatcaaattgttacgcatttaattaatgaacaatttgagcgaggtaattcacatatttttctttataccaaaacctcaaccagccaattttttgccaatttaggctttcacgaaattgcccgtatagaagggaaaatatcctttatggaaaatcagcgcaccggatttgcaaattatttagcaaatttgaccgcttgtagtccgactcctctcgcaaatcaacgggtagctgcgatcgtaatgaatgccaatccgtttactttggggcatctctatttggtggaaaaagccgcaagcgaaaatgatctggtacatctttttatggtgtctgaggataaaagtttggttccgtttgcagttcgaaaacaattggtaaaacagggcgtagcacatttaaacaatgtgatttgtcatgaaagcggttcttatattattagttcggcaaccttcccgagttacttccaagaaaacgataatgcagttatcgaaagtaatgcgatgctcgatctgcaaatttttacgcgtattgccaatgcgttaggcattcaacgtcgttacgttggcgatgagccttttagccgagtaaccaatatttataaccaaattatgcaagacaaattaccagaacaaggtatcgaatgcgttatcgtgcctcgcaaagaggtgaacgaacagatcattagtgcttctgctgttcgagagttgattaaaaacggtgatttcactacgatgaaacagatggtgccggcttctacatatcaattttttaccagcgaagcggcaaagccgattattacacgtattcaagcaacagataatgtaaggcactattaaaaaagaaatgtaaaaaagaaatgctaaaaaacaagcggtcatattttgcaaatgtcttacaaaatatgaccgcttgctttatacaagtaagttaatccttacttcaattgttcttcgataacaccgccacctaagcaaacttcgccttgatagaagactgctgattgacccggcgtcactgcaatttgcggttcatcaaagatcactcgaatcgtatcatcatccatcggttgaatttcacaggcaatatccgtttgacgataacgcgtttttaccgtacaacgtacattttcacgaatcggctgacggtccacccaatgtaactgagttgcgattaaaccgcttgaaagtaatgccgaattatcatgaccttgtgccacaactaacacattattgatgaggtctttttcgactacataaaacggatcttcgctcaagcctttcacgccgccaattcctaagcctttacgctgaccaagggtgtgatacattaaaccatcatgacgaccgacaactttaccatccaccgttctgatctcacccggttgtgctggtaaataacgtgctaagaaatctttaaatttacgttcaccgataaaacaaataccggttgaatcttttttcttcgctgtcgctaagccaatatcttcagcaatttgacggacaatcggtttctcaatatcacctacagggaataggctctgccctacttgcttatggcttagtgtgtaaaggaaataactttgatctttatttgcatctaaaccacgtaacaattgtgcgttattatcatcaccgctacggcgtacataatggccggtcgcaatataatccgcacctaaatcttccgccgcatattctaaaaatgctttaaatttgatttctttattacaaagaatatccggatttggtgtacgacccgctttatattcgcttaagaaatgctcgaaaacattatcccaatactctgccgcaaaattaattttgtgcagcttcatacccagtttatccgccaccgcttgagcatcagctaaatccgccgctgcggtacaataatcggtatcatcgtcttcttcccagtttttcataaacaggccttcaacttgataaccttgttgttgcagaataaaagcggatactgatgaatccacaccaccggacataccgataatcactttctttttcgcattttccgctaattgctcagcggttaatttagcaaagtgagtatcataagttttcgagctaagtttagtttgatttgtcataattctcccgtaacttcggttaaggcgaagcacattggttaatattaaataaaatacaagcggtgaaaaaatcaaaaatttttgcttttcaccgcttgctatgaatctcctacccctcccttttcaaaagagggggactataactgaacataaatagataacaaagctatcatcaatcaaagaaaacgcccctctttaataaagaggggatgggggagattttaaaattattttacttcgtaaaattgcggttctttactgaagcgtgcaacctcttcaggatcagccgtaccatccgccatttttgctttcagattgtcacaaggctcttcacagtcacacatttttttcatacctaatgcagtaataccaccgcagctgcctttgattgtttttccttttacgataaaaccaatcgacattgcaaaaattacggcgataaaaaagccgaaagtaattaataatgtttccattgtttactccaattatttttggttaattaatttttcaaattcgctcgacattttagtttcaaatgcttcgccgttcttaataatcaggaaaaccgctaacttttcacgttcagcgacttccagcgctttttccggtcctaatacgaataaaccggttgataaaccatctgctgtcattgttgttggagcaaatacggtaatcgaggctaatttatggctaaccggacgcagttctttcggattaataatatgcgaaagacgattaccttgttcgtcttcgaaataattgcggtaattaccggaagtcgccatgcccagattatgcaatggaacggtaatctgtgccgcttgtccttgcgctagtgttggctgctcaatcgcaatacgccaatcaacaccttgtaaatttttccctttaccacgcaactcaccaccgatttccactaagtaattggttaaaccgaggctttcgagatgttccgctaacttatctacgccaaaaccttttgcgatagaagaaagatctaaataaagattcggtacagattttgctaataaagatttatcactaccggttaatgttaacttttcaatgccaactgccgctgctcgttcggtaatctgttctgctgaagggactttatttaaacgtttgtccggcccgaacccccataagttaactaaaggcccaacagtaacatctaacgctccttcagttactttatttaatcggattgcttcatgcacaacctttgcaaaatcaggtgaaatttcaaccgatttattaacctcttgcattgcattaaagcgactgatttgcgaatcttgttggtaggtagacatttcatcattaacagttttcaataaactgtccaattgcttctgcacttcattcggtgcctccaactgcgcaactttaccgtcatcaatatattttaccgtataggttgtgcccatcgttttaccttgtaaggtaatttgctctggcgttttattgcaagcagttaacaaaatagctgacattgcaaaagttaaaatcgatttaagtttcaaattaaacctctttattattttagtaggtacgatttctaggtaagccattcagcttacccttataaatttaaattactattgaaaaagactgtagaaacaaactttttcactaacaatttaaagcacgtcaagcggtgtgatttacaaaaaactttgcaaatcacaccgcttgtaaatctgggcgcatttacaccctgttcgatttggtattaaccaccgaagtcatctaataagatgttttcgtcttcaacacctaagctcttcagcataccgattaccgctgcattcatcactggtggaccacacatatagtattcacagtcttccggtgcttcatgatttttcagatagttctcataaagtacgttgtgaataaagcctgtgtaacctgtccagttatcttccggtaacgcatctgaaagcgctacgtgccatacgaagttatcgttttcagccgctaattggtcaaagtcttcttgatagaagatttcacgtttagaacgagcaccataccagaatgacattttacgtttagattttaaacgttttaattggtcaaagatatgtgaacgcattggcgccatacctgcaccaccaccgataaataccatttcgttgtcggtttctttcgcgaagaattcaccgaacggaccagaaatcgttactttatcacctggttttaatgaccaaatgtatgaagacatttgacccggtggaacatccggattacgtggaggaggcgttgcaatacgcacgtttagcataatgatgcctttctcttctggatatgaagccattgagtaagcacgaataatatgctcgtccacttttgacacataacgccataagttaaatttatcccagtcttcgtgatactctttcggaatatcgaagtctttatagttaactgtatgaggttccgcttcaatttggatataaccacccgcacggaaaggtacttcttcgccttcaggaatttgaagtttaagctctttgatgaaggttgctttgttatcgttagaaataacggtacattcccattttttcacaccaaagatttcttccggaagttcaacatccattgaagattttacgtttacctgacacgctaaacgccaaccttctttcgcttctttcttagaaatgtgcgataactcggttggaagaatttcaccaccgccagattttacttgtactttacattgaccacatgagccaccgccaccacaagctgacgatacgaaaatacctttgctcgctaaagcaccaagtaatttaccacccgccggaagcgtaatgcctttttccggatcgttgttgattgagatggtaatatcacctgaatcgactaattttgatttagcgaaaagaatgatcaccgcaagcactaatacaagagcagtaaatgcgataataccgaaaataaaattactatccacgatatgctccttataattgaatgcctgagaatgacatgaagcctaacgccattaagccaacagtgataaaggtaatacctaaaccacgtaaacctgccggaacatcagaatatttcattttttcagttaaacctgctagtgcaacgattgctaacatccaacctgtacctgcaccaataccataaaccacagactccgtgaagttgtattcacgttgaaccatgaatgatacaccaccgaagatcgcacagtttacggtaatcaatggtaagaagatacctaatgcgctatataacgcagggaagaacttatccaaaatcatttctaaaatttgaacaagtgccgcaatcacaccgatgaatgtgatgaagtttaagaagcttaaatctacaccttcaacaagtgcgccatcttttaatacgtgtgtataaactaattggttagccggtaccgcaatacctaatactacgattaccgcaatacctaaaccaaaagcagttgaaactttcttagacaccgcaaggaatgtacacataccaaggaagaaagaaagtgccatattctcaatgaatacagacttaacaaatagacttaaataatgttccatcttatttctccacttgctctggtttccaggtacgaattccccaaatcacaaaaccgataatgaagaacgcacttggcgctaataagaataaaccgtttgcttgataccaaccgccgttttgaacagtttctaatacggtaataccgaagattttacctgaaccgattaattcacggaaaaatgccacgatgattaacatcgcaccgtaacctaaaccgttaccgataccatcaacgaaactttctaccggacctgatttcattgcaaatgcttcagcacgacccattacgatacagttagtaatgataagacctacgaatacagaaagctgttttgataagtcatatgcatacgcacgtaaaatttggtcaactaagattacaagtgatgcaatgatagccatttgtacaatgatacgaatactattaggaataaagttacgaatcattgaaataaacatactagagaaagcagtaactaaacttactgcaatcgccattactaccgcagtttgtaactgagtagttaccgctaatgcagaacagatacctaagatctgtaatgcgatcgggttgttatccgcgattggagataacaataactttttaagattgttactcgccattagttagctcccattgctgctttgaatttcgctaaatatggaccgaaaccgttagcaccgaaccaatatttgaatgagccgtcaacaccgtttgaagttaatgtcgcaccagataaaccatcaataccgtgatctttatctgctgaagcacctttacctacggttaatgccacttcattgtttgcgttgaataatttcttacctacaaagtttttctgccagttagggttagcgatttcgccgccaagacccgcagtttcaccttgttcatagtaagtaataccatttacagtgttcgcatcaggttgaaccgcaacaaagccgtacataattgaccataaaccgttaccgtacataggaagtacgacttggcttactttacccgcttcgtcttttactaaataaacttccgcatatttagcacgtactttgatgttcgctttatcatcagccggattgatcgctacgttttgtgcaggatctttcgccgctgctttcgcatcaaagtttgttacgccttcaacataatcaccggtcgctaaatcaacgattttaggttcgatgaatttcgcataggtttcttgcacgtttgtatttggctgcattaaacctgctgcttgtaaaatgttcttttgtttatcaagcactttctgaatatcttgcgtaggtttaagcaatactgccgcacccgctacgataagagaacagattaaacttaataacacaacaacggttaaagtaccgcctacgctatctttattaaatttagccatttttatgccgccttcgcttttctacgtttgatgttgccttgaactactaagtagtcgaagatcggagcaaataagttagcgaataagattgctaacatcataccttcaggatatgccgggtttgctacacggataacaacacacatcacaccgattaacgcaccgtaccaccatttacctttgttagtaaatgccgctgatacagggtctgttgccataaagaacatacctaatgcgaaaccgcctaacactaagtgccaatgccatggcattgagaatagtggatttgtgtctgaaccgattaggttaaatacggttgctgttgccgccataccaacaaatacgccggcgataatgcgccatgaagcaatacgtgtgaacacgataattgccgcaccaatcattaacataagtgttgaaacttcaccgattgaaccaggaatgttgcctaagaaagcatccatccaagtaatttcttgaccggttactgcgtgtttaagcgcaccttgaccgccttgcgcccattgtgaaagcgctgttgcaccagagaagccatctgcagcagtccacactaagtcgcctgaaatttgtgccggataagcgaagaataagaacgcacgacccgctaatgctgggttcataaagtttttacctacaccgccaaacacttctttcgcaaccacaacaccgaaggttgtagcaagcgccgcttgccataatggcaatgttggtggaacgattaatgctaataagatagaagtaacaaagaaaccttcgttaatttcatgcttacgcaccattgcaaatacaacttcccagaaaccacctacaaggaaaaccgttaagtagataggaaggaaatacgttgcaccaagaagcattttgctgccccagcctgcatctgcggttaaagttgcgcctaacgcatcagagaaaccataatgccagttacttgcgattgaatccgctaatgtacctaaatggcttgttgcaagaattgcttgcgcacctacgttatacataccccagaacattgccgggaataacgctaaccatacgatgatcatcatacgtttagaatctaacgcatcacgtacgtgtgaatctttacgagtcacagtacccggtgtataaagaatggtatatgtcgcttcaaaaagcgtgtaccatttctcatattttccacctttgtgaaacgcaggttccatcttttcaaaaagattttttaaacccattttattaaccttccttctcgatcttatctaacgcagcacgtaacatcggaccgtagttgtttttacccgggcaaacataagtacataatgctaaatcttcttcatctagctctaagcaacctaagttttgcgcagaatcggtatcgccggcagctaagtcacgaagtaataacgtaggaataatatctaacggcattacacgctcatatgcaccgattggcaccattgcacgctcaccaccgtgaactgcagtcgtgaagttaaataattttttgctgaagtgacctaatacggtacgagtgatagagaatttatccgaacctggcataatccaaccgaataattctttctcacgaccttccgcaagtacagaaacttgtaacgcataacgacctaagtagttaaccggacctgttgccgttgcaccacttaacactgaacctgaaatcacacggttttcacctgcattcagctcgtttgccgttaattgtgaaaggtttgcaccaagacgagtacgtactaaacgtggtgtttttacttgcggaccagcaagcgcaacaacacggtcagtaaacaattcaccgcttgtgaataatttaccgattgcgattacatcttgataatttaaatgccatacggttttggttaaacctaccggatcaataaagtgaatgtgagtacccactaaacctgccgggtgacgacccgcaaattcgtgtacatttacaccgctaactgaaggaacattcgcaccagccgctttcactaaattaactttcacgcctaaacgagttaagaccgttaaaccgtgttcgaaatcatttttgtattcgttaatgatcactgtcggatcagcgcttaacggattagtatccattgcattaacgaaaatcgatgctggagttgcatcaactgcaggaactttgctgaacggacgagtacggaatgctgtccataaacccgaatcaacaagatttgttcttacttgttccgctgataaagaggccaattgcgcagcttcatagctcttaaaggtaatttgctcatcaccctcaactttaatcacgactgattgaagaacacgtttttcaccacggttaatcgttactaccgtaccgcttgctggggctgtaaatactacgccagggttctttttatcttcaaaaagaacttggccttttttcactacatcgccttcacgaactttcattgaaggacgcatacccacatattcttcaccaagcatcgcaacttcattaacggtattgccgttatggattacttgtgccggtgtacctgcgataggtaaatccaagccttttttgattgtaatcatattgtttgcactactttttgttgggttaaaaaataagattacgaaaaaatcgcaatcgcttctcttgagccgtaacgctgatttaaaaacaaacgaattcccccacttgtttctaaaaagttacattaagttctcaaatctaggctttatcttggaattaattcacaagctaaaataaacgaggtattttaccttaaaaacgagctaactttccacaaaaacacacgattttaagccgttagcccttgaatatttgaaataaatcaatatttattagacaattttttaacatttacctctaaagaggtgatttaaatttcagcgttttaacgccaaacaagcggccaaatttctaaactttttgcaaagtttgtaacaattggtaattacaaaattttgagtagaaaaaaccgcctgtaaggcgtagaatacccgatgattttactcaatttaaataacgaatttggaaactcataatggaacaacaagaagcaattcatatttcgatttctgaagcagcgcaggcgcacttccgtcgtcttttagaacaacaagaagaaaataccaatattcgtattttcgtggtgaatccgggcagccctaatgccgagtgtggcgtttcttattgcccccaaaatgccgtagaagacaccgatacacaatttgaatataacggtttctctgcatttgtagatgaaattagcttacctttcttagatgaagcagaaattgattatgtaacggatccaatgggatcacagctcacgttaaaggcgccaaatgcgaaaatgcgtaaagtagcggatgacgcaccttttatcgaacgcttagactatgtgattcaaactcaagtgaacccgcaattggcaagccatggtggccgagtaaccttaattgaagtaacagaagacaaatatgcaatcctacaatttggtggcggttgtaacggctgttcaatggttgatgtcacattgaaagaggggattgaaaaacaattattagctatgttccctgacgaattagtcggagtgaaagatgtgacagaacatcaacacggcgaacactcttactactaaataacataaaaaagcacgagcaactcagctcgtgcttttttttgcaatttttcagccaaatttaaccgcttgctaaagtaatgtcggataacgttgttgaatttcgctcaataaagcttttttatcttgcttagagagaaaagccgcttcaatcgcattaaataaaagttgctgcgcttcttctttagtaagctgataatctgcttccaatagatggaattcatttcttacatccgtttgagaaacggtcatattatcgctatttaatgttgccactacacctcgctctaaaaaagcacgtaacggataatcctgcaaatgctgaaccgttttagtttgcagattactacacggacacatttctaacggcgttcgactaccaatcaatttacgcattaccacttccgactgaatggagcgaactccatgcccaatacgagatgcgccgaaattaagcgcttgctcaacactttccgcaccagccgcttctccggcatgaagggtaaacggtacacctaattcatttgcataatcaaattctgcactaaaattcgccgtcggaaagataccttccgcaccggctaaatccaccgccaccacaccggcttcacctttacttaaatatttatgcgctaaacgtacggtttctaaattttccgcctgattatccgctgctcgcatacagcataaaattaaatttgctttaaataactgtgtttttgctaagccttcttgtaaacctttaatcgccgcttgtaccacttgctcttgatccatgtttttttgggtatgaaattgtggtgcaaaacgaatctccgcataaagcaagccagcttgatctaatcgttgtagaacatcagtaacggacgaagctaacgcttcaggggtttgtaacaaagaaatgggtaattcgaaacagcgtaaatattggtttaaatcgctacaatcttggggaacagaaataaaaggaagtaaggtttgggggtcagaggacgggagttgaatttgctgtttagctgcccattcaatcatccattgcggtgatagcgagccatctaaatgcagatgtagatcaatcacgccgtattttgctaagtgtaaagccatattgtctccttaactgttattgatattttatatatggtcaaacaaagattacacaaacttacataaaatgacaatatataaaacaataagcggtttaatttccgagaaatattacagatataaaaacaccaccttacggtggtgtttttaatgcttttaattaaccttcacagctagaacagcttaataagttacggttaaacacttgtgccgcactcattgagtattggtaataaattgattttaaaccgagttcttctgcggttaagtataattggtttaaatcacgtgccggtgttgccggatgaaccataatattaatactttgaccttggtcgatatatttctgacgttgtgccgcttgctgaatcacgcttaactgactaatttcagagaaggttttgaatacttctttttcttcatcggttagttgttctaagtgctgtacagaaccgtcattatgtaaaatcgattcccaaatctcttccgtatctaaacctttttcttggagtaatttctctaagaacgggtttttatacacggttttgattttcgctaaatccttaacatagtagttagatttaaacggttcaaccgatggtgatacgctacctaaaataaaactacttgatttggttggcgcaatactcattaaagtggtattacgacgaccataaccttttaagatttccggctcaccaaaacgtttcgctaactcttgtgacgcttttaaggttttctcttgtaacgttttaaagattaagttgtttttttgcattgcttggaagctatcaaacgcaatattattcgcttgtaagtagctgtgccaacctaatacgcctaaacctaatgcacggtgacgagttgcaaagcgatgcgcacgatctaagaacggcatatctttacttttctcaataaactcactcattaccacgtctaagaagtaggttaatacttcaggcgcatccgtatctttccactcatcaaaataaagtaagttcattgaagaaagacagcaaacgaagctttcatcattgcttgacggaagcataatttcggtacataagtttgaagcgtgtaccgtcatatttttatctttataaacgtccggacgaccggcattcgcattatctttaaagaataaatacggaatacccgtttccgttttacgttgtaatagttttgcccaaagttgacgtttatacgggtcacccgctttcattgattctaaccaatcatggccgacacatacgccgtagtacattaattggattgggttaccttcggtatgaatatctaaccattcgtcaatatcgccgtgttcgatatcaatataaccggcaaattgacctttacgtgacgtaccttgagaaataacatcaatcactgtatcaaacaatttactaaagttgaacgaaccgtctgatttaccgttatttttaattgctgaaccacgtggacgaatatcaccgaaataagcggaagtaccgccaccgattttactcatcatccccacttcagcggtcgtcaccataatttcgtggattgaatcaccaatgtagctaccaaaacaagaaatcggtaaaccacgatctaaaccgaaattcgaccaaatcggagaagaaagtgagaaatagccacgagccatatagtgatagaatttatccgcataaccttcgataccaagtttatgctccgcatgttcagcgataaaacgaatacgctctaatgcggttgttccttcaagtaagtaaccacgttgtaaaaataagcggctatcttcatttagccattcaaaatcagggcgagtattagaataagtcatctgcggtaatctgcttcatttttttgctgtaatcagtactacgtttgttaaagaaatctgtttctttcgttgacagaatttcaatatcaaaccactcagtttcttttagtaattcaggatttacatcgtatggcggctctaaacctagcgtcattaacgagttgttataacggctacgaatatagttttctaccgcttcacggctaataaagcttaaatcgccttcttcaaaaatccaatctaaaatgccacattccgcctcaaatgcttgagtagatagggtctttaattcttcaaaaaattccggagtgaaaagctcactgtgttcgtcacgtaaaatttcgtataacgcaataccgaatttaccatgaatttcttcttcttttgacgttgcttcaaccgcattagaaatccctttaaagaggtttttatgcttattgaacgacatcataattaagaactgaccgaataatgaaatatgttctacgaaaagagagaataaaacaagtgaaagcacaaattcacctttacccgcatctttatctttcatgaacgattccatataacgaatacggttcattaacggctcaatctcttggatttggctaaacatttcgtttaagcctaatttttctaataaaaacgagtatgcatctttgtgacgaacttccgactctgcgaatgtaccgcccacatcatccatttccggtttcgggaaatagcgatacagttcaccccagaaacgttttacgtttacttccacttgagaaatcgccaacatcgcacgagttaacacatgacgttcgtgatcattgatatcaatacggtagttctgaatatcaccggtaaaattaaactctgtatgcaaccagtaagaatggcgaattgcatctttaaattctaataattcagggtattcgtatggcttgatgttcaagcgtttttcaaaaagatttcttttggacatactcgttaactctatctttattcattgataattaaggcgtggattttagggaaaattttttagtaccacaagtcttgacaaacaagctttttagctagtcatttgatttataaagaaaaaaatttttgtcaatttataaatcaatatctagtggtttatttgtaaaaatctactagatattgtattgcattaattataaccagatcataagccaaacgtaaaaaccgtgaattcacaagcgttttatagtatgatgagcgaaattttgatccctttacaagcggttaaatttagcgaaaaatttacaaaagatcggctaaataacaccgcttgttatttttattcgtgaacaattttatgcaaaatcaattttaccgcggacgtttttccgttgcaccaatgcttgattggaccactcgtcattgtcgctacttccatcgtcaatttagccaacacgctttgctttataccgaaatgatcactgcgccggcgatcattcatgcaaaatacgatctgcttgaatacgatccgagtgaaaatccggttgcgttacagcttggcggcagcgatccggcacagcttgcgcattgtgccaaattagttgaagaacgaggctatgccgaaatcaacttaaatgtcggctgcccttccgaccgtgtgcaaaacggaatgtttggtgcttgtttaatggcaaaagccgatttagttgccgactgtatcaaagcaatgcaagatgcggtgcaaattccggtgacggttaagcatcgtatcggtattgatgacttggacagctacgaattcttatgtgattttattgagaaagtacagccgtatagtaacgattttatcgttcatgctcgtaaagcgtggttgtccggtttaagtccgaaacaaaatcgtgaaattccaccgcttgattacgagcgtgtttatcagctgaaacgtgactttccgcacttaaatatttcaattaacggcggcattaaaactgttgatgaaatcaaacaacacttggcatttgtcgatggcgtaatggtggggcgtgaagcctatcaaaacccgtcattgttaggtgaaatcgattcgcaaattttcgatgaaaatcgaccgcttgtcaccgcccgagaagcggttgaaaaaatgctaccttatattgaggcgcaaacgcaaaaaggagtttatttaaaccacatcgttcgccatatgttaggcgcattccaaaactgtaaaggcgcacgccaatggcgtcgccacttaagcgaaaacgccaccaagcaaggggcaggcgttgaagtggtagaacaggcgctcagttttgtacaagagtaattaaatttgctatttccccctgagcaggcataatgtttttatcttatgcatccttcgggggaaatatggccattcattcagtcaatccaaaaggcagtttagaccaactctcacatttagaaatggaattgctgaccaaaaatgcgcaaggcaatctctattctctttatcgcaactgttcgcttgccgtactgaattccggtgcagtcaccgatgacagtcgtgcgctgctcaatcaatatcaacactttgaaatcaatctgattacccgtgaaaaaggggtgacacttgagctgcacaacccgccggaaaccgcttttgttgacggtaaaatgatgctcaatattcaatatcatctatttgccgtattacgtgacattgtttttgtaaacgccctttctcaatatttcaaacaagatcaaccgcaaaccgattgtcgctatatcaccaatcaagtcttttcaattttacgtaatgccaaagcgcttgagattggttctgatccgaatctgattgtttgctggggcggtcattcaattaaccaaactgaataccaatattgtcgagcagtcggcaccgaattggggctacgtttactcaatatcgtcaccggctgcggtaccggtgtgatggaggcgctaatgaaaggcgctgcgattggtcatgcgaaccagcgttatcagaatagccgttttatcggaatcaccgagccctctattattgcctccgagccgccgaatccgatcgtcaacgaattaatcattatgcccgatattgaaaaacggttagaagcattcgtgcgaatgggacacggcattgtcatcttccccggcggccccggtacattagaagaattgctttatatcatcggtataaaactcaatccggcaaataagttgcaacaattaccggtaattttaaccgcaccaccggaaagtgccgattatttcaccgcaattgatgaatttataggagaaacgctcggtaaagaagcgcaacaacaatatgaaattatcattgatgatccggttttagtcgcccaaaaaatggcacatgcgatgagagaagtgaaacgtcagcgccaagcgctagccgattcatatagttttaactggttactgaaaattgatgatgcttttattttgccgtttgctccgactcacgaaaatatggcgaatcttgatctgcattttgaccaagctccagcgcaattagcggcgaatctacgccgtgtattttcgggtattgttgccggtaatatcaaaccagatacgcaagatatgattgagcaatacgggcctttccagctcaaaggcgatcgcaaattaatggagaaaatcgaccgcttgttacaacgctttattcagcaacatcgtatgaaactaccgaccggagaggcttacaaaccttgttatcagattcataaatagcgaggggaattatgtatttacaacagattgaaatcagcggctttcgaggaattaatcagctcacattacaattgcgtccgaatatggtcttgattggtgaaaacgcttggggtaaatccagtttgctggatgcgctcagccatatcttcaatatcaacggtgagctttatcaatttagtgaatccgacttccaccaacaatatcatgcaactaccaaggcggagcaaatccgcctcatgttcaccttctgtgccgaacatgaggacgaatgtcaggctgatattcatcagccctattgccaccttttttatccggatgaaaaaggcaagccttgtattaatctgcaagtttcaggcaaatgcttaaatggcggtgttgaaaccgactaccgttttctggatagcttcgccaaaccgctaacggttgccaatcatgaagacattattctttcgattatcaatcactcgcccgtttaccgctttagagatgcccgtttaaataaattctcgccgcttgaaacactttctcctcatatcgaaaatgaacaagatacgctacaaagcgaattacaggcgctctctctactgttgcgctattactttttaagtatcaaaagccgtcaacaattagccgatgcaatgcaagacacttccatactatgggaaagagttaaatcactttgcttacgtttaaaacaggatcaaagcggagaactgacgcataaggtgcgcactcacctttcctcgttgtttatgatcagccaaaaattacgtcgtgttgaaaagccgattattttatttgaagatcttgaagcacgtttacatcctcgtatgattgcgatcttttgggaattagtaaattacctgccagtacaacgtattaccacgactaattcgatggaattactttctcaagtgccgttacgtgaaattagtcgcttggtgcgttatcgagatcataccgaggcatattcgcttgcacacagttcgttgggcaaagaagacctacgtaaactgacctttcatattcactacaatcgaggtttagctttattttctcgagcatggattttagttgaaggcgaaacagaagtttggattctaaccgagctggcaaatttactggatattaatttggaaatggaaggaattcggatagtggaatttgcccaatgcggcttacgcccgttaattaaatacgccaaagcgatgggcattgaatggtacgtattgaccgacggtgatcaagcgggcgaaaaatatgccgatattgccaaaagcatgttgcaggaaaacgaacacccaagtaaacatttgaccgtcattccacgccaagatatcgaacattttttctatcacgaaggactaagggaagtatttgtgcgtcttgcccgttggcagccgagagatcataaatacccgaccaaaaccattatcaaacgggcgattcagtacacatcaaaaccggatttggcgattgcgatttcaactgaaatcaaacaacgaggcaaccaagcgattccgagtttatttagaaaactattcattaaagttttgcaacttatcaaagagcaataaataacaagcggttaaatttacaagattttttgcaaatttaaccgcttgtctgattcaaaatccgccatggctagcgtcgaatttcaaagcgttcgaattgttccgagccttgataacattgttcaattaaattacgtactgcagatgtcggagggcctttttgtaaccagtttctgaacgctgccatttgcgcttcgctaccaatggcaactacttccaccgagccttcagggcgatttttcacataacctttaatgccgattttccctgcctcttgtagcgtgaagaatcgaaagccaacaccttgtacgtgtccggtcacaataaacagtttctgctgcataagccctccgtcaatttctacattttcaatttaattaaacgtgcgacattttctgcgctagactccaagttttctcgtccttgttttaaggtttcttcgagtgaattcaattggcgaataatcgggaataccgcatcaatgccgtgctgataaaccacattgtaatcttctcgtaagcagccgacaatcgcaattaccggcacattaaattgttttgccgtttttgctacacccaccggtgttttgccggcaatactttgtgcgtccatacgcccctcgccggtaatcactaaatccgcatcttggatatgctccgccaaacgagtcgcttcgataatgatttgtacacctgctttaagctgcacattcggcagtaataataaaccaccgcccataccgcctgccgcaccggcgccggcatgattagcaattgcaatcccctgttgagctaatgcgacatccgcaaaatgtgccaacgcattatccaaagtttgaaccatctccggtgttgcacctttttgtggaccaaatactgctgaagcgccacgctcaccgcataacgggttatttacatcacacgccacttcaaactcaacactttgtaaacgaggctctaaattttctaacgaaatctggcagatttgttgtagctgttcgcccccaaaaccaatttcctcaccggctgcatttttgaacgaagcaccgagcgcttgcaacataccgacaccgccgtcattggttgcactaccgccaatgcctaacagaattttcttcacacccaaatctaacgcttttttgattaattcaccggtaccgaaactggtagttttaagcggattacgttgttcaaaaggcacaagatgtaaaccggaagccgccgccatttcaataaaagcggtctgtttatcgcccgaaatgcctaaaaagccggtcactttattaccgagcggcgcagtcacttcaacttctaacagctcacctttagtcgcatcaattaatgactgaaccgaaccttcaccgccgtccgccatcggtactttgatgtattgtgcatcagggaaaatacgtctgaaaccgccttcgatcgattgcgctacttcaagtgcagtaagactttctttaaatgaatcgggagcaataacaattttcatattttacctcttagaataatttaaacacaccaaataccaaggttgaaacaatagtcataattaaaccgaccgctgtttcatacggaatcaattttaagcgttctttcatatccatattgacgcttccgccggtggcgtggaagaaagaaccgtgcggcatatggtcaaatacggtcgcaccggcgtgaatcattgccgcaccagccaatgcacttacacctaattcaattaaggttgcactaaatacgtttgacgctaccaccgtacctgctgtagttgaagcggttgccagtgacattaacgcccctgaaatcggtgcaagtaaataagacggtaagcctgaagcggtaagcgcttcaattaacacatcttttaaacccgaattagcaataataccggctaacgcccctgtacctaataacatcacggcaaccggtgacatttttaataagcctgaagtggcaaattgattcacttgttttaatttgcccattgccaacgcaccgactaaaccgccaagcggtaatgcgatcagcggatcaattttaatatccgcaatagggcgtaatgctaataagataatcgcacaaagcggtgcggtaattgccggtaggaaagcgggtaaattttgcagattatttgcagagacttcgttatccgccacttttgaacctttgttgataaggcgtttggctaaaaaataggtcagaataataccgaaaatggccggaaggatacctgctgccataacagaagtgagcggtagatggaaagcgtctgaagcagcaatcgcatttgggtttggcgacataatgttaccggctttaccgccaccaatcatcgctaataagatagccggtttcgataaatcaccacgtttcgccaacgctaatgcgattggagaaacggtaatcaccgccacatccacaaataccccaacagaagtcaaaatcatagttgaaagcactagtgcgagtaatgcacgggtttcacctaattttttcacgatggtttcagcaatggtacttgccgcaccggattcaattaacacaccggctaataccccagcggctaagatccgcattaccgccgtggtaattccttgcgctccgccaatcattaagctcacggtttgcgacagatccgcaccgccgattaaaccaccgaccaatgccccgattaacataccgtatgccggcggtactttctttaagattaaaactatcgcgactgatagtgctacaacagcaccgactgcagttaccgcaaccatattgttctccttaataccaaaaacataaataaattgttcggcattatgcggatttttaatggaaagtcgttagtgaaaattacaaaaaatagcgagttacaccgggtaatattgtaaaattcaacaaatcaaggcattaaaatcgcacctaaatataaaataaatttatcttctatcttattgaaagataaagaagttatttgttcgattcgttctaaacgataacgtaaggtattttgatgaataaacaatttttccgaagcgtgaaccagatcacaatttgacaaaaaatattgctgcaaacttttaaacagcacgtttttctcatcttgagaaattaactgttgaaccggtgtaaataattctttggcttgccacgaatgagaaaaatccgctaatagcgcctgtaagcgataatcttcaaaacagataatctgctttttcgtgtgattattttccgcatacgctaaggtatgtaatgctgattgataagaaaaatgcgcttcaacaaaatgtccaacctgacaaccgattaccatacgataatccgcttcaaccgcttgtgacggaaacaactggttaagtgttttatgtttttgtcgatgaagtaattcttctgccggtagcagcaaaactaatttatctaaatcaaccacaacaacactggcattctgttgctgctgctctaaatgtaataaaacagtctgcagctctgctgaagtaggcttatttaatttgataataatcgcagccaatgcttgagccggatctaaattaaagaaacgagcctgctgctctgtttgttccttacttaagctgccttttaataattggcgaataaattcttctttataacggcgctgccagcgttccgtttccaaaacgatcgcttgttcgacaattaattccgccgccatagtgactaattccgcataatgacgaacagcctccggtgcacctgaaataccgatcacgccgatcgttttacctaaatagcgaatcggtaaattcagcccttctctcgcttcatagttccactgttttgctaatttttcgtcaatttctaccgcttgatcatgacgtaatacaattacggcaccggtatgacgctcacctacgcgactcgggtcgccggaggcaataataatgccctgttcgtccatcacattcactgaatttggaataatttgcatggtgcgtttgacaatcgcttgtgcggtttgtttgtctagtttcatcatttcttctctaattaacgcaaaaaataagcgacaagcggtcaaatttttccaattttttgcaaaaaatcagaaaaaacaaaccgcttaaaaaacaatcccctgacaagcaggggataaagattaatgtttaataatatataagttacgcaacaaaatatcatcttgcggatctttaccactataacctttcacatacggtttgactaaacgtgggttcacatagttataaatcggcacgatagcgtaatcgtccgcaagtactttttccgctttcgcataagcggtcgctctgccttccgcatccgtcgctttgtaggactctgctactgcttcatcatacgctttacttgcataacctgttttgttgttacttgaatccgataggaaatacgtcacgaaagtgcttgcttggttataatctgcagaccaacctgcacgtgctaaatcatatttaccttcacggcgtgtatctaaataggttttccattcttgattttctaattcaacttgaactagccctttagtattggctttccataatgaagcggcggcaattgcaatttttttatggttgtcattggtgttatataaaatcgagaatttcaatggattcgctttactaaaaccggcttcttccaataatttaaccgcttgtgcattacgttctgccattgcttgctggctatattcaggcgattgaattttttgtccttcgtgaatataggtcggtgtaaatacataagtcggcgtttgcccttgtcctagcaccttatcggcgataatcgtacgatcgagcgctaaatttaatgctttacgtactcgaagatcatcaaacggttttctattcaaattaatttcatataaataagtagaaagtgttcttgcggtaaagacttcttccggcagatcttttttcaacttagcaaactgttccggtggtagcgtatagttcgttacatctaaatctcctgctttataacgagccacatcggtagtcgcattcggaatggctaaatatgttgctttattgatcacagtttctttgtcattccaataatttgtattacgctcaaacacgattttttcattgataacatgttcagctaatttatacgcaccgttaccaactaagttcgctttttttgcccaactatcaccaaactgttccactacttttttatttaccggcaataatgatgaatgggtggttaattcatttgcataaggaaccggattagttaacgacagcactaacgtatagtcatctaccgctttcacgcccagttcttccggttttttcttgccatcaataatctcttgcgcattttccacttgtaaataagtcagataacttgcataaggtgaagcggttaatggattggctaaacgctgccacgcatagacaaaatcatgtgccgttaccggctctccgtttgcccattttgcattttgacgcaatttaaatgtccaggttttgtaatcgggagaactctgccagctctctgccacaccggcttgtaattttccttcttcatctttagtaatcagcccttcaaataactgataagcgacttgtgattcaggcacaccttctattttttgcgggtcaaaactggcaggctctgaaccgttattaataataatttcttgtttttccgccaataccgttccttccggcacttttgcggcaaaagccgtgctggataagccaagtacgattgcgatatttaataatgagcgagtcagttttgtttgcataattattccctttatttgaataaatatataatacgtatatccttaaagttttaaaacaaaaaaataactttgtaaagcgctacgttttaattcttctcgctttttttccattttgtgataggaatcaccttttattgcaaattattcaataaaaataagttaggtaatcacgctataaagcgttacaaagcatagataagcgtctatacatacgaaataactcagaataaaattctgtattttctcaataacaggcatttttttacttactcattagaataaaaaacgccattttttgcaaaaatagcgttttactttcatttttttaaccgttatattcattagcactaataggtaagcggttgcttttgcaaaaaagaaagcaaatttgaccgcttatttattcatatgcattcacaatatttattttagagttggacaatatcatggcaaaaacattatacgaaaaactatttgatgctcacgttgtatatgaagccgcaggcgaaacgccgattctttatatcaaccgccatttaattcatgaagtgacaagcccgcaagcgtttgacggtttacgtgttgccggccgccaagttcgtcaagttaacaagacattcggcacaatggatcacagtatttctacccaagtgcgtgacgtaaataaattagaaggtcaagcgaaaatccaagttttagaattagcgaaaaactgtgaagcaagtggtatctcgttattcgatatgcaaaccaaagaacaaggtatcgtacacgtaatgggaccggagcaaggtttaaccctaccgggtatgaccattgtatgcggtgattctcatactgctacacacggtgctttcggtgcgcttgcatttggtatcggtacttctgaagtagaacacgtgcttgcaactcaaaccttaaaacaagcgcgtgcaaaaagtatgaaagtggaagttcgcggcaaagtgaacccgggcattaccgcaaaagatatcgtgcttgcaattatcggtaaaacaaccatggcgggcggtaccggtcacgtggtggagttctgcggcgaagcgattcgtgatttatcaatggaaggccgtatgacggtatgtaatatggcgatcgaattcggcgctaaagccggtttagtcgcaccggatgaaactacttttgcttacttaaaaggccgtccgcatgcaccaaaaggcaaagattgggatgatgcagtcgaatattggaaaacattaaaatcagacgatgatgcagtctttgacacggtagttgtattagaagcgaaagatattgcgccacaagtgacttggggaaccaacccggggcaagttatcggcattgaccaagttgtgccaaatccacaagaaatggcggatccggtgacaaaagcctctgcagaaaaagcattggcatatattggtttagaagccaacacggatatgaaagatattcctgtggatcaagtatttatcggctcttgtactaactctcgtattgaagacttacgtgcagcggcggcagtaatgaaaggtcgtaaaaaagcggataacgtaaaacgtgtgctagttgtaccgggttcgggcttagtaaaagaacaggcggaaaaagaaggtttagataagatctttatcgaggctggcgcagaatggcgtaatccgggctgttcaatgtgtttaggtatgaatgatgaccgtttaggcgaatgggaacgttgtgcttcaacctctaaccgtaactttgaaggtcgtcaaggccgtaacggtcgcacccacttagttagcccggcaatggcggcggcagcagcaatgttcggtaaatttgtagatattcgtcacgtggaattaaattaaggataaaaaaatggcaggattaaaacaacactcaggtttagtcgttccgcttgatgcggcaaatgtggatactgacgcaatcattccaaaacagttcttacaagcaattactcgtgtcggcttcggtaagcatttattccacgaatggcgttatttagatgcggaagaaacccaattaaatccggatttcgttttgaattttccacaatatcaaggggcgaccattttactggctcgtaaaaatttaggctgtggttcttctcgtgaacacgcaccttgggcgttagccgattatggtttcaaagtgatgattgccccgagctttgcagacattttttataataatagcttaaacaatcatatgcttccgattcgcttaagtgaagaagaagtggaagaaattttccaatgggtgtgggcgaacgaaggcaaacaaatccatattgatttagaagcaatgacggtaacggtcggtgaaaaagtttatcgttttgaactagacgaattccgccgtcactgtttattaaacgggttagataatatcggtttgaccctacaacacgaagatgctatcgccgcttacgaaagtaagattccagcatttttacgttagtctgataaaacataaagccaagtatcgctacttggctttattttattggctcttataaaaattcgaaatatgataaacaaaatcttctaatatttctattttctgcgcttcggtgacctcatccgaaactctggcggaaacagattcataaatcccctctgcaaaacgttttacatccaatgcataattcacacagaaggtatgggtacaatcgccccggtactcattagaagataataaccagttagacacattgttatcattacattcccctgaataccaatattgacttgctttgatcgccacttcacgttttaagcagtaacagtttgtatcaatatggtttttacgctctaaacaaatcgtaccggaaattcctaaagcatcggacgaaacatcaatatcgccaaccattttgtgatatttaccgactgactcaaatgtatcttggcaaataaattttccggtttccacattcataaagttacgcatgctataaacataatcatattggtgtgcagtaagctgacgaacacagttttccacatgattaggctcataccagttatcatcatctaaataacagatgagatcttctttaaccaaaaacggggcaatcgcattgatactgctatttgtccaaccattcgcaccggtattcatcggtaggtatgtcactaccacttgtgggtacttctctacaatcgctttcgcattcgcagaaaattgctgaccatcgacaaaaatatagtgcttgcaattggcatagctctgttgctgtacacttagaatagctcgttctaaatgcggacgacctattgttgatgtaataattgctacagaaggggctgtaacagacattattcactcctcagggataaatttataattttatatttgatacttggttttatcaccaatatcaaaatgtaacggcattcgccatttttgaatacttaatataagtaacaatagaccacaaacaatactgaatagttgtaataatatattttgctcaaaaacgatcgataaccaaagtactgccattaaaataggctgaaaatttaagccgaatactctaaagcaaaaatactctttgtaacttaagccgccgatggtaaataacattgcacccaatgccatcaacggtaggttgaaaatatagcacaataatccaatccataccgcaaattgaaacagaaaacggaaagtttttaaatagagatgtaaagaggaagcaagcagcacgccggcaatcagtaagcctttttgtgccaattgtaaatgataaggtaatagcagcaacattattgtcgcaatcacaaaacctgttcgatatagaatcacggttaaataatcccaaaaatccatcggtgattgaatatgtggatcagccattttttactccttttataaataacaagcggtcaatttttcgcaaaattttgcaagaaattgaccgcttgagaaagaaaagccttacagcttacgctttgtgactatcttgatagtcttttgccgcttttacaaagccggcaaataatgggtgaccgtcacgtggggttgacgtgaattccggatggaattgcgctgcaataaaccatgggtgattcggcacttcaatgatttccactaacttacggtctgccgataagccactcacttttaagcctgctgcttcgatttgtggtaataaagtattgtttacctcataacggtgacggtgacgctcaacaatggtttccgcaccatacacttcacgtgctttagtaccttcgattaagtgacattgttgtgcacctaaacgcattgtaccgcctaaatccgaatcgtcagagcgtgtttccacattacctgactcatcttgccattcagtaattaaaccaactaccggttgcggacaatctttatcaaactcagatgaatttgcttgggttaaacctgctacgttacgtgcatattcgataagtgcgatctgcatacctaaacaaatacctaaataagggattttgttctcacgtgcatattgtgcggtacggattttaccttccacaccacggtagccaaaaccgcccggcactaaaatcgcatctaagccatggagtaattcaacacctttggtttcaatatcttgtgaatcaatatacttgatatttaccgttaagcgattggttaaaccagcgtgttttaacgcttcgtttaccgatttatacgcatccggtaattcaacatatttacccaccataccgatagtcacttcaccggtcgggttcgcttggcgataaagcacttgttcccattcgcttaaatcggcttccggacaatctaggcggaaacgatcacaaacaaaactatctaagccttgtgatttcagtaattcaggaatacggtaaatcgaatccacgtcttttaatgaaatcaccgcacgttccggcacgttacagaataaggcgatttttttacgttcattgcttggaattgcacgctccgaacgacaaattaacacatccggttgaataccgattgaaagtaattcttttaccgagtgttgagtcggtttagttttcacttcacctgcagtcggaatataaggcactaaggttaagtgcataaataaggttttttcacgaccgacatccaccgctaactgacgtaacgcttctaagaacggtaacgattcaatatcgcctaccgtaccgccaacttcaacgataactacatcacgacctttgccgccttcaatcacacgttctttaatttcattggtgatgtgcggaattacttggattgtcgcacctaaataatcgccgcgacgttctttacgtaatacttcagaataaatcttaccgctggtaaagttgttcgctttgctcattttagaacggataaaacgctcatagtgccctaagtctaagtcagtttccgccccatcttgcgtaacaaaaacttcaccgtgttgagtaggactcattgtacccgggtcaacgttgatataaggatctagcttcataatggttacatttaaaccacgagcttcgagaattgatgcgagagatgcagcggcaatacctttgcctaaagatgaaacaacaccgcccgtcacgaaaatataattcgttgccattttgatctgcctttgataatcagttaaatagataagaaaattcggaatggatagtaaaataaaactatcaggacgggagcgtagtatacagtaaaaggtatttttgtgctatcggaaaaatcagcaagcggtcaaatttaaccaattttttacaactttattttgcaataaaaaggaaaaatttgaccgcttgttcaattcagaaattttgtgaacgagatcaaacaacaagcagtaaccgtttctatttacataggattacatgggataatttcttatctttttaaaatcttaaggagcttatatgaaacccaaaaaacttgctttatctgctgttctttctatggcgatttcaagcgtatatgcggcggaattaccaaatattacgattttagcaaccggcggaacgattgccggtagcggacaaagtgcagtgagttcagcctatcaagcagggcaattaaacatcgatacattaatcgaagccgtaccagagatgaaaacgctggcaaatattaaaggtgaacaagtagtcaaaatcggctcacaggatatgagtgacgaagtatggctgaaattagcgaaaaccattaataatcaatgtgctaatacggacggctttgtgattactcatggtacggatacgatggaagaaaccgcatatttcctcgatatgacggtaaaatgcgataagcctgtcgtgcttgtcggtgcaatgcgccctgcgacagaaaaaagcgctgatggcccgctgaatttatataattcaattgtagtggctaaagataaaaaatcggcaaaacgcggtgtgttagtcgcaatgaatgatgtggtactgggtgcgagagacgtgaccaaaaccagcactaccgccgtacaaacattcagttcgccaaacttcggtacgctcggctatattcataatagtaaagtcgattacgaacgtgcgccggaaagcaaacacacgctaaataccccatttaaggttgataatctgaatgaactgccgaaagtcggtattatctacgcttattcaaatatgccgaccgaaccgcttaaagccttattggatgcgggttatcaaggtattgtggttgccggtgtcggtaacggtaatatgaatgcggcgaatttagcgttacttgaacaggcggcaaaaaatggtgttgcagtggttcgctcttcacgagtgccaaccggctataccactcgtgatgcagaagtcgatgattctaaatatggctttgcggcatccggcacactcaatccgcaaaaagcacgtgtattattacaacttgccttaacccaaaccaaagacatcaatactatccaacaatattttgaagacttctagttttcgcctataagcaagcggtctatttcttgcaaaattttgcgaaaaatagaccgcttgtcttttcgtaactgtcgcttattttacaaagctatcaaaggttagctcgtaattatcgccatcacgattatatgaaatataacgagggaatttttcccctacatattttttcacggtaatcgctttttgatcgctggttttaaagctataagtaatttcttgataagtttgcccttttactttaactgttttctgaactttatttaatttcacattcggtgtcgggtataactttttaccgtttgtcgtttgaaaactcgttggtaattgatcgtaatagctcaactgaaatgccgttgtaaataaatcaaacgtcggcatcgttaacgcctcttgttttaaaggctctttcgctttaccgtacttaaccgtacttgaatcaatctctgccaatgcataggttttaccattacgtgtatcacggtagctcaacatattaaattgaccgttacgttccgtccctttcgctgagaaaacaatgttatataacggcacattaattttcgattgaatcgaatactgacccgctccatttttaaaatgcacataagccggcattaaataattcgagctatattttatattaaagtcttctgcccaagcggttgaaattaatgaagaaattgcaaaaaatgaaagcgcaatttttttaaaaaaactcatttatttttcctctaattttgtactttcgaacaaacgaagaatggcattactttctcgtaattgttctgctttctcaacctgcattttagttaaatgcggcgagaaataattaataaaatcatacatataattacgtaggaatgtgcctcgtttaaatgcaatttgcgtcatacttgattggaataaatggcttgcatcgattgctaccaaatcgctatccgcttcggtatatgccatcgacgccataatcccgacacctaagcccaaacgtgcataggttttaatcacatccgcatctgttgcagtaaacacgatatgcggcaaaatacctactttattaaatgcatggtctagatccgactgacctgtaaacccgaaagtataagtgatcagatcatatttacctagctcttcgaccgttaagttctgactttggttcgcaaatttagctaacggatgatccggtttaacaattactgaacgattccataaataacacggcaataaaatcgcatcttcaaataaatgctgcgcttcggttgtaatagcgagatctacttcgccagccataagcgcatcgtagatttggctcggtgagccttgatgtaattgcaaactaacttccgggtacttggttttgaatttctcaataatcggtggtaaaacataacgagcttgcgtattaggagtggcaattcttaatacaccgcaattcgggcgagtctgttcctccgccaccgatttaatactttgtgctttaaccaataattctcgagcaatcgcaactattttttctccagcaggcgttaaccctttgatatgtttaccatttctctcaaaaatattaattcctagctcactttccaataaacgcacttgcttactaattcccggttgggaagtataaagcgtttcagcggcttcagtaatatttagattttgattcacaatttcaacgatataacgtaactgctgtaatttcattgctattttccttttacgatttcaattaattcggcaatattcgtaatttcataagttggtcgagtctgggtatcattcactactcctgcatgattaaaccaacaagtatcaattccggcattattaccaccaagcacatcagaagctaacgtatcacccaccatcaagattttagtcttatccggctcatccattaaagcaaaagcatactcaaaaacctgacgatctggttttgccgcaccgatttgctccgaaacggcaacaaattcgaaaaagtgttgcgtatcggtatttaataatcgttgctgttgtagctcggtaaaaccattagtgataatccccattttgactttaccatacaactgattaagcattgccatcaccccattcagcggtttactgacaatggccatctcagccatcagctcctgattcagttgcaacgcatccacaccggtttgtgctgaaagtttagcaaagcgacgtgcctgtatatcttttgcagtaatttcattattctgataagccacccaaagcggtttattaaccgcttgaaattgttcgtaatccatacgactaaaatcaatatgataacgagcaagcatcgcttttaatccgtcataagaattaaacgaaaaaagcgtttcatccgcatcaaataaaatccaacgatatttcatctatttgtaacttccttctatttcatgcgtaatccattcgacaaaatgttgtacctttgccacttctttcatttgcggtgggtaaaccacataaaatgctttttcatcataaacatctgttacgaaaggttcaattactgacccctcttcaatttcatcttgtgcaagcattctatttgcaactacaacaccttgacgatgttttgccgcctgaattcccatcgaagttgtggaatacatcggaccggattcagcatccatatgatttaaattcagatgctctgccatttgtttccacttggtatgagaacatacatgaattaaatttttcccttctaaatcttccggtttactaatcgggttttcacgtaaatattctggtgaagctaagatcataattcgggcttgtacaagttcgatagcctcaagattttgccagttacctgaaccataataaattgctacatcaatatctttacccaataaaccttcatcttgtgaagctgttgttaaacgaacctcaatatcaggatgcttcttgtgaaatgcattaagacgaggcactaaccagtgcattccaaacgaaggcgttgtactgattgaaagaatttggcggctatttttaagttttactttttctgttgcactggcaatttgttcaagaagcggttgaatatcttcaaaatattgcgcaccgatttcggtgagttctagaagtcggttacgacgatgaaacaacgatacacctaaaaaatcttctaataatttaatttgatgactaaccgccgcttgagtgacaaataaatcgtctgccgccttagtaaagttaagatggcgagctgcagattcaaatgcttttaaggcgtttaaaggaggaagttttttattcataagtaataattctattttttccgtagatagctcatttctatcgcattattttttttgatagttaaaattaaaatttttagcttgtcatactggtctaacatcactataatgcgcgccgtacttagacggatagtgatagttaagcagtaagaatgtatttttttactgatttaactatttcagatttttaagtatgatgttgtgtttgcatattggtctaggaaactagactagagtaacatttagttactcgtttcacttcctgtatattttgaacccttttggtttattgaccgcccgatttgggcggttttttttcgtcttgaattcccgcattgtaacagaaagaataaatcctgctagtggataacgaacattttcattaaaatttcttatcaattcaccaaaaaactaaaaaattttatcaatcattttaaaaaactcaacttcctttcccatttgctatataaacctgctattttgtagtatcctttctgctaatttttattaacgaaagagaaatactttgagtaaacgcagacttacccaaaaccaacaacgcagaataaaatccaatcatcataaaaaaatcgcaaaacccgaattagaatggcaagacgaaatgcttggtgaagttcagcaaggtattgtggttacccgccacgcaaaacacgctgatgtcgaaacagcacaaggcgaaatttatcgctgtaaccttcgccgtactttaaaaaatgttgtcgttggcgatcaagtatcttggcgccaaggtagtgagcaattgcaaggtatcagcggtgttattgaggcgatttatcctcgcaaaaacgagttaagtcgccctgattattatgacggcatcaaagtgatggcagcgaatatcgatcaaatcattattgtttcggccgtattgccaaccctttcattaaacattatcgatcgctacttggtgatttgcgagacggctaacattcctgcacttatcgtgttaaataaaattgacttactttcggaaacagagcgacaagaagtacagaagcaattagcgatttatgaaaatatcggttacgaaaccctttgtctgtctgcagacaccggtgaaaacatggataaattagaccgctatttatcacgaggcacttcaattttcgttggtcaatccggggtaggaaagtcgagtcttatcaaccaattattaccggaagtaaatgcgttaaccggagcagtgagtgatatttcggggttaggccagcatacaactacatcttctcgtttataccatttaccgcaagggggcaatttaattgactcgccgggcattcgtgaatttggtttatggcatttagagccggagcaaatcacgcttggttaccgtgaatttcaatcggtattaggtacgtgtaaattccgagattgtaaacataaatcggatccgggctgtgcgataagagaagcggtcgaaaaaggcgaaattaatgcaattcgctttgaaaactatcatcgcttaattgaaagccgtgatgaaaccaaaagtcagcgtcattttagaacagaagaataagaatcaatagcaatgagtacaaatttcatttatcctaatgcccacttgatcgcaggtgtggacgaagtcggtagaggcccgttagtcggcgcagtggtaactgctgccgttattttagatccgaataatccgattgaaggattagccgattctaaaaaactgtcggagaagaagcgtttgcttttagcggaggaaattaaagcaaaagcgctttgctggtctttagggcgagccgaaccagaagaaatcgatcagttgaatatcttacacgcaacgatgcttgctatgcagcgagcggttgccggattaaatattcagcccgattttgtgttggttgacggcaatcgtattccaactttaccgatgccagcacaagcggtcataaaaggagatagtttagttgccgagatcagtgccgcttcgattttagctaaagttgcacgtgatcaggaaatggatgaattagataagcaatatccggaatacggttttgcaaaacataaaggctatccgactaaactacattttgaaaaactggaacaatttggggcaaccccttttcaccgaaagagcttcgccccagtgaagaaaatcttaggtttataaatgttagaactactactcgaaccattccaatataactacatgcaaaaagcgatttttgtcagtatgggcgttggtgtggtttgtgcttttctctccgcctttttaatgttaaaaggctggtctttaattggtgacgccctttcacatgccgtggtaccgggcgttgctatcgcttatgcgttaaaacttccttatgctttcggtgcatttttttccggtattcttgctgctctttcgattttatgggtgaaaagtattactcgaataaaagaagatgcggttatcggcttcatctttaccacattctttgcactaggtatgtttattgtatcactcaacccgacttcggttgacgttaatgccatcgtgatggggaacattctcggtattgcggatgaagatttgtggcaagttgcgatcattatcggattatcgctgcttggtcttatctgtttctggaaagatctactgctcaccttttttgatgaacatcatgcgctgtctgtcggactttctcctcttcgctacaaaatcttattctttaccttattaagtgcttgtgtcgtggtggcattgcaaacagtcggcgcaatcttagtgattgcaatggtcgttaccccaggcgcaaccgcctatttactgacagacagattctctcgtttagtcactatcgcgattcttatcggtagcctcagcagcgggatcggtgcctatctcagttattttttaaatggtgcgaccggtggtgtgattgtttgcttacagacctttatctttttactggctttttgctttgcgcctaaatacggtttgattagccaaaaacgtaagcgtttggaggctatcaatgaatgagttagtgctatggttcattgagccttttgaatttgaatttatgcaaaccgctttgtttactgcggtattagtcgcttctgtttgtgcggtattgtcttgttatttgattttaaaaggctggtcattgatgggcgatgcgatttctcatgcggtattaccgggggtggtcgtatctaacttattaggcttccctttagccatcggagcatttgtctctgggctattttgtgcaatttccgtcggttatcttaaagaaaactctcgtttaaaagaagataccattatgggcattatgtttgccggcttatttgcgctcggtattgtactttttaccgcactaccgaccgaacagcaccttacccacttattattcggcaatttgcttggtgtgactcaagccgaattaattcaaaccatgattatttgtgcggtaacttttagcatcattatctttaaacgcaaagacttcttgctctattgcttcgatagtagccacgctaaagttatcggtttaccggtcaaatggttacactacggactacttgcgctcttagcgttaactatcatcagcgcaatgcaagttgtaggtgtcattctggttgttgcaatgttaattgccccgggaattaccgcctaccaactgtcaaaccgctttgattatatgttagtcatcgcaatgactattgccatcagttcatctgtttttggtacgatattgagctatcatattgatgcagcaacgggcccgacaattattctcattcagtctagtctttttgttttagctctatgtttcagccgtttaaagactcacaagcggtaacatttttgtgtaaatttgcaaattagagcaaaacaatagagaattattgcttataacttatataaagaggaatcttattatgactaaaaactacgaagaaactattttcagtaaaatcattcgcaaagaaattcccgcttcaatcgtgtatcaagacgaattagtcactgcatttcgtgatatttcaccgcaagcaccgactcacattctcatcgtgccgaataagttaattccaaccgtaaaccatgtagaagcggaagacgaattagcattgggtcgcttatttaccgcagcggcgaaaattgcaaaagaagaaggtatcgcagaagatggttatcgtctaattatgaactgtaatgtacatggtggtcaggaagtgttccatattcatatgcatttagtgggtggtgaacctttaggcaaaatgttaagcaataaatagtatgaaacatttaaaatcttattggctatttgcaattttttcgttttttctgaccgcttgtggcagtaatccgcaaagttatatcaaagggaaatcagaaccgattgtaaatattgaagcgcaaattgctactcttgttaaagtcgaagcgaaaagtgagatgctatcggtaacaaatctaagtgagcatccgcttaatttatcttacaaattattttggtatgataaacaaggcgttacacaaaacagtgataatgtatctcctcaaccttggcagcctctttggttagatagcaagcaatctcaaacgttacagcttgagaagccgactaatgagagcaataactatcgtgtctatttacgtggtagccgatgaatgccctcgcttggcttgagagccaacaacaagcggtcatttttcgcaaaaatttagccggtttgaccgcttgtagccaacagattcagctcgcttccggcgagcgatttgttttacgccaacaaaatgagcgagcaacagctttcgggattaattacgctcaagaagcacaaattttacactatttaactcgcttaccctttacgccaaaggtctattaccacaatgaaaattccagtttattgacttggatagagggtaatacacctagccgttttagttcgtcattattagataaattggcatcacaacttgccgaactacatctttttcctattgatgaatcactaccaaagctcgatctttctgaacgctgtcaatttttatggcagaaactctctgttcaacaacaagcactattgagatttcatcccccatttcaaacgattcagccttttacacaagcaatctgccatcatgatctgcatttaggtaattttcttgaaaaaaatgaccgcttgtatctgattgattgggaatatagtgccgtgtcggatccagcattagagatttcgatgctttttagtgcgaatgctcagatactcaacgagcaacaacaagctgagtttcttcgcttgtatctgcaagcaacaaaatttgatgagaaaggttttaaacaaaaaatggcagaatatcattctgccattaatcagttaaatcaattatggtttgcgattctcgaaccataaaaactattttaagaatggattgtgcagtttctcacgtccaattgtggtatgagggccgtgtccagcaacgacaataaaatcatcatccaaatcaaacattttggtacgaatcgtattgagtaacacgtctaaattgcccatataaaggtcagtacgtccaatactgtctttaaataacacatcaccactaaaagcgattttattttcaaaatcaaaaaaaccgatatgtcccggtgcatgccctggcaaatgacgaacgctaaaacgtaacgaacctacttcaactacatcattttcatttaaccaataatccggtaaaaatgctttaaccggcggaagaccaaacatttcacacatttgaggcaactgctcaaatagcggcttatcatcaatatgagaaccatatacttccacaccaaaatgatctctgactttttcaaccgccataatatgatctaaatgaccatgggtgagtaataactttcgtacttttagattttgtgattcaacaaactgaatgattttatctgcactatcgccagcatcaataatagcggcatttttattatcatcccaaataatactgcagttttgctgaaaggcacttaccgggataatttgtaaattaaacataaaattcgaccgcttacttaaccacgccacgtacgaacaggaccggtatctacatgaacaaaattactgcgaggataataacctacaccaccattatgcaaactttctgctgctgctcttactttagcgagcggaacacctgatactcgaaaatccaccgcttggccacgaatatggtagctattacttgccacaccacgttgtgttcgatgcattcttgcgtttgttttcgccgaacgatagccacttaatacttgaatttctgcgttacggaaacctaaacgttgctgaatttgatttaatttcacgaataacattgggtcaatgcgtttaatttggtttgtgtgtcggtcacgcattaagtgatttaattgatgtaaatccgctacagacaaatgcccaccatgaaatttggcagcataagtatcaccggtattaatatttcggaagcgtaacgctaacggagcaggtgtcgaaagtgctgccatcactttacctggcaataaacttgcccctaaaacaagaccaccgagtgacaaccacttacggcgttgaacattagtttgattcattgaactgtcctcattatcacaagtaatgattgatagtagattactccattcgaataatttactatcagccataaataaaggcttattattcataagcccttttggctcactctaaaaaataaagttccgagaagcaagccttacttctcggaaatttttatatttgtgaattagatcacacttttaactttgctccaattcaccgcattcttcggaatagaggtatcaaatttatagatatcaggtaatgtatataccttaccgttctctacccatgccgtaacatagtataaatagaccggattatccgaacgaatattcgcagaggtggttttctggcttgctaatactttttgttttctgtccatactccaaccagcttctttcaataagatgcttgcaagatcatcagaacgttcaacacgcacacaaccagaacttaatgctcgatccgttttgccaaataaaccacgattcggggtatcgtgtagataaatcgcatccgaacttggcatattaaatttaaaacggcctaatgcactatcatcccctgctttttggcgaatacggtaaggaatattcttactattcacatattgcgaccaattcacgctgcgaggattaattttattaccttttccgtcaaaaatttcatagccggcagaatccgcaaatcccggatttctcgctagcttcggaataatatctttagtcaaaattgtcggtggaatattccaaggcggattaaccacaacattgcttagcttgctatacatcaccggtgtacggcggtcatcacgaccaacaatcaccttagattgtagcgctaactgaccatcacggaagtaaaatagttggtaacttggaatatttacgaagataccgttattaaaacttgggataatacgtaaacgctgtgcatttaaagcgagtttataaaacgtatcattacctgttgttgctgtcgcttcaggtgtttttgctttcttggctttagttgcctttttcacattacctgatgctgacatcgataatacacgttgtgcagtttcttgataaatgtggtttcgaggcactaaattagcaataaattgacctgaacgcccttcttgaacagcattgacccattgattaaccagctcagcactcggtgctttcggcgtgtaactgcctaggttatatagccactggttcgcatttttaaaaacgtttttgttatagtacagataatctaaaaaactatccgttaataacatatctcgagccggaccttccggttgatttagtatctgttgtaacgctcttgctgatttagctgatacaccgcttacagccaacaaagcatattctttgataaattgcttttctgccgctttatcattccacatattcgcaaaagcattatctaaataaactttagccgttgttttacttaacagtaatgtattagctcctactgtttgctgtacttttgcttctgcttccgctagctttctagcttcttcttggcgaatttgttcttgctcaaatacataatccgcacgttttgctaattctgcagcacgagcctgctgagccgcaaaacttaattgaggtaaaatcgcatcttgcgcaataggcgctgcagcaacatttgattgccctaccgagacaaccgtggctgattgctcagacacacctgttgcaaccggagcagtttccgccatagccatgctagaaagcattaacgccggcaacaatttaaaggtttgcaccttattcatactaaatccttagaaccgagattgtaaaaattcataaaaagcagaccgcttaactctcgttaagcggcagttgatttaatatattataatcgattttatgacttcttatcaatttctagccaatcgaccatcattttctcagcttctttcaagaagaaatccggcgcttcgtaatctttaggtaacgcatcaagatcttttaacggctttttaccttctcgtgcaaaacgagcatttagatcttttaagcgtttcgcttcatccgatttattttctttttgacgttccgctaagttaagagatgtaaatttacgtgcatctctttctttacgaatagcaatgtcctcattcaaagtaacgaattcaggatccttcgcaatacgtgcttcatgcttagcggttaaagtagaaaccgcatcgcgtgcatgccctgccgcctgataagttgctgcaggaatcttatcccatggtaatgcgttatcttcaaagctttcaccagttttttccgcattaatcacttctgggaatttgatatctgcttcaacaccttttagctgggtgcttccaccatcaatacgatagaatttctgaatcgtatattgaataaagcctagcggttcttgatctaagtcgtacacgaagtttaacgaacgactttgttgaaccgttcctttaccaaaggtttgttgtccgacaataattgcacgattgtaatcttgcattgccgccgcaaaaatctcagatgctgaagcactatgacggttaatcattaccataattttaccgtcataaagcgatttatccgcttccggatcttcatggactttgattcggttgaaagcatcacgaacttgaacaactggaccatctttaatgaataatcctgtcaactccactacttccgttaatgaaccaccaccattttcacgtaaatcgataatcaaaccgtcagcttttttggttttcatatcatctaataatttacgtacatcattggttaatccaatatagaatgtcgaaattttgataaccgcaatgtttttacctgcaattttctcaacagttaacttcgctgcactatcttctagacgcactttatcacgagttaaagtaataattttcgttttcccgcctttttccggctcaatttctaaacgaaccttactgccttttttacctttaattttgtcaacaacgtcatctaaacgccagccgataacatcttcaatctcgcctttttcctgccccacgccgacaattttgtctcctacggcaatcttcttgctgcgagctgccggtgctcccggcactagcgatttaattgaagtaacatcatcttccattgcaagtgtcgcaccgataccttctaacgaaagattcatgctttcttggaatgctttcgctgcacgaggtgataaataactggtatgcggatcaatttcacgcgcaaatgcatttaaatacgtttgtaaaatatcatctgcttttacttgcgtaagacgtttaatcgctaagttataacgtttagttaaagtctttttaatttccggccattttttatctttaagatacaaactgataatatcgttcttaacacgctgctcccataatttattcgcgtcttccgtagtagttgggaaaggtgctttatcacgctcattttcaatttgatcagcggcttttaaatccggctctttgtctaaaagtgaaagggcatatttatagcgctcatagcgacgctttgtcataagatcatagatttcaaatgccgaatccaatttaccttcatacaattcttcatcgagctttgttgcgtatttggcacgcattgcatcgatttccgattgtaaaaaagtattgtgcgagccatctaaccaatcgatataacgattaaaaatcttgtttgcaaactcatcatctaatttaaatttatgataatgagactgagttaaacgtgcggtaactcgtttagtagaaagactatgttgctctgttggtttaggggtaactaatgcactttctttaatctgtggttcaactgcaaaagcagtgctaatcatggaaccaagacaaactgcaatgagtcggctaagtttattaattttcataaaaatcctaattcattatgagatatgcccaagtaaatgggataagcgatgtttgcaaatctcattgcttatcccgattacttaaagactagaattatttattacctttactaaatttattcgttaatgcagcaaggctttctgctgttgctttcgcagaaacttctttagaaatacgtggcgctttttttacacgcacatccacacgttttttcattttttcttcacgtgcttttttcttaaagaactctttgcgttgttctttacgttgttcttttctttgctcagctttacgagcggcgtatgcttcttttgcaaccgctaatgattgtgctgcatgttcagcttgcgcttcatcaacgataccggcatcttcaccttgtaaaccgacacgttgagcattcgcagtacaagcaccaagataacgccagctcatcgtataagtacgtaatgcttgacgtaataatgttttactgaccttttcatcatctaccagagcttcggctaaatcttggaaaagaccgacttttaatggcttagcatctccttcaatactaaaacaaagtgggaatttgtccgctaaatatgcgattacttctttcacacttgggtttgttttgttgccattctgtgtttttacttgttgttctgacataatgttttctctgttaaaatttaagtctagataaatgtttagcttaattatgaagcctcaactcgttactatattttatttagggaggctagtctatataaaatcaaaatctttccaccacgagtttatgttagacaagaatattccttcaggtttcgtaaataatttaaaaaaacatttgctttaatgattaattggtgttctaatcgacttgctctcgtagcgttattagttcgattctttctatgttgttttcctttctataaatcatttcgattttccgagagttcttcaccgataaatctctaatctccaaataaacgtgtagcaattctttttattaaatttctataaggaaaatcctatgtctaaagcaacaggtatcgttaaatggttcaattcaactaaaggtttcggtttcattactccggatcaaggcggtaaagatattttcgttcacttctctggtatcgttggttcaaacttccgtaccttagaagaaggtgcaaaagttgaatttgaagtacaagattctgatcgtggcccatcagcggtaaacgtgaaagcactttaatcttaagatgcttattaaaattttaaagccagcacttgctggcttttttcttatacctcactaggttcatacgacaacggatacaaatccaatttatccattaacaagcggtcagaatcttcttccggattgcaagtcgttaacaacttctcaccatagaaaatcgaattggcgcccgccataaaacacaatgtttgcatcgcttccggcatggctgttctacctgcagataatcgtacatagcttttcggcatagtaatacgagcaaccgcaattgttctaacaaattcagtccaatccagatcttcggcattttccaatggtgtaccttcaactttaattaattgattaattggtacactttccggttgcggatcgagattcgctaaacttgcgataagcccagcacgctccggacgagtctcattcattccgacaattccaccgcaacacacttttaatcccgcattacgcacttttccaagtgtatccatccgatcatcatgattacgtgtatgcacaattttgctataacgctccggatcggtatctaaattgtgattgtaataatctaatccggcttgcttcaaatcttccgccataccttcttcaagtaaaccgaaagtgccgcaagtttctaggcctaatgccttaaccgcactaataatattggacacaactttaatgtctttcggcctcggtcctcgccaagctgcgcccatacaaaaacggcttgcacctcgtgctttcgcaatttttgccttctcgacaatttcttctatatccatcatcacttgcttttcaagtccggtatcatagcgagcagactgaggacaatattcacattcctccggacaaccgcctgtttttatcgaaagtaacgtagataattgaatcgcttgcggatcaaaattttctctatgcacttgtgcagccttaaacaccaattccataaaaggcatagcaaataattcttcaacttggcatttacgccaatattgcaccgttggatgtggtgttaattcattttttgctttaagacgtaaattataagttgtcataagctccgttctccttcgttataaaaaagcggtcaattttcctgtattttttgcaaattattaggaaaatgtgaccgcttacgtaagccataatctcgttatttaaccactttcttggtttttactgattttttcgctttagcttctgctttattttcatcttctgccattgtttttacacaaagatgaagaatttgctcaacgccattttgaatatattcatcactgcgaacgctatttttttgaatatccatcattgcatcatgaataccttggctcatgcttggcgtttgaaccaaattccaacattccggatctaaatggttaaaattaccttgtaaatcagcagcatataatacaccactataataagcatagatattgtgatccatcattcgatttaaaatcattgctcgaatttgttcaaccggcatttttacttttttgctgtaccagtcattaaccccattcataaatgaatcaatatcgtaactttcatttactcgatcagcgtaagtttgtgcagtcgcaccataagcaatcgcataagatttctgatcaatttcagaatcacttaaacgtgtccatccgctttttgtagaacacgcagctaatacggctaaggttaaaccaaccaacatagttttaatgatgtttttcatatcgcactccttatcgctttataaaatttattatctattttaacgaataaatggcaaaattacctaaatttttttaagaggtaatcatgaaacagtatttagatttatgtcatcgtatcgtaaacgaagggaaatgggtagagaatgagcgtactggtaagcgttgtttaaccgttatcaatgcggatttaacttatgatgttgctaatggtgaatttccgttagtcactacacgccgcagcttttggaaagcagctattgctgaattactcggctatattcgaggctacgataatgcggcggatttccgtaatctaggtacaaaatcatgggacgcaaatgccaatcaaaatacggcatggctagcaaatccataccgtaaaggtgaagatgatatgggattggtttatggtgcggtcggtcgtaactttcctaagcctgatggcggttcaattgatttactgcgtcaaattgtcaatgacctaaaaaaaggcgtggataatcgaggtgaaatttataccttttatcatccgggtgtatttcatatgggctgtttacgtccgtgcttatatagccatcatttctcacttttagacggtacactttatctcaacagtactcagcgttctgccgatgtgccgttaggtttaaactggaatatgattcaatgttacacattcttagctttaatggcgcaaattaccgggcacaaagccggacaagcattccataaaattgtcaatgcgcatatttatgaagaccagctagaattaatgcgtgatgtacaattgaaaagagagccgctaggcgcacccaaactttggataaatccggaaattaagtcattggaagatttagaaacatgggtaacgcttgatgatttcaaagtagaaggctatgaatatcatccaagtattcaatatccatttgccgtctaaaaaatagtaataaaaaagcctagctctttcagagtctaggctttttttgtagaaatcttaaaaagaattatttcactaaatcttttaatgctttacctgcaacgaacgctggtactttagcagctgcgattttgatctcttcaccagtacgtgggttacgaccagtacgtgcattacgctcatttactttaaacgtaccgaagccgattaattgaactgcatcaccttttttgaggctttcagagattgcttctaaagtagcttctaatgctgctttagcatcttttttgcttaactctgcacctgctgcgattgcatcgattaactcagttttgttcataattgtatcctctaagattttatttagataaatggcgttgacccgcctgaaacttgttgcataacgccccgctagcttaattcaaactgagatattctcaaagtgaataatgcatcattctatggggaagttgatttattgattaaattttaacccaatattactaattccgctactacgaatctcattttttaactcaagaatgagttcaatatcacgttcttcacactcattaagcaaacgataaacctgccactgtacatcaagttcgtcttgaatttcttccgcatttttgagttcttgttcatttaactctcggtcttgctgcatttctaaatagcttgccaccgtgcctaatgaaatttggctgatacgaatcgcttgttctaaagtcgaaccggcaattaaactatgcaataattcagaaagcgcttcacacgcctcttgtgcgggtaggacaccaaaaaagtcataatcgttcacatccggaataatttcttctaatttctccagctgattatcaaaattaatttttgcacctttaaccgttaaaaactcccaaactaagttcagaatattttgaaataccttggctttttccggctgttcggttacttcacaaaacagctgatagttcggatacattctttcacaaaggcacgccataaatgttaaatgctgccaagattcaaaacgttccatacgtttatgaatagggtttctcattttttcctctttctttaagctaagccaattcccctaaaatacaagcggtcggatttccataattttttgcaaaattttcccgaaatttaaccgcttattaagataaaccggctacgagattacttatggtactgctttgaatactcgtgaaccgcatcaacaaagatctttggactttgttcaggtacatcttgatggatgccgtgtcctaaattaaatacgtgtcctgatccttgaccgaaaccagctaagatctgtttcacttcctgctcaatacgttccggctgcgcatacaatacgctcggatccatattaccctgtagtgcaactttgtgtccgacacgacgacgagcatccgcaatatcaatcgtccagtctaagcctaccgcatcacaaccggtttccgcaatcgcttccaaccataaaccgccacctttggtaaataaggtgaccggtacttttctaccgtcattttcacgaattaaaccgtccacaattttatgcatataacgtagcgagaactctttatattcgttatgcgccaatacaccgccccaagtatcgaaaaccatcactgcttgcgcgccggctttgatttgtgcgtttaaatataagatcacgctatcggctaatttatccaataatgcgtgtaaaatttgcggatccgcatacatcatttttttgattttggtgaatgccttgcttgagccgccttccaccatataagtagctaatgtccatgggctaccggagaaaccgattaatggcacttcgccttttaattcacggcgaatcgtacgcactgcattcatgacatattgcaattcaccttccggatccggaatcggtaagttttctacctgtgctttattttcaattggacgagcaaatttaggaccttctcccgcgccgaaactcaaacctaagcccattgcgtccgggatagttaaaatatcagagaataaaatcgccgcatccaacgcataacgacgtaacggctgtaaagtcacttcacaggctaaatccgcattacggcataaatacataaaatcaccggcttctgcacgtgtcgctttatattccggtagataacgccctgcttgacgcatcatccacaccggagtcatatccacaggttcgcgtaatagtgcttttaaatagcgatcattttttaattggctcataatattccttgtgtaatctgttcttctatacaaataagcggttaaatttcacgaaaaatttgcaaaattttgccacaatgtcaccgcttgtatataactcattgggattagtgaagttgaggcttttccgttgtttttacgtttaatgcaaaatggctatgcaagaaaagcgtcaacacacgaagatattcaacaacctcttctcccgcttctagcaattcattattatcatcgtcttcattgtaacctaatttagaaatttcttctaaatcatctaaagcttcgccgatttcatccgtttcacggcttaatttaggttgtgctaatcctaagcccaataaaaattggcttgtccagtcggcaatcgcatctgctaaagcgaaaccatcttcattattcggagtccaaagcgaaaataatgtattagcctcatcaaaactttcggtcaattgctgataaaaatcagttaacgctgctaaaggcgcttgagaaaaggcatgaccatcatttaaaaattggtaagttaaggttttccaagattcatcttgtacaccgcctgcaattaacccacttagaaaaccgtgtacttctggcgctgtctcagcgatttgaagttgtgcgattaattgattaaattcatttgattgtgtaatagccatagtgtcttatttgtgattctgttaaagaatggcataatagcaaaaaatttatattacttgtgaggatttcacgactatgtcggcaaattatattgaagttcaaatttttgggcaggtacttcgtttacattgcccaccggatcaacaacacaatttacttgcttccgcgcaacgtttggaagagcgtgtagcactcttaaaagaacaatccggcattattcaacttgaaaaagttttagcgatcgttgccttaaacctaaattatgaacttgaacaagaaaagcaaaaaaatgcgaataataaaacggtattagaatcttgtattcagcaactcgacagctcattgaataaattactaacgaatgcatcggttgcaattaatcaagaaaatgtttaaaagctgatcgtttgcaagtttttctaaattcaagactaggaaaaattctcaatttccgttagtataactcttgcctggggtgtgcgtgactggttacgtccctgagccgataattgaaaactttgagttggacatctaattgctggtgagcaggcttaccttgagtaagaagcctaaaggtaattaagttcgactcccttgaaccgtctggttcaaggaccaccaccggtgacggcacttcgggttctttcatttctctgtttggtatttcaatatgcaaacaagtcaatctcggcgagatactcgtcaactcatacgaaatcaaatgcgagccaaacggcttgaacttagcacatctcaacagattacagcctcattaaatcttatccctcaggcgctttctttgattgatcattatcaagcctctcatcttgctttctatttgccgtttaaagcagaaatttcaccgctaccgctaatgcaacgcatcgctgaacaaggtaaatcgatttatctgccggtattacatccttttagtcccggtaatctactttttctgcaataccatccgtcttctcaacttgaacgccatgcattcggtatgcagcagcctaaacttgatattcgtcagctaaagccacttgaagaattggagatgatctttactccgcttctcgcttgcgatagccagctaaatcgcttaggctatggaggcggtttttatgatcgaactctcgctcaaactcaagccattagtgtcggattagcttatcgttgtcagttaatcgaacaacttcctgtcgagccttgggatatgccgctcaatcatctgatattaggagacacagaatgacagaaaaagaatcatcaggaagccaaacgctggtaagagggttaaaactacttgagttactttctcaatatccgaacggctgcccgctcgctcagctttccgaacttgcccaattaaataaaagtaccgtgcatcgtttattacaaagcttacaacaagaaggcttcgttcgtcctgcgcccactaccggcagctatcgccttaccacaaaatgtcttgccatcggtcagcgtgcattaagttcattgaacattctgcacattgccgcacctcaccttgaagcacttaatctcgaattgggtgaaacagttaattttgcgatgcgtgaaggcaatcatgcgattttgatctataaactcgaaccgaccaccggtatgatgaaaaccagagcttatatcgggcaacgattacaattgtactgctcaggtatgggtaagttattcttagcctatgataaagctgaatacatcccacaatattggcaacaaaagcatgacattattcgccaacttaccgcaaataccattaccacaattccggaaatggaagccgaattagccaagatccgcctgcaacaatttgcaatggatgatgaagaaaatgaattaggcgtatcttgtatcgcttgtcctatttttgacaatcaaggaaaagtaaattatgcggtttccatctccttatcaaccgctcgtttgagccaacttggtttcgatgttctctatcctgctcttcgcactactgcacaaaaaatttcagaagagctaggctggcaaggggaataagcggtcagatcttcaacgaattttgcaaaaattccacgaagatctgattttatattcaggtgttttttctatccacaatctctgtggataactttgtggatttctttttgaaaaacaagctaaccctagataaaacctagcctctatcactttcactcaaaattgagcacaaaataacatttcttttaaaatcaataagttaaattttgactagtctttttaataaaaattttttaaaaaatttcttgtaaatctgcttgacaaatatcacctgtgtacaactgctaatttcattgtaaaaaatcagacaaaaagcacactaaattcgttaaaaaaacgatcattttttacgattaaatgtaaaaaaattgttgcaaacgtttgcaaattagttatagtcgaattgtataggttatcaacaaacaacaataattttatttatctcgatataagccgcatagaaatgcgtaaaatagcgataaaaattcattttaccgatattttttgctataatttgccctttttgtgctaatgaaaacatagaaagaataagaggaataactatgtttggatttgatcctaccacgaccacattcctgatttatatccttggaatgatcttaatcggctttattgcctatcgtgttactaataacctttcggactacatcttaggtggtcgtcgtttaggtagctttgtgacggcattatctgccggagcgtccgatatgtcaggctggcttttgatgggcttaccgggtgcgatttatgcaggcggtttaattgaaggctggttagcgatcggcttaaccattggcgcttacttaaactggaaattagttgcaggtcgtttacgttctcatacagaacacagtggcgatgcgctcaccttacccgaatactttcataatcgttttggtgataaaaccaaactgatcaaaatcctatctgcggttattttcttactcttttttgcggtttactgtgcttcaggcgtagtagccggcgcgcgagtttttgaaaatctgttcggtgtaccttatgcagatgctatttggtacggtgcgattgctacgattctctacacttttatcggcggtttcttagcggtaagttggacagatacgattcaagcttcattgatgttatttgcactgatcttaacgcctgttttcgttatcttaaacgtaggcggcattgaggcgatgcaagaaagcattgcgcttgccgaagttgctgccaataaaaattacaatgatatgtttaccggcacaaccgtcctcggcgtattaagcttattagcatggggcttaggttatttcggtcaaccgcacattgtcgtgcgctttatggcggcggaaagtgtcaaatctcttgagaatgcacgccgcatcagtatgacttggatggtaatctgccttgccggtgctatcggtatcggttatttcggtatggcatacttctttaaattcccggaaaatgcccaagtcgttaaccaaaataatgaacaaatctttattgaactggcaaaattattattcaatccttggattgccggtattttattatcagcgatcttagcggcagtaatgagtacgctttcagcacaacttttaatttgctcgagtgcaattaccgaagacttatataaaggtattattcgcccgtctgcaacggataaagaattagtctggcttggccgagtaatggtgcttgccgtagcggcgcttgccatttatattgcacaagatccgaatagccaagtatttgctttagtaaaagatgcttgggcgggtttcggttcggcatttggccctgtcgtattactgtcactcttctggaaacgtatgaacggctttggtgcgattgccggtatgttaactggggcattaatcgtttatttctggaaagatttaactgttgcgctttcactacctgaaatgtactcaatgattccgggctttatcagcgcaatgtttgctatcgtgataatctcacttatcacgccggcaccaagtaaagacgttatcgagactttcgaacgagccgataagtcttatttagacgaagtaaaataaaaacaaaagcgatttgctgtttaacagtaaatcgcttttttgtttggcgttatgtaaaaaatatgacaaaaacgaccgcttgttaacaagcaaacacaacataccgaggagcccattatgcaacaatatcatcttctccctagcacttcgattcgccctactcttagtcaacactatcgcattgatgagactgaacttgtgcagcagcttttaactgaagcaagaacggatgagcatcaaccgaatattaaagcgctaacccgtcagcttgtcgaaaaggtgcgagctaatcgccaaaaagccagtggtgtcgatgcgttgatgcacgagttttcgctttcaagccaagaaggcatcgctttaatgtgtttagctgaagctctactgcgtattcccgatcaagcgacccaagacaaactgattaaagataaaatcgcaaaaggtgattggaagtcgcatataggcaaaagcccgtctctgtttgtgaatgcttccgcttgggggctagtgtttaccggtaaagtgcttttgctgtctgaaacttcactttcccaaacgcttattcaactcatcaataaaggcggagagccgattatccgccaaggaatggattttgcaatgcgcttgctcggcaaacaattcgttaccggtgaaaccattcaaattgcccttaaaaatagcgaatctcgttttaacaaaggcttccgctttacctacgatatgcttggagagtcggcatttaccgaagaagatgccaaacgctactatcaagattatgtttcttccgtgcatgcggtcggtgcagtatcaaaaggacttggcgtttatcagtcatccggtatatcggtaaaactctccgctattcaccctcgctactcgctggcacaacacgatcgcgttgtcacagaactctatcctcgtttacgtgatttatgtttactcgccaaacgctatgatatcggcatcaatattgatgctgaagaagctgatcgcttagaaatctcactcgaccttatcgaccgtttattagatgagccggcacttgcaggatttgatggtattggctttgtcgtgcaagcctaccaaaaacgctgtttatctgtgattgactatctcattgaaaaagctcgagaaaaacaacgtaagctaatgattcgtttagtgaaaggtgcatattgggatgctgaaatcaaacgagcgcaagcagactgtgccagcggttatccggttttctcacgtaaagtgcataccgatttaaattacattgcctgtgctaaaaaattactcggcgcccaagatgtgatctatccacaattcgccacccacaacgcacaaacgctcgccactatttatcatcttgccaaaggtaaaaaatttgaatttcaatgcttacacggtatgggagaaaccttatacgaccaagtggtcggcaaagaaaaccttgatattcaatgccgtgtttatgcgccggttggttcttaccaaaccttattagcctatttggttcgccgtttattagaaaacggttcaaacagttcatttgtcaatcaattggttgacgagcgagtatcggtcgaaagcttaaccgaagatccggtgctgaaagcggaaaaaaccgcaggctcaatgcacccgaaaattccattacctcgccacttatttaacgatcgtattaattcgcaaggttacgatctcagcgatgcggtgcagcttgaacgcctccaaacacagctcaatcagctggcaaaagtgcaatacaaagcttatccgttactagccgacagctactatgaaggtagtaccgccaaaccgattttcaatccggcattgaatacccaacaagtcggtgaagtcattttcgctcactcgtcagatgtcgaaaaagcttttgccattgccgaacaaaatcagaccgcttggcaagcgactccgccagcgcaaagggcatcaattctcgaaaagttcgctgatttactagaaagcaatatgccgactttattcgatcttgcaattcgagaagcaggtaaaacactgaataatgcgattgcggaagtcagagaagcggtcgatttttgccgttattatgcaaatgaagtgaagcgcaatccgcaggcttaccaaaatccaagaggaattatcgttgcgattagcccgtggaacttcccattggcgatttttaccggtgaagtcgtttccgctttagttgccggtaatgtggtgttggctaagccggcggaacaaacttccttaatggctcattatgcggtggaattatgctatcaagcaggtattccaaaaggtgttttgcaatgtttaccgggtagcggagcggaaatcggtaatcaactgacttccgatcctagagtggacggcgtaatttttaccggctcgaccgaaactgccaaaaccatcaaccgcaatttgcaaaaacaaaccaaaatcgtaccgcttattgcggaaaccggcggacaaaacgccttgattatggatagctccgcgctcggcgaacaagtggtggcggatgtacttaactcggcgtttgattcggctgggcaacgttgttcggcacttcgtgtactttatctgcaagaagatgtagctgatcacattctcacgatgcttaaaggtgcaatggcagagttgcgtgtcggcaaaccgcaattactgaataccgatattggcccggtgatcgatcgcacggcacaaagtcgcttactagcgcatattgaaaaaatgaaagcggtggcaaaatcgtactatcaagtgccgattgcagcggaggtggaacagagcggaattttcgtaccgccaaccttacttgaaatcgatcacatttcacaaatcgaacatgaagtgtttggcccagtactacacgtgattcgctttagtgccacccaattcgaacaaattattgatgacattaactcaaccggcttcggcttaaccagcggtttacatagccgtattgataccaccattaatcaatggctcaacaaagtacatgctggtaacttatatgttaatcgtaatacggttggtgcggtggtcggcgtgcaaccgttcggcggcatggggctttccggtacaggaccaaaagccggcgggccgctttatttacaacgtttggtaaaaagcgaggcttggacgcttactgatttagaaggcgaaacgcttatagaaacggataaacttgcacaagctattcgccaaacacttagcaacgagcaacaaagtgaagcattaacactcttgcaaactttatgcaaaaaatcaccgcttgcaaaagtgtttaaaatgcaaggcattaccggcgaaaataactatttacgctttgaagctcgtccaatgattgcagtaagtaatggctcactactcgaacaaatcaaagcaatgattgctattgtggtatgcggcagcaaagctgtggttaaagagggttcgccgttagcggaatacgcacatcaatttgccgaatacttgatgataacagacgacttcaataatctttcggcattaagtgtaatgattgtacttgagcagctttccacgcaagaacgtcaaaattatgccgagcgcaacggtgcgattttaacttatgtggaaagccttgaattggcgctttcattgttaccgctggtacacgaaaaatcgatcagcattaacaccgcagccgccggtggtaatgcaactttgatgagtgaaatggattagcatggcataaatcatgcttaatatttatccccttagcaataaactgaggggatttttattttctgtttagcaagtcattttcttttcagctataatgcgccgactatcccgtgaggtagtgtttacgtatgttaattcaaaccgagagttgaaacaaaaatgacaaatcaaactatcagcacacctaaacaggtgtttgttggcttacaaatgctatttgtggcatttggtgctttagtattaatgccgttaattaccggcttagatcctaatacagccctccttactgccggtatcggtaccctacttttccaactttgtactaaaggtcaagtgcctattttccttgcctcttccttcgcatttattgcaccgattcaatacggcgtacaacaatggggcatcccaaccaccatgggcggtttagtatttaccggtttcgtttacttcgtattaagttcattagtgaaatggaaaggggcaaatatccttgaaaaactgttcccgccggtagtggttgggccggtaattattattatcggtttaggcttagctccgactgcggtggatatagcgttaggcaaaggcacaaccattgagccgaataccgcattactgatttcgatggcaaccctaattacaacacttatcgtggcggtctttgctaaaggtttaatgaaattagtcccgattatgttcggaattgtggttggttatatcctttcgctcgtgttcggcatcattgattttagcccggtaactaatgccgcttggtttagcttaccgaagctcaccacgccggaatttaagttagaagcgattctttacttattacctatcgccctagcaccggcagtcgaacacgtcggcggcattatggcgatcagttcagtaaccggtaaagattttatgaataaaccgggtttacaccgcacattattaggtgatggcgttgcaacctctgccgcagcatttttaggcggcccaccaaatactacttatgcggaagttaccggtgcggttatgctcaccaaaaactttaacccacgtgtaatgacctttgccgctatttgggctattgccatttcattctgcggcaaagtcggcgcattcttacaaaccatcccgggcgtagtgatgggcggcattatgatgttagttttcggctctattgcggcagttggtatgagtaccttaattcgtgccaaagtggatatgggcgaagctcgcaacctctgtatcgtttcagtagtcatgaccttcggcatcggcggtatgttgatcaatgtcggcgaattctcactgaaaggcatcagcctctgcgcaatcgccgcaatcgtgatgaacttacttctcccaaaagaagcggctaaaaaagcagaataatttttaacgttcttcttataaaacaagcggtcaaatttcaccaaaaatttgcaaattgcaaaaaagttaggaaatttgaccgctcgaagtttctacaaaataagataaatacctttgtcaattctgcttatattcaccactttaaaaaggaaaaaaatgattttttctccacttttccggctaacaattctttaacaaactcgggcttttcttcttctgaaatatactcataaaacgaataaatcacctcttcaggtgtatattccttttctcttgcatcacaaaccatttttaaccaataaagcatttctgttggacgccccattgaataaagcatctgtaagtgcttttctaaaaatggctttgctgctttctccaattgctccaccgtaaatttattttcataaaaatgcaggcaatatgcataagcaagcctataaccactcatattcttattcaacttaagcagtttatcacctttcacagactgataaagtttgattgctttttcatattcttgagcttgaatatagtgcaaaagtgataatgcaaagatttctttatcatcacgactcataccctttgaataatcttcgttaccataaagctcttctcgccatttcaaagactttttccataactcaacatcatttactcccgtatttatccaagtagcaaatgccaaagctgagtttaaattattttgatggaatgcaagagaaccaaagcattcattgttatctattccctcagatatccaatctataattctaggtaagaaaggcttatataattttttatatccaacgctatatccgtagactaccatatctagatcatgaattgatgagtttccaataaatttttgatctatagctttttgtttttttataaaagaataattgaatccacttttataataagcgtcttttttcctaattaaagtttccttaaaactcatatattctttccttactcacatttttgattgttgcaatatttttgagttacagaattttttaccttactatatccaactgtatgggttgtaaagttccctatttttaaattctgtatagctttgtctttaacgtgttcagaaataatcttagtatttgaaatttcttctattgcctctctaattgcattattacgagtattttctctagaaaaagttggagattctcttcctttggttaatgatgttcttactttactatcccaaagttcaacctctcctgttttcgtattaacagaaattacatcactaccatttgtacctgttgaattcccccattttattacttgtctatttggagtttcttgaatgctattcgctaaatttatttctccacgataaccattaatatctttccattcttgatacaccgaattaccttttgctttttgtggaacaaaaccataacctgcttttggttcaggaagattagggtgcaattcaatgccattgaaaacaacttttggataattcgccggtacccctgtaaccttagctccatatttagcagatgtcgctcctctgatagagccaacaagttccgcaaaattcttaaagagcattaggttttcaactttagattttgccgcttctaacggaatattttctgcttttgcaatacctaaagctactttctctatataccgaatccgcatcttttcctcgtaaaatttgctctacattggcaaaatcattaggaaaaatatcttttaactgtcctcggtaagaaaaatattcttcataaccacgttgagcatattgagcagtcctagctaatgataaacattgctcactacttacttgcttacaagcatctctaatttcttgattgcgtttctcatcaattcgattaatttcctctaaacgagctaagtcatcttttgtagctgtaccttctacttttttacgttgtaaaaccattttttctttggcttcattaataaataaatagttattctccaccgccctttttgccgtttctatcccttgtaaggttgctgccgtattaccgcccaccgcattaccaactaaagcacccgataattgacctgcaacactcagtaactcccgctcttcttcacttaattggcttgcttctttgttaaaaaccacttccgataataacatcgcactcgcttcgcccgccatgcctgatgccgctcccgctagcgcattattacccgaaatgcccgcctccaatgccgaaagcgctgcatgagctaataagttggctgtcttattatccgaggtatatttgtgaatctgtgcatttaactccggagatattgccgtcgccgctacttctcccgcactaccgcctgataatatcgcacccagcgtcaccgcgaccgtatctaacttacgttttgaagcccctctttctcgccagctttcttctttcgctttcgcttcagtgtaaactcgttccttttgtgatatgtcttcttctgaagctcctgtgcgtctcgctttagccaacgccttctccgccgcattcacttcttcctctgccgctttctgcttccgttcggaatagctatctactgcaccacgccggcgctcgactcctgtgagagcccaaagaaaacacaaaaacaagcggtcaaatttcactaaaaatttgcaaattgcaaaaaattttagaaatttggtcacttgtatttgctataagaattaagccaaagcagcctctttccaaatagataaagataaaagagtatttaaaatatagtctttatgatacataaaagaagatattacttcatcttccacaacgactataaaatcattatcttcactcgaaaaaaaaaaaaaaaaaaaaaaaaaaaaaaaaaaaaaaaaaaataacaaaatagattattatcctccatctctgcagcgcttatttttattccacattcatcatcaaatatattagctattacctcctctaatgaggttatatttttcattgatgacaatatatcactcgtaaaattagccaatgtaaattttagttctgaaacaaataattctttatggattttttaccttgaatatatatatcatatattccattataccaaaaggagtcatcattccattcttcaactatatcacaatgaattgcaaacttatcaggattaccaaaaatcattattacctcctatttaaactctagatctttagggacttttaaagggttatttttgtccccactacttcccgaccaatgatactcatcattagtaccaaaaaatctatgaatatttccatctgagtcttttgcataacgtgtaatcttatttgcatcaactttatattcgatagaatttctaaaaagttctaatgaatttctaggctctatctcaacatttggatatagaattgcaagacatctatcctttttattcgacttatttgagaaatcaaattgtcatgttctactaaatgaaagccaaacacatccaatatatcttataatctaagattcaaacttttacctaagacaggagatatcaatcttatctaaaatattcttctctcttcccattattaccaattcaaatgttggaaatccatcctcactcaagaaaaagcatacaaactctccatttcctaatctattgttaatccagtcattataatcattagtcttttcattatgattgtcatataaatctgtagaacaatataaaatatcacaattcataattaagtcatttaataagcttttttctgaaataaacacatctccatccaataagaaactcaatttatttccactctcttttttaacctcatttttatcctttattagatcaatatcaacaccataaccttttaatatcccccacccacctttatagttgataatcttattatttggctgatcatttaaataagtcattaccttaacattattatttcctcccaataaaagaaatttatcaaaaataaaacgcaataactcatatttactcattgtatctttagatatctcgatactctttgctaaaacaccttctgccggaaaaaaaatacatacttttaaaatctgcaatatcattattcttagaaatatcctgcgcttttctaattacaatattagtagtcataatggtttcctaatttcgtatctttcttcagtgattaggctttacttaaaatatcatttctttattttaggttgacaatcaaattcatctaaaaaaatatcttctttaaaaaacaatctcgccaatacatatttaaatctctcatacctagcataaatatctaaatcattaatctcaaaacgcccccaattagacaccatcattaactcaataatcctcataactcctattaatatatcttgctctagctctcctttttcactatacattctagctatattcaataaggatttttctaatttaaaatattcaaaatcattccattcggaataatccagccatcttccaatgaaagaattaccatcatattctttaaaaaaagtaatatttcgataaaaatcatttaaatcatccatttattaatccccccaacagcactcgcctcttgcctagatcccaaagaaaatacaaaaacaagcggtcaaatttcgctaaaaacttgcaaattgcaaaagattttggaaacttgaccgcctaagttttgttatttcctcttataaaagatctatattcactctctagggaatattaatatatatcatgctattctgacaaaaatttattaacacctaatattatttttttaaactcactagtttttaatatagaaacatccacatgccaatatccctcatcaaagaattgtaagttttttttcaatgtcatatctttattaaaaaaacgagataactcccctaattcatctatattcatagttttattaactaaaacaatctttgtaaaaccattaaaattaactataaatggatacactcctttgccaaaatattcaaaatcatcaatatcccataaattatttctagtttctaacaatctttcattcgatacaatatcatcgatataatcaaacaaaattgattcatcattttttatcaattcatagtcaataatccctttttctattgctttctctataccaaaaagcgataaaaaactttgtttaattaactcaatcattaattctcgatcaggtaaattataaagaaactcatcttctcgattaaaaatatcattattccagtcaaccccccccaataaacatgaattcatattataagctaggtaagatggatataacttcatatctaaaataagatttaatgatgaaaattctccaactaatttatcaacttgtattgcaaaattactaaaattaccctcttcatcatagactcctggattcccaaatatcatttttttctaacctctttctctgttgtacctaatttttttaaaatatcattactaatattttttgtatctaaaatttgtgatgccggttgatcccttcctgtccgtccagcccaatgccattctgtcccctctttattagaattaaattgatgaatgtttccttgagaatcaattgaatagcgttttttcccatctactacagaatttctaaaaagttctaatgaatttctaggctctatccctgcatttggtctatttcctggcatacctttagtgtgtttcgcattagatttatatgtaacttctttatctgctatctgtactttttctggatttggatatggaattgcagaacctctatccactttattcgacttcttcgcaaaatcaacttgagtcggcttatgtcctaatcgttccttgccaacaatctgtgccgcatttacaccaaattcaagtgcattttccgcaaaactatgtctcgcttttaatgcatttattgacttcgtattttcctcttccaccaacgttaaaaagcgagaacgctcttctgtcgataaacctgacatccacccccaaattaaacctgaataatctgccgcaagttccgttgcattccctagcattccttcaaccggcaaacggcaactttcaccacaatcactcaaaagcgcttctctttgggcttgacttaactgacgataatgtttatagactgcctcaacatcttccccattttctatcgccttacgaatatctctatataatgctgcaacatcttttgatgataaagcattattctccaccgcattcttcgctacctctacacctgtgctcactgcatttagtgtttctacacttgaaccaccattcactgctcctgatgctaaaccggctaaggctttgctgagcgctaatacctcctctttttcttccgtcgtcagttcatgcggctctttttcataaagcccctgcgtaagtactcttgcgcctatctctgcagcgcctgccgcaacggctcctgtactcgcttttccgccagccagctccgcttctattgctccccataatacatgggctgcaatatttgccgattcactctgctctgtcagctgttttatcgctctattcacatacggagacgctgctcccgctactaccgcttctgttggtttacctgcgatagctaaactgattgccgtagtaaccgcatcaactttgcgtttatactctcccgaagtttgccatttctctgcttcttctttcttctgaattgcttcagctacttttccagctttctcaagctcctctgcctcttgatttagttcttttgctttactttctgtataagcttgagctgccgcaccaatatcacccactgccgctgaaagtacctgttggtctttcaacttctgtttgatatcaaacgtcgcttcaacctgtttattcgcttggtttaagtctgtgtttagccctagcgcttctgccgtcgtttcggtcggttggctatctttgtttaaggtgattttgccttccgttaacgttgctttggtcacactactatcactttcgctatcatacatcgggactgtcgggttgatagcgttactttgcgttgtccccgtcagtttcgctaagtccgcttgctgtttcgctccttctttgcttgccgcttccgcattacctaatttattcaggttagccgatacactcatgccgcccgttaaggctttgctctcgctttcattctcaatatctttaaaagcaagcgtatttgtgcttaattcactcttattcgggttcgtactcgctatcgcgccgccatttagctgtacgtggtctgcattaacatgataaccgccctcttccgcaaataaacccgattgctctaccacttgcttgctgttcgatttaccactcgaggcattgccgtaaccgcttccgccccatgccgtacccagtgcgacttgcacgcgtccgcctgcacctacactgctgctcttagaatgatgttcatcttgacggctttctaccgttaacactccacccacatccgcattaatggtttttcctttcgctactgcgcctgctaatgtggtatctcccccactttttaacgtgatggtttcactgtctaagtggctattattttgtacgacatgctgttcgtcttgtttacctttcgtaaaaccgccttgtacataaatatacaccccagtttgagctcctaccgctacaccagcccccacttcaacaccactgctttgctgtttacctttttgcttcgctgtgctttggcttgattccacgatgaggtctttatgtgcatctaacgtaattgagctatccgctaagcgattgccttcactgtctcggctaacaaagtccgtctgcttcgcttgaatatctccgcttcttgattttacgctgatatgttgcgcatttaccacattaccttgcgcttctgactgtgcggattccattcgctctcggctatggctatagccggtacccgcttccacgcgcaacaatgctccgcctgccgctgcattggcataagcagaatagccttttgccgcaacgcctaacgcttgtgctgctctgactctatcattcgcatctttattttctatcgcactttctaccgcctgcactaaatcaataatcggcgaacctactcgggcaaatgtccccatttttagatcgcttttatggcttgaacttgtgcctgtattatgtgcaacatcaaaggtgactttttccgcctcgatatctatgcgttttttcgccaaaatttggccgcttgtttggtggaaatcattacctgcttcaatatcaacattaccgtttaagcttgcgatagttgctccgctgtggcttacgctatcatgactctcactacttaattgacgatggtatccgccaaaacgctccgtttctgatacgaccgcttcgccgatatggtgttttttacttgaggtcgattgccccactcgtttttcagcggttgttaataccacatctccacctgcgaaaatgcggttatctccttcgctcactaactgagtaccggctaaacgaacatccccttgcttcgctgttacgctgctattaccaccaaatgataaaacacttgcctgcgcagtaaccgtatcaccttcacccaattctttttcattaaaaatacccgctgctgaagtcacgccttttgagccgtttaattcaatacctttacgggttgaacgattattttgtgaagttgatgaagtggctacatcaagctgaacatctctcttcgcccataatgagccatctcctttcgcagagagctgtgagccttgagaagtaatatcgccctctcttgcagtaatacttaaattaccgccggcatttacatgtccaatgacagctgtttctttttgagtgttcttattcagctcacttttttgcgttttaaaataaggacttcccggattcatcgcttggttcgtcgttttagaaatcgcttccgccgctgttaagatttttccgataatcccagccgctgaaccttgtgacgcttgctcaccaaagttatcttttgccacttgtacagggttatataccgcactcacaccaaagccggtagattttgacttatagctgaattgattattttcatgctctgtcatggcatttaagtgaacgttattaccttcaatagcaatatctcttccggcattcattcttgccgcattgcttgtaacatcaccatgaatagaagatatggttaaattacctgataccgagtttaataccgtagtcgcaatacttgtcgctacatttttatctctcatatcagatttatttttcgaataaccgacagaggcaacacctctacttttcgaagctgaaagcccactgcttttacgaatttctttttcgctttttgtctctgtattttctgcggcacctaatatgatatctttctcagcaaatgcagtaatgtcatttaacgcaataatctctgccgcggttaaatcaaggtgacctttgcgtgagtctaaataaacatctttagcagcaagtacactacctttatgcgatgtcacatctctcgttttttctgtttctaagcttgaagagccaaaagcattgcgctttttatatttatggtattcttcatattcgcctgaacgtaatgctgtaccaagtactaaatcattttcagctaatgcagctaaacgctctttcgcaccgagttctgcgccttcagcagtaagcgtattcgcaactaaagtcacattgccgttacccgatacacggcttaccactacatcttgtactgcttcattacgatagtgattgccgccgcccattttctcatcaaaaccgactgcaaccgtgcctaaatgcatttggtcttttgctttgagataagttaaaccttgaccgtcattaataatatccgagccgttaagggtgatattattcgccgtcacctgtaaggtgccgtttgcatcttttacatgtaataacgctttacgatctagcgtggtttgtttacgtttaaaaccgtctaaatcaatttcagtatctcgggtggttgaagaatgtgtaaaattccctgcaacatcgaggaataatgcactatttgcttccataacaccgccattgttttccgcatcaccggaaactttaccttgcaatataccgccggaaatcttaccgctatttaccaatttatctgctgcgaattttacaaaattacggccggcaatcgtcccttcattaattaatgaagtagaatttacattcattttatcagcagaaatcaatgtacctttaccgctaatatcacctttgcgagcaaccgcatacactttcggcactaaaacttgttctacttgaccatttggtaatgtcacactttcggtctctaaccagacgatatcggaagttagctgagccacctgacttgagcttaatgcaatccccggacgtaagttaaatttttgcgcaaaagttacaccggcatccattaatgctttatattggtcgtcaaaagtttcaaactcacctaagaattgtcttccggtcagcttattgatttgctctctcactaaacgctgttcataaaaaccatcgcccaagcgtttatgcaccgcttcgtgttctgaacgaagggcgttatacatataatcactcgctaaccatctttttcggtcagtaaaatccggatccgtctcaattaagacgtgactatccgcatcagggttaattttatataaactctgatttggtaagcgggtatccgctttcacgctgcggatttctattccgtcttgggaggttggaattgccgaaatagttaattctttaaattttggtgcatcttcttgtaaaggcttaagagccaattcatttccttgagacgagatcccatttgcgtctactgaattaacataaccattgaactcacttggtgtaatatcatttctttcttgccaaattcccatatccttatgagtttcattaatacgcattaatggaccatggctattatctttacgctggaaatagcgtctatgcccccctcgccatactgtataagagaaatggcgattcccttcctcaatatcttgatggatagcatcttcatcatctctattttctaacttaccgctccctacttgctcaatacctttagcaattacccagcttttatcatttaagaatcgttcgctattataggtgattcctccccctgcaagaatctgagcaggcgcagtacgagtggttacattctctttaatatattcctttttaacattaattgcccagaaacgatcatacacatcaccaacaatttctttattatgtgcatcaatcgcttctgtcagtgctttgagtttatcaccatgtttatttgtccattcttgtaatggcttcattaactcatagtcttttttggcttgaacggctttatcataagcctctttttctttgcgataattttctagtttcgtctgaaatacttcttcactctcattagcttgtttggttggttgtactggtaatggtggaattacaggcaaagtttgcatctcttcttgctgatctaatttagcaatttcttcatctgaaagagagcttaacttctcatcattcaattctgagcgttttaaatatgcagccatttccggagtaatttcaggcacatcttctgttggagcctcaataccaaagtatccccaaacggggctatcttttttataaatacccgcagctaatggcttacaattctgattatcgtcacaattaacctgattaggagatgctaatactttacctttgatttgagccgtattcgtaataacttccaaattattcacattatatttgcgcatccatttccatgtacggctaaatccgatccgctgtaattcatcagtactgatatacggcaacttaccgttgttataaggttgatcaactttagttgcctctccctccggtaaaatataattcttatctacctcatttataggaccgacaatttgtaattcggaacgatagtacttattaatattttcaatattcttaatattcagtaccgtatgtcctaccgcttctatcacactactaatatttttgaacgagtctgcttgtccttctgcaagatcttgctcatttaattcactaccaaaaacaatatctccaccactataaatataaccgccaccttttaggttttgatcataagtagccatttcattcgtaatcgttttacttgctaaatccaaacgtttacgagccgcaattgttgcagcttttccattctcatcttgattaagaatattttcagcaccaagcgcaacataatcaccataaatacggccagaacctttattctcgattactttagctttaacgacagtttttgatgtatcgtcttcattaaaactattgattaagcctctattttcaactttgtcatttactgtgatacgagtatgccctgaactaatacgaccgtcagccgcattgtttaaactttgcgccgttaaggttaacttatcattagctgataatttatgattattgaccaaattaccaagcgtctcgatagcaagggtactttttgcattaatattattcttagtattaaaatcatctttctgtttaatacttagatctttagcttctaaatgtccatcttcactgatcgctttagcctcaacagataatctcttttctgcttggatcttaccttctttatttgtcactataagatcagtttgataacctgaaatcgataaccctccccaacttaaaatctcaccagcctgattgtttactgccttagcaatattcagtaagccctcgctttccagataaataccgcctttttcgttttctaaacgatccgaagttagcgtcagtttttgtgcaataataccttgtgtcggtgttttaccttgagcgatagtgccgttattttcaaaaattggtgtattcaccactaatggtgcaccagcttcaattaacgagccgttttccgctactttattattcaagatatgtgatgccgtgatggttccgccctgctgcgtttgaataaaaccaccttggttatcaagtaacgctgtattgataataagttgcgctaaactctgaatttttccatcctgagtatttgtaagctgctgaccattggtattgatctgctgattttccgtagagaaaagcgtaccctgctgattattaatttcagccgaatcaatttgtaatgcttttccggataaaatttgaccttgttggttattcaaagcttgtttctgtgtatctaaaacaaggttatcttgtgctgtataaagcgttccttgcttattatccactccgtaagcggttaaatttagctgattttttgcagaaatcgtgccttgttgattattcagtaaacctgagacatttaaatccacactgctgttttggctggcaatcacgccttgttggttatttaatttttgactattaatcgtttgtgctttattgctaaccaaataacctaattggttattcagtgcttgcgttttgatattcatttccgcattcgaaactaaacgccctttcgtattatcgagttgctccgcttcaacggtaaatttaccttgtgtttttatcgcaccgccttggttatttattgttttggctttgagggcaaaatcttgctcaccggtctgctcccaaaccgcattttttgtgtttaagtcagcttgtgtcgtttgaatatgtgttgcactgacgtggctaccttcagtagataatgttttaggcgtgtttaaacgtagcgtctctttagcgctgagtttggcttggtttgcttgaatatcgcccgttttagcatgaacatcaatttggttggcactggtttggcttttgtttaaatctgctttgtccgccttgatttgtagcgtaccgcttgcaatatttttaccatttaacaccgcttgttggcgtgtgctaatctgaatatccttactattatccgtttgtggcgagagctgacgagcttcaccttgcgccgtctgctgaatctctacgccggcagcaatcagtgacgattcacttgcttccactcgatcggcatcaaaactgatttttcctttcgcaacggtttcaccggtttggcggatatccttcgctgcacgctgttgaatctccccttggcgagccacaattgagccctgttgttggatatcagcttggctagttaaaacgatattgccttgtttggtttccaattttccgtggttttcaatcccttgttttgttttgcacttagctccgcttggttttcaccactcatcaggccttggttaacaatacgtccttgcgaatcaattttgacattttcgctgcttgcaccgatatgaccggcattacgtacacctaagccttgttccgtaccaataaggtgcacttttcctgcatacatcccgcccaattcgctgatatcgagcgcatattgaggaggcgcattggttacagacgtttgagcactttgtttggcagtattgataatttgtaagtcactgtccgaatcggtttccatgcgggctttcaccatatttttaccagtgactgccgtaagctttttcttactccatacgccggcattgatttcggtttctttagcaataatatcggtgtagtccactcggctattatctaagcctttaccggacacttttactttacctttttccaccacaaagctgtctaaattaccttgtttgatttgtggtttgccggtcgtcagagtagctctatccgaattaataataccgcaaccttcgcaatgtaagccgcttgggttggcgataattacatccgcctttttacccgctacttccacataaccttttaacacactcgggtcatttgaattgacttcatttaaaatcactttagcttcgccacgggctaaataagggttgccttgaatcattcccgcttgttgcgtttgagtttgggtgcggctgttgttaagaatcgcccctttagtatccacatcaaatttgctgtatttattatgtgaaagccctttatcatttggggtttgaatattgacttgtggtaagccgttcgccgtttttaatacgatcggttgttcatgttttggcgcacttttatccgcttggataattaattctgccagtgcgttttctgagaagctgacaaagcctaaagcgcaaaataagctaaaggtaagcggtctgattttgcaaaaaattgacgaaattaacccgcttgtcgagctagcagaagcttcgccgcctttgccttcagatttggctaattcagacactaccacaaggcgttgtagagttttactaaaaatgactcggaaagattttttattcatgatgttattcctttaataaattcttgtaatacataatctgcgataagcatcggttaaaaactgtagccgatattaaaaccagtcacatgtttggaggttctaaatccttccggatggcgcattggtctgccgacaaaatagtcgtaataaaaccctttccaaccgcctcgtaagccaattactgtccccattaaatgatgacctaaacgtgaattaccatctaagccggagactcgtccaccgtctaatccccaataaaaccagtgtccacggttgcccacattccaactcaattcattacgccaataccaaccgcgttcacccgacagcgataactcaccatcaaatcctcgtacactatgacgcccgccaatactaatacgatcttgggcaattaatggcgttttattccattgcgcattgacactggtatgaaattgccaagcttgtccttctaattcaaacggctttttatagtcgatagtggcagtgataattttagggcgagatgtcccttcgttatacgcttcttccggagcgctgattgcacctcgcacgccggtaccacgcttaaagtgcatatccacctctaaggtggcgttacttaaatattctttatgtgcaatgcccgcttcccaacctgccattcggcggcgctgaacatctacttctgcattatcaacaaagtttttagaactgcgtgaccagaaccctccggaaagtatggtcttacgtaccgcatctcggtatagcacacgagaaagcgttaacttatctgtttcactttcaccggcatacagataattttcaaaagcaccaaacacttgttggtgataacggttactcgaatggttggcagttaactgccaataaccgaaaggaatggaataatagaaagaaaggttacggctggcacgcttcccctcatcatccgaatgacgtttgatactatgggtaaagctagtatagaaaaggtcgtttgcggagaaaatattatcccaagataaggttgccgatgcctgccatttaccggttgaggtcgagccggaatcctctaagccgagattaagacgaaacggaatcgcttgagcatagctgatttttaaatcgctttcgccgacttgactgccttcgccttcactcggcaaaatttcaatattggcatccgctgtcggtacacgttttaagttctctagcgattgttcaatatcacgtacatttaaaatatcacctttctcaaacgttaaaccggttaacgcatgtaatggggtaaagcgaggcacgatgccactgtctgccaccaatgtatgacgtactttacctgcaatcacggtcaatactaaatcaccggaacgtaaatcttgctcttgtgccacaacgcgtgttgtaacataacctttttcaataatattattttgtgtttgcttcattaaaatacctaaaccttctccacctaaacaatgtggtaaagttagttttagatcggcaacggctttattaaatgcccattgaaattggctcgtttgattcaattgctctgcagaataatcaattaaagaaattcgatgaattggataacaaggcgattcatctgtcggcaggtgtaaattattctcttgacgagtatccatacggatatcagtttgaggtgtaaattgcgtttctcgttgctgtgcttgctgttgctgacgctgttgttctaccgcgtccaaatcatttaagactggatcaattgtaggagcagcgaaggtaaacaaaggaaaggtaagaaaagaagaataaattagaggttttaaatttaaagacataaataaccgtttaaagataattaaaactaatcggatgagtttatgcaatttaatatagatcgtaaagcatatttacatatttacctcattgatatctatttataatttttataacgggctagatatatttctctttatttcattcactaagcctttaaatgacacttgtttatttttataaattcagaccaaaaaaaaatgcgacccgaaggccgcatttattcatttgtttaggctaattaattaccattggtaacctacacccacaccaccagagtagtgaccagcactgtttgcagtaccattcactttaaggataactttaccgttatcgcttgctcttgagtaacctaccgctactgcagatgcgccactataagcaccgcctgctacagcaaccattgatttacccggaagcattacttgtggtaatgatgaagcggccgctgagttagcaccgataccacgaacacgtttatctaatttagatacacggttgtcgatgttcgctacgttttgtgcaacacctcttaactgacgtacgtttacagcgtcgttatcagctttaccatccgctacgttgttaatacgtgtttcagatttaccgtctgcgcccgttactttgattgcagaaccgtgttcatcttgtaccgtaccaactgttgcagtgttaccgtctttgcctacagttactgtatcaaatgttggtgttgctgaagttgcaattgcaatatttgaaccatcttgagtaatctcgatgttattgcctgctttcacgcccactgtatcgcccatcgcaacgttagatttcgatgcgccagttactttaccagttgatccttcaactgtgccagcttcaatgttccaacctttcgcaacgttattttgtaagttcgttacgttttggttagttgcatataattggctaccgtttacagcatccgtacttgttgcacttacttcacccgctttcacgttagtaactttgttaccgccgttatttaaaccattgctggttaaattcactagtgaatcagcgaagcttacgcctttctcagatactttcgtaccgccggctgttaagctaccgtctttgcctaaatcaacatccttgtttaagcccactgtgagtgaaccattagttacggttgtagttacattaccgtcacctttcacttggattgttttaccaagactttgtttcacttcagtgccattgtcatctgctaaaccgaagccaccgccttgctctgcatctgttacgccagagatagctgtttggaggtcaccgatattcgcagcattcttcaatgtatcgccttttgcatctgcaagtttagtaccacctaaaccactttctacattagtgatttgtttgttacctgcattgatgccggcttctgcagagattttcacatcacccgccgttaagccgtctttcgttaatgatactttatcaccaactttcacaccttcattgttcatgatagtgtcgccagctttaatgctaccgtctttacctaagtcaacatctttcgctaagccaacagttacgtttgtaccatcgttattaatttcgatgttcttaccgtttgcaaagtttacagtgtcacccggtttaacgttagttgaaacattaccgttagtttgaatgttccagcctttattagccacttcgcttactgcatataattggctaccgtttactgcatcagtacttgttgcattcacgtcaccagcagctacgttaataactttgttaccgccgttatctaagcctttagtggttaagcttactgtattgccgccgtttgccggagtaatcgttaagccgttaccgtcaactactgacttatcaccacctacgttagtaaatgttgcgctcgttaaatccgttaacgttctcgccatcttaatgatgagtgcgccatctacgttatcaacacgtaagttcttatcagtaacatctgccacagtgcttaagttacctttaatggttaacgttttgttaagctccttagtaattactttaccgtcgtcacctacgaattttaagccatctttaagggttgcaacttcttcagtcactgttttaccgtctggagttttagtctcataaacgatacgtgttttgccatccttgccatcaacacccggttcacctttagctaaagtaattgtaccgttagaaccgtctttaccgttgataccgattgtgccgtttgcaccatctaaaccaacaccggttttaccgtctttaccgttaactgcaattgcaccgttgccgtctttaccattgattgatactgcatctttgccattttcgcctttaatgctgataccatctttaccgctgatagaaacgccatctttaccgttttcacctttaacagtgattacgccaggctctttatcgttacctactgttacgttgttagttaagccgatttgaagtgctttcttaccgtctttctcaacaacttcagttttcacgctaccgtcaccaataacagtaactgttttgcctaaatccgctttaacgtttccacctttttcatcagttaaaccaaaaccaccggttgttgcgttagttaagttatttactgaatcttttaagtcacctacgttaactgcgttagttaaaacatcacctgttgcatttgcaaggtcaactttatcaccgttacggtttactaagccgcttgttacattagtaatttggttattaccgttgtttaagcccttatcagttaagcttactgtattacccgcatttggtgtaatggttaagccgttaccgccgatagttgtgttgctgttaccagatgtaaatgttgcgttcgttaaatccgttaacgatttcgccatcttgataattagcgcaccatctacgttatcaacacgtaagttcttatcagtaactgctgccgctgcatctaagttacctttaatagttaacgtttggttaagtttcttagcaatcggattaccagtatcgcctacgaagcttaaaccgtcatttaaggttgaaacgttatgtttagtaccgtttgcatctgtataaacgattcgagtcataccgtctttaccatttgcaccatcagtaccgtcaacaccaactgcacctttctctacagtaattgcaccgttagaaccgtctttaccgttgataccgattgaaccgtctttaccgtttaaagtaacaccagttttaccatctgcacctttaacgccgatttcaccatctttaccgtctttaccaccaactgttaagttgttgtttaacgcgaaggttacgttattcgcatctttagtgataacgatgttgccatctgtattcgctaaatctacggttgcatttggagttactgtagtttggttattaccgttgttaaccgttaatttccaacctgcatttgcagttgcatttacacgctctaattggtctttattcacagcatctttgccgtctttaccatcagcaacgttagtaatacgaccaccttctttaaatgatacgccgtctttaccatctgcacctttcaacgttaagccgttttgaccatctgcaccacgagtgccaacgatagacataccgtctttgccgtctttcgcaaatttaacttctgcatccttgccgtctttaccgtcaacgataataccagagaaggttggacgttctgcaataacgatatttaaacctttatcgctttcacgaacgcctacgttacgatctgacgcagctgttagaccagcttcagtgttgataccacctttaatcgctaaagtatcgtttagtttcttagtaacgactttaccatcgttaccaacgaagtttaagccatcgttaagtgttgctacttcttctttctcaccgtttggtttttcgtaaacgatacgtgttttgctttcgccgtttacgccatcgttaccgtcaagacctttagcaccttgagctacagtaatatttgcacttgcatttttaccgtctttgcccggagcgcctgttaagccgatagaaccgtctttgccgtttaaagtcacaccggtcgtgccgtctttacctttaacgccaatagaaccatctttgccgtccttgccatctttaccagggccaccaacggttaaatcgctgttaaagccgaaggttacgttattaccatccttagtaataatgatgttgccatctttatttgctaaatctactgtcgcatttggcgttacagttgattcatttgtaccattattagttaacttccaacctgctttcgctgttgcattaactttttctaattggtttacatttacggcatccgtaccgtttaagccagcttttacattagtaattgtattattaccgttgtttaagcctttacctgttaagcttactgaatcacctgctttaggcgtaatcgttacaccattaccaccgatgattgtgttgttgccggcagcatctgtaaagttagcgcttgttaaatccgttaacactttcgccatcttaacgatcaattgttcgccttcattatcaacacgtaagttcttatcagttacttcagcagttgaagttaagttacctttaattgctaaggtttcgtttagtttcttagcgattgaagttcctttatcgcctacaaaatgtaagccatctttaagggtcgcaacttcttctttatcgccatttggtttttcgtaaacgatacgagttttgctttcgccgtctttaccatcgttgccatcaatgcctttcgcacctttttcaactttgatagacgctttaccttctgcaccatctttaccgtctttgccgtttacaccgtcaacgccgttaaatacgattgcatctttagtaattgttgtaccgtctttaccatctgcgcctttaacaccgatagtaccgtctttaccatccttaccgtttacaaccacatcaccagctaatgccacttctaatgatttatcggttacatttgaagtaacagttacaccgtctttacctttaatttggatagtcttacctaagtcttgtttaacttcagtacctttatcatcttttaagccaaagccgtctgttgtaatgtttttaacggtttcttttaagtcaccaacatttacagcatttgttgacgttgcattcgcgaggtctgttttgttacctgttgcatcagttaaaccgcttgttacgttagtaatttggttattaccgttgtttaaacctttatcagttaagctaactgtgttttcaggtttatctgcagagatagttacaccatctttacctacaaccgttttatctgttgcagtattaccaaatgttgcagttgttaagttagctaagttttgtgctaatttcacaactaatgcgccatcttggctatccacacgcacattctctgaacttgctgcagcatcgtttgctaatgtacctttaacagttaatgtatcgttaagtttcttagcaatcttatcaccttggttaccgatgaagtttaagccatcgttaagggttgcaacttcttctttaactggtttaccgttatcatctttagtttcataaacgatacgagttttggtttcacctggtttgccatcaagacctggtttaccgtctgcaacgctgatattagcgcttgcaccgtctttaccatcagtaccacgagggcctgttaaaccgattgaaccgtctttaccgtttaaaacaaccgatgaaccgtctttaccgttaacaccgatttgaccgtcaacaccatctttaccgtctttgccatctttacctactgtgaggttgttatttaaagcaaaagtaacgttgttatcggttgtacctttagtaattacgatattaccgtctgtgttatttaagcttacgttgcctttaggaccaacattcgttgaatttgcaccgttagcagaaatattccaacccgcgtttgctgttgcatttacacgctctaactggttaacgtttactgcatcagtaccgtttttaccttcagcaacattagtaattgtgttattaccattgtttaagcctttgtcggttaagctaactttatcaccagtatttggagtgattgttacgccattaccaccgatagttgtgttgctatctgcagatgtgaaagttgcgttagttaaatctgttaactctttcgccatcttgatgattaattcatctttctcgttatcaacacgtaagttcttatcagttacgttagcatctttagctaagttacctttaacggctaaagtgtcgtttagtttcttagcgatcacttcgcctttatcaccaacgaattttaagccatcgttaagagttgcaacttcttcagtagttgttttaccgtctttagttgtttcataaacgatacgagttttaccgtccttgccatcaacgcctggttgaccgtttttaactgtaatcgaaccgtttgcaccatctttgccgtttaagccgattgtgccgtctttaccgttgatagaaacaccgtctttaccgttttcacctttaacagtgattacaccaggttcttgatcattaccaactgttaccgtgctatttaagccgatttgtaatgctttaccgttgccatccgtaacaacttgtgcattcacaccatctttaccagtaactttaattgaagtacctaaatcctgtttaacttcattacccgcagaatctttaagaccgaaaccaccggttgttgcattggttaaatctttaaccgtattttgtaagtcaccaacgtttaccgcatttgttaatgttgtaccgttagcatcttttaatgcaactttagttttaccatcgttacctactaaaccgcttgaaacgtttgtaataatgttattaccgttgtttaagccgttttcagttaggctaactgtcttagcatcaccacctgttgttggtttaattgtcaaaccatctttgttaattacaagttggtcatttccatctttaccaaatgttgctgtcgttaagttagttaagttttgtgctaatttaacgattaaatcgccgcctacgttatcaacacggatattttccgctgttgccgcatcagcattagctaattcacctttaatggttaaggtttcatttagtttcttagcaactgcaccgcctgtatttccaacaaagcttaagccgtcatttaacgtagaaacgttatgtttagtgccgttaggatctgtgtaaacgatacgcgtcatgccatctgtaccatttgcaccgtctttaccatcaacaccagcaggacctttcgctacagtaatatttgctgttgcagatttaccatcagcacctttaggacctgttaagccgattgaaccgtctttaccgttaagaacaactgctgaaccgtctttaccgttaacaccgattgaaccgtctttgccgtctttgccgtctttaccaccaactgttaagttgctgtttaaagcgaaagtaacattgttgttatctttagtaataacgatgttgccatctttatttgctaaatctaccgttgcttttggtgctacatttgagctgcttgtgccattaactgttaagttccaacctgcatttgctgttgagctaacttcttttaattggcttacatttactgcatctgtatctgctgtaccgttagcaacattagtgatgttattaccaccattgtttaaacctttatcggttaagcttacagtcttagtaacatccgcacctttaggagtaatagttacaccattaccgttaatagtggtatttgcacctgtcgcagtaaagttagcgctggttaaatccgttaactctttcgctaatttaacaactaattggccatttgcttcattagcttcaacaccaatgttcttatctgataatttcgcaggatctgcattaccaacaacacttagtgtttcacctaatttacggtgtacttttgcacctttattatcagcactgaaacttaaacctttctcagttaagttattacctaagttagtaatattcgtatttaattgatcgtgagaagactgtaattgatcttcagtagctgcacgaccgcttacgatttgacccggagtaaaggttttatttgttaaaccagttaccgtgccatctgtaccattaattgttaccgctttatcgccagtaccaactttaacagtattgtttaagtcaaatgttacattgttaccttctttagtaactttaatgttgccatctttattatttaaacgaactgttgcgtttggtgcgatattagaacctttagcatcatcatttaccgctaagttccaacccgctttagctgttgcgttaactttctctaattggcttacatttacagcatctgttgcatctgtacctgcagaaacattagtaatcttgttattaccgttgtttaaacctttatcagttaagcttacagtcttatctgcaccaccggctgtagtaatagttacacctttaccatcgataactgtgttgccattattacctgcagttgtaaatgtcgcattcgttaactcttttaacgttttcgctaatttaacttctaatttaccttcagaaccaactacaccaatatttttatcagataagttagcttcttcagcgccaccaacaatgcttaaagtatcgcctaaattacggtgaacgacttctttatcatcaccaacaaagtttaagcctttagttgttaagtctttgcttgcattagtgatgtttgtatttaagtcaccatgaacctgttttaactgatcttcagttgcagcttgaccagacacgatcttagtaggatcaaaagtcttattagttaaaccaccaacagtaccatttgtaccgtcaattgttacagcgttattagtaccaactttaacagtgttatttaaaccaaatgtaacgttgttatcgccagctttcttagtaataacaatgttgttatccgtattatttaagcttactgcatcgtttggttttactactgattcttcagcgttattcgctcgtaatttccaaccagcatttgccgctaaactcacttcgtttaactgatcaacgtttaccgcatcagtaccttttgtacctctagctacgttagtaatgttattaccaccgttgtttaagccattattggttaaactaactgttttagctgtatcaccgttagctggagtaatagttacaccattaccattaataactgtgttaccttgaccgttagtagtgaagtttgcacttgttaaatcatttaacgttttcgctaatttaactgttaatgtgccgtctttaccttcaacaccaatattgttttcagataaatctgctttagcaccaccaacaacacttaacgtcgcacctaaatcacgatgtactacttgaccgttatcaccaacaaagtttaagccttctgctgttaacttatcacctaacttagttacgttttggttagtttggtgtaattggctaccgtttactgcgtctttactatctgctgaaacttttccatcagcaacattagttacaacgttatcacccatattaatggttgcaccttttttcacggttaaaccattatttgcagtcacattgtcaaaagtaacatctttctgagttgcaatttttacagaaccatcttgttccgcagtcactgcaatattatcgccagcaataaagttagctacattacttgttggagtaacatttttagcttttttaccacctacttgtaattcccaacctgcttgaacagtagtatttaagctattaatgctatttgtgttgttagttacattttggtttgttgcatataattggctaccgtttacagcatccttactgttggcactaatctcaccagcttctacattagtgattttcttatcacctgcgttgataccatctttcttaactgatggaccaccagcaatctctaagccaccattgttaatggttgtatcaccaatttttacagaaccttgttcactaagatctaaagtgttatttaagttaactttaagtttttcgccatcaattgtagtgttaatgtttttattaccaccaacaacctcgatcttctcacctaaatctttattaacagttttgttatcttcagcttgtaaaccaaaaccttttgcaatcttatctgcattgtctttgatatcgttcttaactttatcatctagcttaaatgtaacttgaccatctttagcttcagtaacgatttcacctgtagtgcctgcaaatttaatttcttcacttaatttattagtaccgttaccactatcacctgcatagctaacatttgcatttacttttaaatcataagatttagctggaccattttgggtttcagcaatcgtcacagaaccatcatttgaggtaacaatcgtacgagcatcgtcaacatattttttgtttgccgcatcagtatctgctgttggggttgcaacatttgttactcggttattacccatgtctactttaccgccatttttcacagtaaagttatttacattggtatcgccttcaacatttaagttttgtgtcttaacattatcgaaagtcacatctttatctgttgcaattactaccgatttatctgttgcaattgaaacattgatattgtcaccagctttaaagttagcaactttatcttttggtgtaacatctttagctttattaccttcaacttgtaattcccaacctgcttgaacagtagtatttaagttgttaatgctatttgtattgttagttacattttggttagttgcgtataattggctaccgtttacagcttccttactgttttcactaacttcaccagcctctacgttagtaattttcttactgccagcattaataccagttttagttactgaaggaccaccagtaatcgttaaaccatcttgatctactttagtagatccaatttttacagaacctttatcaccaagatctaaggtgttatttaaattaatcgcaagtttaccatccgccgttacagtggtattgatattttggttaccaccaacgactttaactttttcacctagctgtttagtaacgttgttaccatcttgggcttctaagccaaagcctttagcaatagcttctgcatttttagtgatgttatttgtgttgttagtaatgttttgagtatttttcgcaatattatccgcatttttagtgatattgtttgcgttattcgtaatattttgcttgttgtcggcaatattgtttgtattagtatttacttgatctttaaatttctgatcaatatcaacttttacactaccatcagtaaccgttgttgttacataatcttgtgtaccaataatatcaaaacgtttatctttctgatttactgtaatacccgtagcttgatgttgcgcatctgtaccaacggtaaactcttgcatcgcagaatcagcttttttcaatgattcttttgctttatctgctaaaccaacagttaccttgccatcttcagctttagtaacagtttcattttcaacacctgcaaatctaattggatcacttaatttattagtgcctttaccactatcaccttcatagctaacatttgcatttacttttaagtcgtaaactgtagcgccattagtagttgagtttgtaatcgttacagaaccatctgttgatttaacctgtgtacgaccatcatcaacatattttttatttgctgcatcagtatctgctgttggagctgcaacatttgttacattgttgccacccatatcaactttaccgcctttttctactgtaaagttgtttacttttgtgttaccagttgccgttaagtcttttgtatttactgaattaaatgtcacatcatcttcagttttaactgtaatgtttttaccttgctgatcgatagcaatatttttatctgctgtaaaagttacagtttcaccattgataaccttagctgcagttgtatcaccggttttactaccttcatttgttgcgctagtcgctacattccaacctttttcgatttcagttgctaatgcatataattggctaccgttaattgcgtctgttgaattagctaatacacgaccagcacctaagtctgtaattgtacgaacaactgtacctgaacgagcttgatctttatcataaccactaccaacactcacagtaccttgtgcttgacctcctgcaaacttataagttttgccattgatttgcatatcggcgctaccaccgatttcatcagcaaaagaatcagcacctaatgaaactgaatttgcaacagttactgttgcattagcacctaaagctaaagaatgatttgcttttgctttagcttcttcaccaatcgccattgagcggttatgagttgctgttgagtttgtaccgattgttacaacacgatcatgtgctgcatttgaattggtaccaattgcaactgattgattccctacagaagtagcattaaacgcaaatgcaactgattcttcacctcttgcagttgcattattaccaaatgcaacagccttatcttttaatgcttttgaatcattaccaaatgcaattgcttcattagctgatacagctgctaccgtatctttatgcccaaagatatcaacagaatctgtaaaagtccctgttctagctccagaacctactgcaaatgaatcattaccattggtcttcgctccagaacctaaagccattgagcgattaccataagtttctgtactatttacaccatcataagctgtacggaatgcttcatcagtagtaccttttgttgttttaggatctacactaccaattgcaatagattgagaaccatgtgctgttgctgatgcacctaatgcaacacttgcttcaccttttgcataagaaaccgaaccaattgctgtagagtaattacctgttgctgcggattgacgcatcatcgcaagagagttaaagcctgatgcattagctgctgtaccaatagcaacagcgcccacatcgcgagaagttgcttgaacacctaatgaaacagataacccccctgtagcttcagaaaaatcaccaatcgcaataccatttgaaccacctttaccagtagttgcaatagcattggtgttacacccaatagcaataccgtgagcatactttgttgaactataaagatccgaagagcgctcaccagggttaccagggttataatagttatatgctcgggtaccttcatcagttgtagtatgatgataatatgggctactaactactgttgatgcattagccttagcactattatcagtacttataacgccattttccacatgactaatagccacaatcgcatttgcttccattggggcaaatgaaccgattgctatggtaccgacggcggcgacttgaagagcggcagcaacagcgacagctgttgttttatttgaaacgtctttgacgtccgagacagtagaggcagccttgcctttactacgggcgagttcagacacgacaacgagagagttcgttaccgtgctccaaaccactttataaatgtggttcatacaatactcctaaatttaatatacatcattccaaaataatgaaagtacaatccatcactttcattaatttcttttcaatcttcatgattaaaaaagaaaatttatgattcttacactcataagaataaatcgtattatatatctgttgaataaaaacacaaattaattccacactagaaatcagaccagaatcgatatttacactaacgtaaaccgttcaataagaaatgacaatcaacctgataggcaataactctgcaaacgtttaccaaacataaataaatcaaggagttacacatcaaaacaaagcttgaaatctataaataaagcctaaacaataagcaataaaaacaacatatccgaccaaaaaaaacatatttttctgatgaaaaaaccatctaaatactcaattaaattattcattaaaatttatttaaaaaataattgaacttattaaaaaactaaaaatctaataaaattctgtggtacacaacgatttatttttaatcataaaataaataaaaagcgagcaactctgattaaaaaatagagcaatattgctcaaaaacaaacgtacgcaaacgttaaactaaattttttgttattaagtacttaaaaatcagagatattctcttcttatcccctctcttcttttataatttctccgattggttagtttatctgaaatttgcataaactttacgaatatagtttctctcttcctttacctctctctttctgttaactcaaccaagttgaaaatttaagacatccaaagagcgctcctcggataaaaaatttttcagttaaaataaagaaataggggaaaatgctttaatggctcaaaacatcataaacagttcatatttaaaggaggtctctcattttactaaagagaatgtagagctaaggctatgagaagatgggcaatttatataggccaaagagattgcaaaatttttgcgaaatttgaccgcttgtaataaaaagaaagccctaacgaaaagttagggcttgttgatatattgcagtagaactagctagcgatagtgagctgccctgcatatagaatgaagtaacgtaagcaaagcacgccaatcaaatccagaatagagattaagacgataaacttcacgttatgttttaatttatgactcccgaagatatttgctactaatggaattaaaataccgataaacagtacgccaatccagaagattgcgccccagaagccggataaagcattatgtaatgctaattgtttatccgcgccaccaaagtgtaagccaacaaagaacgccactaataagcctaattcggtaaccataatcggtacttcgaatttatggataaagtgaacttctttgctttcgccggataatttacccgcaagtaaaatgacgaggaacgtcgccgcaataccggaagatgtacctgatgctaaaaagagcgccggtaataccgggttattcagcatcggataactgattaaggctgaaagtaagaagccggtataagcacctagcacagcagcaaagacgaagaggataaactcaaccgcttttaaacctttgctttcaacaacatcaatccaatttaaaataaatttaaatgccggtaaataacgatttactaacactgccacccaatctttgaacataatggcgatccaaacaaccaatacggccatataaagttggaacaacattacacccatcgacattacagaggtgaagttatagttaaacattaacttccagaatgtccacggtttagttaggtgaaaaataagtaaagttaaaccgattagagttggaaccgtccctaaaatagcggcactacggattacccagttttcgctatttttttcgattttattaccgctattacggtaagcgatcgctaactgcaccgcacctgatgaaatacctaataaaaagaggtaaatcgcaatggtgctgtcccacactaaattcggggtttggaatggaatatagtcgttcattatctatgttcccccttgccaaatggaatgtggtataagttcggctctgtacctaaagctactttggtacgatacactgggttctcatgtacttttttgtacacttcgctattgcgatcgttcatatcaccgaaagttaatgctttagtcggacaagcttctacacaagcaggttgtttgccttccgcaagattggtatcacgacagaagttacatttatctgctgattttttctccggatgaataaaacgtacacggtatggacaaactgcaatacagtattggcaaccgacacataagtctgaatgtacgtcaacaatgccggtttccggatcaacaaatgatgcgccggtcggacaaaccgcaacacaaggtgcgtttgtacaatgttggcaagattgacggaaaaattcatactctacgttagggaattcaccatacggctcgctacggataatttctaaacgagaaacaccttccggcactttattcgttgtacggcacgcgtccatacaagcggtacaaccgatacaagaggtttcatcgtgcaccatcgcatagcgaatttttttctcttctttctcagtagcaagagttactgaggtagcaagcccggtgcttgctacgacagcgatagcacctgcccctgagacgaagtctctacgggtgcaagtcattatttattttcctttgctttgagtgagtccatttcaggcgttttaaattcgcctgcatggattttcgtatgacaatctgtacaaagtttaatacgttgtttttcaggaatgtctttcatcggctctttttccgggtgaagttcatgacagttagtacatgagattttcgttgcatgagtatcatgcgcccagaatttttcacgtaatttatccgccgtatgacaagctacacacacttggttttgttcgttcaccgaacgctcaagtgaaggattacttgctttaccgtgcggattaaaacgcattacgtcttttacacctttacggtggttttcagaaatattaccgtggcagcttacacaagtgatttgttcaccgctatttgggcttttcacatctttttggaagtgtttgcccgcatggtgaaacggcttaccggttgcatttgcagattcatggcattgcacacaatatttgttcggatcacgacgtgcatcttctgcaatttgtgcatcacttgcttgctctgtccaaagtggtttcggttgttgcggcatatccgcttgggaagcggttgaaattgcaaagaaacttgcaaaagcgaccgcttggagggcgattgctcgccctgcttttgagataatgtttttcataatttcacctcaagcttctattatttcgcttctgcttttggtgctgcaactgcttttggttcttctactgcaggtaataagccttttttacgagcttccgcatcccattgtggaaccactgtacgtaagaattctgctttgtctgcttctaattttggcatattcaagccaatcgctttttgtgctttttctctcgtagaaatatctggaatagcaaccggtgttgttacgccatgtttcgctaatactacaccgagtttcgcacgtgcatctgctgcgcggtcaatacctgttgcaatcacatgtaacattgcatccggagcgtgcatatggctaccgtgaccagctgctgaataatcccaacgccattgtgcatgacgaattgctgttaagatatctttcatctcttcttgtgttgcaccagcatcccaagcggctttcgcttcaaaatgcgctttcactaattgatcttctaaacgaatcattgcttctttcacttgatgtttatgttctttcacacgtttctcaagtgtttctttactttgttcgtgacaagttttacacgttacgtcaaattgatcgaacgggttaccgattttgtgatccgtataaactttgccgtctttatctttcactttcggcatatgacagtcgatacaagttacaccatttttaccatgtacaccttgagaccaaacttcaaaatccggatgttgtgcttttaacataggtgctttagataaagcatgcgtccagtcagcgaattcaatttcatcatagtatttctcaatactagcgacatctacgcctttatcccatgggaaagttacgtctgttttacctttgaagtaatactcaacgtgacagttcgcacataccgcaacacgtttaccatgtttatctaagtcttcaaatttccaacctaccgtttctaacgcacgtaatacatgtggacgagcaacacgtaatgctggtttgccttcttcaaactctttagattttgtgtcatgacagtctgcacaaccgattgagtttacgatttcagcaccgtattttgcccatttaggatcaaaataaccacgttcacctttttcttcgattaagcgaggcacatctggacctttacatgtccagcaagccattggctgaggaccatcattttcatctttcggcgcaccagtacgtaaaatttcacgtacgtctgttacagcataatagtgaccacgaggtttgttatactctgcggagaataaataaccagcccataacacaacataacgaggatctgcttctaatgcactaccacggtcggttgattcggaagtggctttccatgagttatattgaagcggatatttttcagcaaatttatggtttgctgactcaactaccacacctaatttttcatgttttaaagctttatcggttaaagacggtgattttgcttcctccgcccatgctgacgatgataaacatcccaacattgcaatggttgccattgctaattttttagttaaacgtttcacgttgtgtcccccacaaaatgctgatagaaatgagaatttttcttattaaaaacaataagataaacattgcgtttcacgcgtgagcatagaataaaatagataatatttactaggtgaatcttaacttttattgaaataaatcaacaaaaaaatcacaaatactccttaagaggtatgtgtttttcgcttacctaaccatccctttttatgatttgctgtaataaaagaaatataaatcagactggggttaaattgacttttttagaattgttcttaaaataaacaataaccaactaaaaaagtaggatttatttatcttgcaggagtaatcatgaaaatcgccgtttacagcactaaaaattacgatcgtaaatatctcgaattagccaatcaaccatatggctttcagcttgaattctttgactttatgttaagtgaacgcaccgccaaaatggcggaaggttgccaagctgtgtgtattttcgtaaatgatgatgcgagcgctaatgtcttggaatcactggctaaagtcggtgtaaaaattgtggcgctacgctgcgccggttttaacaatgttgatttaaaagcagctcaaaaactgggattacaagtcgtgcgagtaccggcttattcgccggaagcggttgccgagcacgcagttgccttaatgctaagtttaaaccgccgtatccaccgtgcttatcaacgcacacgagatgcgaatttctctttagagggcttaattggctttaatatgcatggtaagacagtcggcattattggtaccggcaaaattgggttggcaacaatgcggatactaaaaggcttcggtatggagatcttagcattcgatccgtttaaaaatcctgctgccgaagcgatcggcgccaaatatgttgaacttgatgagctgtatgcgaaatctcacattatcagtttgcactgcccggcgacaccggaaaattatcatttattaaataagcaggcttttgacaaaatgcgagacggtgtgatgattattaataccagccgtggtgggttaattgattcttctgcggcaattgaggccttaaagcaacaacgtatcggagcattaggtatggatgtttatgaaaatgaacgtgatttattcttcgaagataaatcgaacgatgtcattttagatgatgttttccgccgtttgtcttcttgccataacgtactatttaccggacaccaagcatttttgacggctgaagcgttaaccaatatttcagaagtcacgctaagtaatattcaacatattcataataatgaagcgtgtccaaatctagtattagcatcttaaccccaacaagcggtcaattttgcgtatttttttgcaaattttacgccaaaattgaccgttttctttccatatccgctttatcttgttgaatttcccacatttttgctgattacgggtttaaaaatccttaaatctatgttatcaataacgcctttaattttataaatttaattaaataattataactaggacacaacaaaaatgaacggtgcaaatttagtcattgaaagtctaaaagcacagggcgtgactacactattcggttatccgggcggtgcgattatgcctacttacgatgcgctttacgactcaggtttagatcatttattagttcgcaatgaacaaggtgcggcaatggctgccattggatatgcgcgtgcaacgggtaaagtgggtgtttgtatcgcgacatctggtcccggagcaactaacctaattaccggcttgggtgatgcggcattagattcaattccggtggtggcgattaccggtcaagttgcttcacatttaatcggtacggatgctttccaagaagcggatgtattaggtctgtcactcgcttgtaccaaacatagtttcatcgttcaaaatgtagaagaattacctgaaattatcgcacgagcattccaaatcgcacaaagcagtcgcccaggccccgtgttagtcgatattcctcgtgatgtgcaattagctccaacgtcaggcaaaccgatcgtatatgcgaaagaagagccaaccgctcaaaatgcggaaaaccttgcccaagccaaagcgcttatcgctcaagctaaacgtccagtattatatgtcggtggtggtgtcggcatggcaggcggcgtacaagcggtcagaaatttcttaaaaattaccaatatgccctctgtttccaccttaaaaggtttaggcactatcgaagcggatgcgccgctttatatgggaatgattggtatgcacggtaccaaagcggcaaactatgcggtacaagaatgtgatctgctgattgcttgcggtgcacgttttgatgaccgagtaaccggtaaacttgataccttcgcaccacacgccaaagtaattcatatcgatattgatagtgctgaaattaacaaattacgcaaagtacaggttgcattacaaggcgatttgattgaagcggtaaatgctttagcgcaaccgttaaatatcgatccttggcgtgaagatgttaaacgcttaaaagcagacttagatttccaatatgtcgataatgcaggtgaaggcgatattgatgctaaggcattgctaaacacgctttcacagcgtaaaccgaaaaatgcgattatcaccacggatgtaggtcaacaccaaatgtggtctgcgcaacatttacagcattttgcgccggaaaatttcattacctcggcaggcttcggtacaatgggcttcggcttaccggcggcagtcggtgcggtaaaagctcgtccgcatgatccggtgattttagttaccggtgacggctcgattatgatgaatattcaggaattcggttctatcaaacgtgataatttgccagtcaaaatcttattactggataaccaacgtttaggtatggtacgccaatggcaatcgctcttcttccacggtcgtcacagtaacacgattttagacgataaccctgattttgtagtgcttgcttcagcattcggcattaaaggcgaacgtattgagaaagctagtgaggtatctgatgcgttaggccgtttactaaatgcggaaggtgcttacttattacacgtttgtattccggaagaagataacgtatggccgcttgtgccgccgggtgcgtgtaacgcagatatgctagatgatgaagtttaagggttgaggagaataatgatgcaacgttacgatttaactattaaagcgaataggcgtcccgaaacacttgagcgcatttttcgagtgattcgccaccgaggttttgaagttctgaatctgcaagcggtcaattccggcgaagaaattgcaattcagctcacgctccaaagccaacgtgatatttcgttacttaccgcacaacttgaaaaattatttgatgtcttagcggtgagctaaccaatcaaagatagcgtcaaagcgaaatactgtataaaataaaagactgtttggcgaagcaatgttgtttcgcccatttaaccaaccatttattgatcaataaggaaataaaatggcagattttaaccaaatcttaactccgggtgatgttgatgcaggtatcatcaacgttgtaaacgaaattccagaaggcagctgccacaaaattgaatggaaccgtaaattaggtgcattccaattagaccgtgttgaaccggctatcttcgcaaaaccgactaactacggtttcattccacaaacattagatgaagacggcgatgaattagatgtattattaattacacgtcaaccgttagcgacaggcgtattccttgaagcgaaagttatcggtgtaatgaaattcgttgatgacggcgaagtagatgacaaaatcgtgtgtgtaccggcagacgatcgtgactcaggtaatgcatataactcattagcagatttaccagcacaattaatcaaacaaatcgaattccacttcaacaactacaaagcactgaaaaaaccgggttcaactgttgttcaacactggggtgatgtagaagaagcgaaagaagttattcgtgaatcaatcaaacgttgggacgagcaaaaataatcttcccacgtaacaataaaggcaattcactccgaattgcctttatttttaataatatgccaaaataactaaaaaattgaccgcttgttttaggattttaagcggtgtgctaatatattagcgtctatttatccattacaaacacaactgaaataacattggagagattatgcctattttacgttctgcaacctcaacgcaaggtcgcaatatggcaggcgcacgtgcattatggcgtgcaacaggaatgaaagaaaacgacttcggcaaaccgattattgccgtagtaaactcctttacccaatttgtaccgggtcacgtccacttacgtgatatgggtaaactggttgccgaacaaattgaagcagctggcggtgttgcaaaagaatttaataccattgcggtagatgacggtatcgcaatggggcacggcggtatgctttactcattaccaagccgtgatttaatcgctgactcggtggaatatatggtcaatgcgcactgtgccgatgcgatggtgtgtatttcaaactgtgacaaaatcaccccgggaatgttaatggcagcaatgcgtttaaatattccggcggtatttgtatcaggtggcccgatggaagcgggtaaaaccaagttatctgatcaactcatcaaattagacttagttgatgcaatgatgaaaagtgccgacaaaaccgtgtgtgacgatgacgtggatgcgattgaaaaatccgcttgcccaacttgcggttcatgttcaggtatgtttaccgccaactcaatgaactgcttaaccgaagcattaggtttatctttaccgggcaacggctcgatgttagccactcatgccgaccgtaaggaattattcttaactgccggtcgtcaaatcgttgaactttgcaaacgttattacgaacaagacgatgcgagcgtattaccgcgttcaatcgcaaccaaagcggcatttgaaaatgcaatgagcttagatatcgcgatgggcggttcaaccaatacggttttacacttactagctgcagcacaagaagcggaagtggatttcactatgtcggatatcgaccgcttatcacgtaaagtgccgtgtttatccaaagttgcgccgaataccaataaataccatatggaagacgtgcaccgtgccggcggtattatggcaattttaggcgaacttgagcgtgccgatttattacattcagatacacgaaccgtattaggtatgacgatcggcgaacagattgcgaaatacgacattaccttaacgaaagacgaagcggtacataaattcttccgtgccggcccggcggggattcgtaccaccaaagcattctcacaagattgccgttgggatacggtagatgacgaccgtcaaaacggttgtatccgttcaaaagaatttgcctatagccaagacggcggtttagcaatgctaaccggtaatatcgcactagacggctgtatcgtaaaaaccgccggtgtagatgaatccatcttaaaattcaccggtgatgcaattgtgtttgaaagccaagaagaagcggtggaaggcattttaggcggtaaagtacgtgccggtcatgtggtgatcatccgttacgaaggcccgaaaggcggcccgggtatgcaagaaatgttgtatccgaccacttacttaaaatctatcggtttaggtcaagagtgtgcgctattaacggacggccgcttctccggcggtacatccggtttatctatcggtcactgctcaccggaagcggcttccggcggtaccatcggtttagtacgtgacggcgataaaattgcgatcgatattccaaaccgctcaattcaacttttagtttcagatgaagaattagcggtacgccgtgcggaacaagatgcgaaaggctggaaaccggtaaatcgccaacgtgaagtttcaatggcattaaaaatgttcggtcacttcgcaacctctgccgacaaaggtgcggtgcgtgataaaaccaaactataaaatctattaattaaaacttataaaagcggtcaaatttcgctagaaaattgcaaaataatttgcaaaaattcgcgcaaatttgaccgctttttgatctccatttgagatctatttattaggaatgtaaatgtttgatttgtttttatcgctaaacccgattctacaagcgtttatcgccggtttatttacttggggctgtactgtttttggcgctgcttttgtctatttctttaaaacggtaaaccgcaaattactggatgtgatgatgggctttgccgccggtgtgatgattgcggcttcgttttggtcactgctcgccccagctctcgaatatgccgagccaagttacggttcgcttgcgtggcttccggcagcggtcggctttcttgccggcggattctttttgcgtatgattgatcatattgttccgcacttacatctaagtaaaccgcttgccgatgcggaaggaatgccgaagttcaaaaagcatttatccaaaagtatgctattgtttttagctatcactattcacaatattccagaaggacttgccctcggagtaacatttggtgctttagcctcagatgtagccgatcaccaagccatgctcaccgctgcgcttggcttagcaatcgggattggcttacaaaatattccggaaggttcgtctctttctctgccgctgagaggcgaaggacaaagccgcaaaaaagctttcttatggggagcaatgtctgcggtggttgagccaattgccgcagtcattggtgccgcatttgtgctttccatgacagcaattctgccttatgcgcttgcattcgctgccggtgcaatgatcttcgtagtggtagaagagctgattcccgagtcacaaagcggcggtaacaccgatattgccaccttaggtctaatggcgggatttgtaattatgatggtattagatgtcgctttaggctaagctacgctcctattttgatcgttactcaaaggaatttgtatgatttggtacaaagcactgttttcacttcaaggaagactcaatcgtcagggcttttggatcggctttgcgattaactttattttcttatttattgttgcaaatttttggttaaattcgaccgctttcagtgtgattaatttaattccgctcgtactcgccgtatatagtttatctgcggtgattataaagcgcctacacgatcgtaaccgttccggtaaagcggttatcatggcatttgtaccggttgtgtgctatggtgtatccctttcagcccaaggcacaatgcaatggctactcgggatgatgatgccgatgtttatcggtacgatgttattactggaatggggtgtatttaaaggtaatccgcaggcaaaccagtatggggaaaagggcttaagtgtaaaattcctagcacgatagatcaatgttacttttctttgtgttgccaaagaaaagtaaccaaaagaaaggcaaccctacttcaccgcttatcttcgcttagttgaaatttgcttaacggaacattttagattcgcttcgctcaagaaaaatgttcctacaaattgcaacacgctcaggcggttcagaagggaacccagcccagactgcctaatatatactttctttggcaacgcaaagaaagtaggaaaaaatctatttttaatttaaaaagaaatactaataatgctcaaactaaactatcacaaaactcattttttaacttctgcaccggatatccgtcatttaccggaagacaatggtgtggaaattgcctttgccggtcgttcaaacgccggtaaatctactgctctcaatgcattaaccaaccaaaaaaacttagcaagaacttcaaaaacaccggggcgcacccagttaattaacttatttgaagtcgagccgaattgtaaactcgtcgatttaccgggatacggttatgcggcggtgccggagcaaatgaagctccaatggcaaaaagcgttaggtgaatacctacaaaagcgtgaatgcttacgaggtgtggttatcctaatggatattcgccacccgttaaaagatctcgaccaacagatgatcgaatgggcggtatccgcacaattaccggtgttattactattaactaaagcggataaactcagccaaagcgcaagaagtaaaacggtaaaaatggtgcgagaagcgattctaccgttccaaggcgatattcaagtcgaagcctattctgctctaaataaaattggtattgataaactggcggctaaactagacggttggtttagcgaagtttttgtagaacaacaatcataaaaatttaaagcttatcttcggataagctttctttttacaaaggacaattatgttttacggctatgtgatcaatcttaatcgacatcctcaacgcctccagcgttttctagcccattctgatgccaaatattttgaacgaataccggctattgataaaaaagtattagatctgttagatgcaccggaattgttatttaatatcgaaaaaattaaatccatcattggcagagagattactttaggcgaaatcgcttgtactctctcacatattcgctgttggcaaaaaattgcagagaatccgcaacttgaattaaccgattttgccgtgattgctgaagacgatattcaattggtagataattttcattatttcctgagtaatatcttacaagaactaaaaaatcgtccggaaatcgaaattgcattgctacataaattatcactatttcatgaaggtttttataccgcgagtgcggagcaacgtgatttccactttttaaccgataatcactcttcactatttgatagtgatggttcggcgctttatgcgatacgtaaagatcgtgcgattcagttggtagaacaattgaaaaccaacaaaccttattggttagccgatcactttactcatatctgcccaactcagaatatgttggtgctgaatccattactcggaaaaattgtaaatccgaatgattccgaccttgaagccgatcgagaaattgccagagcgaataagtcggtatagaatgccaaacaatttacattaataaggaaaaaacaatgtacgattttaataaattacgccaagaaacggatgagatcatcgaaaacctattaaaagacggttcggatccggatgcgctttatattattgaacaccacgtagcacaccgtgattttgataaactggaaaaattagtggtggatgcctataaactcggctacgaaatttcagaagcggaagaagtagaagaagagaacggcaaagtaatcttcgtatgtgatatcgtaagcgaagtcaatttaaatgccgacatcattaccgcccaacaaaaagaattactgccactgattgaaaaagtcggtgcggaatatgagggttggggtacttattttgaagatccgaatgcggaagatgatgaatatggtgaagacggcgaattcttcgatgatcaagatgaagattttgagtttgatgaagaagaaatcagacgtcactaatagttaaaaaatcccccatacgtttgtgtgggggattattttattgtgcttaaagcccttttttgacccaataacgatacggggtattttccgtttcgctatttagcaattggtgatccataaattcgcagaagcttggaatatctcgcgtagtggcaggatcgtccgccacaattaataatacctcgccttccgccatattgcggatggttttgcgagtgagcattaccggctccgggcaacgtagcccaagcgtatctaatgtttggtcaatttttatatccgtcatatttttctcttattttttcttttatgaaacaattatttacacaacatatcaagcgactacagcaagtcgttcaaacgattttagaaagtaactttctcagcggtttatggattcattccggtacggctcgctatcattttttagatgatcaaaccgccccctttaaaataaacccacattttaactacttcttcccttgtccgacagcagaaaattgctggttatttttagacggcaaaaataagccgaccgtctatttctatgcgccgaacgattattggcatacgccaccgactgccccgacagatgctttttttgcagatgaatttcagtgggtgattttgcaagatgcccaagaaattgcaaaatttatccaaaatccgaccgcttgcgcctttatcggtgaaaatgaaaacttggcaaattcacttggttttaaccaaatcaatccgcaaaaagtactgaatcagctccatttcgaacgttcgattaaaagtgaatttgaaatcgaagcaatctaccaagcacaatttgcggcattaaaaggtcatcaggcggcaaaacaagccttttttgaagggaaaagcgagtttgaaattaacctcgcttacctaaaagccagtcagcaatccgacttaaacgtgccttacggcaatattattgccatcaatcaacattcggctattttacactatactcgccttgattacgcccctaatccgcaaccgcagagttttctgattgatgccggtgcaaccgtacacggttatgcctccgatattactcgcacttatgcggctgatcctaatagcgaatttgcagcaatgattaagcaaatggaacaatacaaatatcgcattattgagcggcttgctgtggatgtaaactatctgagttatcatacgcaaatgcagcaatggattgctgaaatgctgcaccaatatgactttgtccgtcttacaccggaacaaatttttgaagaagggatttccagagcctttttgccacacggtttaggacatttgcttggactacaagtacacgatgtcgccggtttccaacaaaatcatcgtggtactcgcaaatcaccgccggaggtttatccaagtctgcgctgtactcgtgatttggcggaaaatatggtgctgacgatcgaaccggggttctatttcattgatatgttgctgaatccgttgcaaaatagcccgcttgcacgtcatattaattggcaaaagatcgctgaatttaaacaattcggcggcatccgtaccgaagacaatattgtgatgcgttcacaaggagcggagaatttaacccaaaaagcggaaattgaacttcaactttctgatcattaaagcattcaaataaggaactgttatgccatttctttttatcttattcggcatttttctgtatatctacttcgagatctcactactggtctcaatcggctcccaaatcggggtactaccgctgattttgttactgatcgctatttcggtattaggcttatggtttgtgaaattacgtgggttatataccatttattcaattcgtagtgaattaagccaaggcaaaatcccgacacaagcggttatcggctcactcctgtttattttagccagtgtttttttaattattcccggcttcttaagcgatattattgcgatcttattaatgttgccgatgactcgtcagattgccgaacgttatttaatgaaattctttaaagcgaaagtgcgtttcaaccatttttcaagcggtcaattttcacagcaagataacaataccttcgatgccgaatttgaacgtaaacaagatcaagataaatggattaaatagtggataaacatacgctcgcactcttgaaagtacattttaccgcaatcctttttggtgcatccggtattttcggtgcattaattgaaagcagcccggatacacttgtgcttgggcgagtgatgattgcacttgtttttatctctttgtattttatatggaaaaaacaaccgcttgtaaaactcactcaccgagaattatttagccaaatactttccggtgcattacttaccgcccattgggtgaccttttttactgcggtacaagtaggcggtatcgccttagcaactttaggcttcgccagctttcctgcttttgtcgcattatttgaaatgctcttttttagagaaaaactcagttatcgtgaaggctttttacttgtggcgatcaccatcggcttaattttggtcacaccggaatttacttttggcaatcaagcaacattaggacttttatggggtgttttatccgctttggtctatggtgtgttggcaattgtaaatcggaaaactatgagcaaattatccggcacacaaacgagctggtggcaatatttagtggcaatgctgatcttattacctttttccacaaaaggcttaataaacgcacctgccctcgattggttttggattttctgtatcggttttttctgtaccacattggcatatacgctatttgtctccagccttgatacgatcaacgcccgtaccgcttcgatgattatctcgcttgaaccggtatatgccattgcgattgcgtggctatgttttaacgaagtaccaactatcaaaatgttgattggcggcgcaattattttattctcggtcgcttgggctaacttaaagaaataaatgatgtttaaagctaaatttaatcaaaaaaataaacctcgttctgcaacaaccaaaccgaacttgcaaaatagaaccaaaaaacgaccgcttaagccacagctttcgtttgaagatactgtggtcgtattgtttaacaagccgtttgacgtgctaacccaattcaccgatgaacaaggacgacaaacgctgaaagactttattccgattccacaagtttatccggtcggccgtttagatcgtgacagcgaaggcttattgttactgactaataacggtgaaattcagcatcggttggcaaatcctaaatttgaaaagcagaaaacttatctcgcacaggtggaaggtattccgcaaactgcagatttagctaagttagagaaaggtgttgaactgaaagacggcttaaccaaaccggcaaaagcgaaagcaatttccgccccgaattatgaatggcaaaccgccccaaaaattcgagaacgaaaaactattccaaccagttggatcgagctaacaattcacgagggaaaaaaccgccaagtgcgccgaatgaccgcacacatcggctttccgaccctgcgcttaatccgtgtcggtttagggcaatttcagcttggtgatttagatagcggtgaatatcgtattttaaatgaggcagaaaaacgccaattatttcaacaaattgacttaaaaatttaatgatttcgggagcaaatatgaaaagttattgggtattagtacatcaatttgagattgctttaaaagatgatgagattcctttcggcaccgccgaacaattaggtttagccagctttgctaaattacaggttggaacatatcaaaactcaccggtttttctggtgcaactggatgaacaagcggtcgaaaatctgcaaaattttaccatggtgaacctacgctcacagattgctcgtccggcggaattcgctcatctgttacaccgagcggtttcacttaataatttcctcaatacgcataaattctgcggtaaatgtggatcgcataccaaacttgctgataacgaaatagcgattcattgcccaaattgccaacatcgtagctacccgaccatcagcccgtctattattgtagcggtacgccgtggacgacagattttactcgccaaccacctgcgtcacaaaggcacgatttacaccacattagccggttttgtcgaagccggcgaagcgatagaaaccaccgttcagcgtgaagtatgggaagaaagcggtttaaaaatcaaaaacatccgctatttcggcagccaaccgtgggcatttccaaattcactgatgctaggatttctcgccgattacggaagtggtgaaatcacgctacaagaggaagaaatcttcgatgcaaaatggttcgactgcgatcaaccactccccgaactaccaccggaaggtacaattgcgttggagctaatcaaagaaacgttgaagatttgtcgagaggaaagatagcgataattttataaaggctaattacgtcaaaacaaaaacagggagaattaaattctccctgttttttaagattagctaaataatttacctaacacaccttttgccgcttgagctaataagtcgttagtatttaagttttgtagatccggcaattgaccatccggtgttaatgtatcaacgatttttggtaaaaattccgccaataaatcgccggcatctttttcttctacacccacttcttgtgcggctgcttgaagattttcttgaccgaatacatttgcgatttgctcgcctgataccggtgcgttttcttcatccgcactgatccacgtttttaataaatcgtctaaaccgccttgttgtaatttagcgataataccttcaacaccaccttgcgattgtagtaatgcttgaattaattgaagtgctgttgattggttgccgttaccgccacttaaaacagatgatgcgattgagcctaaaatgtttcctaacataggtttactccgagaatgtgcctaagcacgtttttatttactgagttgctactcagcctagataattaagcggtctgatttgcaaaattttttgcaattttgaccgcttgtttctgccgattctaagctagaatccggcgaacacgttccaaatcttcttgcgtatctacacctacttgcggtgcttgtttggcaagttcgatatgaattttttctccgtaccacaacgcacgtaattgctctaacgattccaattgttctaattgggtcggttgccaagccacatattgttttacaaagccagcacggtatgcatagatcccgatatggcgtaagtaattttggcttgcgacaaaagcgtcatcacaatcagcgaaatgatcacgggcaaacggaatcggcgcacgtgagaaatagagtgccataccgtttttatctgccagcgctttgacggcattcggattgaaaagttcttctttagtggttaattttaccgctaatgtcgccatattcacttggcagcgatctaaattttccgccacttgcgaaacgatcaccggcgggatcaatggctcatcaccttgtacatttacgatgatctcatcatcggcaatccgcatcttttcaatcacttccgctaaacgttccgtgccagaattatgttgatccgaagtcatgcacacttccgcaccaaatgctttagcagttgcttcaatctccggatgatcggtggcaataatcacacgtgtcgcaccggcttgttgtgccttttcccacacgtgttgaatcatcggtttgccggcaatatccagtagcggtttacgaggtaaacggcttgaagcgtaacgtgccggaataatcacagtaaaattcataacatttcctttataaaaaacacggaacacccgctcaaatcaatattggtaaaattcttgtaaaatctagccgcttgtttgaataaaactgatgttccgtaaaatatttttaggcttctaacgcatctaagaaacgttctgcatctaacgctgccatacagcctgtaccggcagaagtgattgcttggcgatagttatgatccattacgtcaccggctgcaaacacaccttctacgctagttgcggtcgcattgccttccaagcccgatttcactttaatgtaaccgttatccaattcaagctgaccgtcaaaaatagcggtattcggtgcatgaccgatcgcaacaaagaaaccgtctactttaatttcttctttgctttcgtctttggttgaaactaaacgtacaccagttacgcccatattgtcgcctaacacttcttcgaccgttctatcggtgtgaagaataatttttccttcttccacacgtttctgtaagcgacctaataaaattttctcagcacggaagctgtcacggcgatgcactaaatgtacttcgcttgcgatattggctaaatataacgcttcttcaaccgcagtattaccgccgccaaccactgcaaccggtttgttacgatagaagaaaccgtcacaagttgcacaagccgacacgcctttgcctttaaacgcttcttcagatggtaaacctaaatattttgcagaagcaccagttgcgataattaatgcatcacaagtaaaagtattaatatcgccttttaaagtaaacggacgcttagataaatctacgctgttgatatggtcaaaaatgatttccgtattaaatttttctgcgtgtttcagcattttatccattaaaccggtaccggtagtatgctcatactcgcccggccagttttcaatttcatcagtagtggttaattgaccgccttgctgcataccggtgactaataccggatttaaattcgcacgagcggcataaacggctgcagtataacctgccgggccggagcctaaaattaaaagttttgcgtgtttaactgtcatgatgtaatccttatcaataaatatcgttgctattttagcgtaaatttaccgctaactctattttcgttttcactcatctttttttcgattttgtgaagcagctaacagaaattcgcctcgaattttggttaaattgggataaattcttcttttaaaaggatatccgtctatgaaaaaacttatcaattcaatcgaaacggtcttacaagagcaattagccggttttgccaaagctcattcgactctagttctaaacactgagccgacttacgtacgccgtgcagatgcaccggttgccggtaaagtggcattgatttcaggcggtggtagcggacacgaaccgatgcacgccggttttgttggtaagggaatgttagatggtgcttgtccgggtgcgatttttacctcgccgacaccggatcaaatgtttgaatgtggtttaaatgtcgatagcggcgaaggggttttattacttattaaaaattataccggtgatgtgttgaatttcgaaaccgccaccgaactccttgccgatagcggtgtaaaagttgcaaccgtactgattgatgatgacgttgcggtcaaagatagcttatataccgccggtcgccgtggggttgccaacaccgtgttattagaaaaactattaggcgcagcggcagataaaggctacaacttatcgcaattagccgaattaggttacaaattaaataatgccggccattcgattggtgttgcgcttggtgcttgtaccgtaccggcagccggtaaaccttctttcactttagccgaaaacgaaatggaatttggcgtaggcattcacggcgaaccgggcatcgaacgccgtccgtttgagaacctagataaaaccgtacgccaaatgtttgaaacactcatcgcacacggcgattatgagcgtaacgtacgccgttgggataatgacacgcaacaatggaacgaagtgttagataaaaaacaagcgttacaaaaaggtgatcgtgtgattgcgttagtgaataacttaggtgcagtgccgctttcagaattatatggcgtttataacgtgcttgccgattgctgtgaacaattcggcttaaccattgaacgtaatttggtcggttcattctgcacttcactcgatatgcaaggcgtatccattactttactgaaagtggacgatgaaactttagcactttgggatgctccggttaatacaccggcgttacgttggggagaataaaatgacgatttcaaaacaacacattctgcaatggcttgaaaattgtaatcaagtgatgagcgagcaacgagattttctcacacagctggataccgaaatcggagacggcgatcacggcttaaatatgcaacgtggttttagcaaagcgttagaaaaagtcgctagcgtaagtgataaagatattggcactatcttaaaaacagtcggtatgacgttactctctcaagtcggtggggctagcggccctttatacggcactttatttatcaaaggttcgcaaattgctaacggtaaagaacagcttacctttgaagaacttgttagcgtcttcaaagctggggtggaaggcattgttgcgcgtgggcgagcagaatcgggcgataaaaccatgtgtgacgtttggcttccgttactagacgaattagctcaagcagatccgtctcagcctgaagccgctctacttcaacaagcggtcgaaaaagccgaaaactttgcaaatgcaacggtgccgatgatagcaaaaaaaggacgtgcaagctatttaggcgaacgtagtatcggtcatgcggatcccggtgcaacgtcaagctattatttaatcaaagccttagcggaagcggttaaataggagtaatgatggttaatttagtgattgtttcgcatagcaaacaacttggagaaggcgtggcagaaattacacgccaaatggcacaaggatcgtgccaaattgctgtagctgccggtattgatgatccggataatccgattggcacagatgcggtaaaaattatgaatgcgattgaagaagtattcagcgaagacggtatagtaatctttgtcgacctcggcagtgcgattttaagtgcggaaaccgcgattgatttactcgctcctgaaaaagcagaaaaagtggtgattagctatgcaccgctggttgaaggcgcgtttgctgcggcggtagccgccgccggaggcgatgatttagcttcagtattacaagaagcaaatgaagcagctgcattaaagcagcaacaagcggtctaattttctgaaaaatttaccaaataaaaaatgaggcgaaagtgttactccgcctcatttttttgcttcaaatacgattaatagagtaatgaataaagctgacgtctaaattttggcacgataggatcgttacctaaagcagaaagaatcgctaaaaattgacttttcacttcaccatttgcactatttaaatcagctttcagccaatcaaacagtagcactaacgcctcttcatttttatgtgcttgatgtaactgatttgctaaacgaatcgcaatttccggcgttttgttatttgcataatcggcttgtaattgctgtaattcaggcgattcattcgcttgttctaacaactcgatctgtgcctgtaaaccgttccaacgactatcgcgatcttgaatcggaatctgctttaagatttctcgagcttcttccactttcttcatcacaataaaagtttctgcataaagcaatgcgaaatcactgtttttcttatcggtcatttcccaagctgatttgagtagcggtaatgcctcttcataacgctgatcttgcaacaattccaacgcttgattgaatttaagctcttcttcttttggcaaaatattggctaaacgcactcgcatttcttgctcggaaatcgccccttgaatcatatcaaccggctgtccgccggcaaaaagatacatggtcggaatcgtttgaattctaaattgagctgccaatgcttgctcttcatcacaatttactgtagctaataaaaattgcgccggattttcatccgctaatcggcgcaataatgaatccatttcaagtgaagccacttctctcggtgagataaaattaaacacgaccggtacttgtgtcgcagcattccacacttcactaaaattactttcggtgacattgacaaaataattcatactattttcctaatctaaaaaattagcaaattataccttatttttagtaagccgtttcaatcggtaaaccgcttcgttcccagccgtcaaagccgccttttacactatatacgcgatcaaagccctgctcgactaaaaattgcgccgtattacggctacttacaccgtggtaacaaattacaatcaccggttcttcataatcaacttcatctaaaaaacgcccatagctttcattggtcaaatgaaacgcatccttcgggtgactataaacataacggcgtacatctcgaatatccacaagtatcgcgccttcgttttcgattaactcccatgcttgctgcggactaatttcagtaaatgtttcgctcatattttgccttacaccttatttatatttatataacaaaaaaataacgagtaaatatagcataatctatttataaaaaataaacgagaatacctattattacgagttgaattttctgcctcacttagtataattacgaaccattttcattatacagtatcacctgtcttctatatttttatatcgtttccgaggattttatggaacaaatgcttgaacttttacaagatcatgtagattacattatcttaggtttattattattaatgagtgttgtgttagtatggaaaattattgaacgtgttctattttataaacagcttgatgtcacaaaatatgaaaccatccaagatttagagatcgatacaactcgtaacctcaccactatctcaactatcggtgctaacgcgccttatatcggtttattaggaaccgtattaggtatcttacttaccttctaccatttaggtcattccggcggtgaaattgatgccgcatctattatggttcacctctcacttgcattaaaagcgacagcagcaggtatcttagttgcaattccggcaatgatgttctacagcggttttaaccgtaaagtagatgaaagcaaacttaaatggcaggccattcaagcccgtaaagccaatcaataagcggtcaaatttcacttattttttgcaactcaatcaggtttcttatgaaaaaatttgacgaaattaatattattccgttcatcgacattatgttggtgctattagcgatcgtgcttgttaccgcctcatttatttcacaaggcaaaattcaagtgaatgtgccgaaagcaaccacgactcaagcgatgaaagcggatgaattagctaaacttcttacgatcacagaaaacaacgagttctatttcaacgatcaaccaattactaaagaagcacttactactgagattgccacttgggacaaaacccaaaaagtaaccttaaaagtagatggtgcggtggcatttgaaaaatttgttgaactcaccgatgtactctctgcgaatgaaattaaaaacgtcgctatcgtaacgaagaaagatacagccaagaaataggatacgagtatgaagaaaaaacattctcgtatcgggttaatcagttctattgttattcacacctttgtttttgccggtttcatttcgatagtaaaaagttctcattcggacggtcagcctgaagataatgtaatgtcgatggaattagttgccgctttattagaacagcctcaagttgcggtggcagaagaacaacctacacaagcggaaccggaaaaacagcaagcagaaccggagccggaacctgaagcagagccgattcctgaaccgaagccacagcctaaacctaaagaaaagccgaaggaaaagccaaaaccaaaagagcaaccgaagcctaaagaaaaagaaaagcctaaaaaagagaaagctaaagataaaccgattaaggcattagaaaaagggccggaagccaaacaaggtattgtcgcaaaagccataccgaatgcagtgcaaggtactcaagcacgagcgggcatcccgaatggtaaaccaaacggtaatcctaacggtacatcagcgaacggctcacaaaatggtgcggcaggtggcagtggcagcggaagtaatggtagtgaaatcggagcttataaagctgcattacagcgagccttacaacgtcgagctaacaatgcctatcccgctcgagaaaaaatgatgcgtaaaacaggggttgttactattggttttaccgtatcgtcttctggcgatttaaccaatgtaaaagtgttaaacagttccggtaacagtaatcttgataacgcagcagttaaagcagcgcaaagcaccaaagtgtcaccgccaccgtctggtttcccaagtagtgttactgttccggtaaaattctcgattgaataaatcttaccaataagctcccctgcgggagcttattttttattcgttataagcggtcattttttactaaaattttgcaaacatcagcaaaagataagcgcttgcctaaagcggggtgcttaagtaaaataaactgtttctatttttattatacaaattgaggaaaatgtaatgtttggaaaaggcggcttaggcggtttaatgaaacaagctcagcaaatgcaagagcgtatgcagaaaatgcaagaagaaatcgcacaacttgaagtaaccggcgaatctggtgcaggtttagtaaaagtaacaatcaatggtgcacataactgccgtcgtatcgaaatcgatccgtcattaatggaagacgataaagagatggtggaagacttagttgccgctgcattcaatgatgccgttcgccgtgcggaagaaatgcaaaaagaaaaaatggcaagcgtgactgccggtatgcaattaccaccgggcatgaagttcccattctaatttagtgataatggataggcgcttttgcaactatccattattaattttcaactatccattcctatttatgcaaattagccctttactcgaaaaccttatggaagccctgcgtgcattacccggtgtcggtccaaaatccgcacagcgtatggcatatcatttattacaacgcaatcgttccggcggagtgaacttatcgaaagcattgagcgaagcaatgacacatatcggtcattgtcgttcttgtcgtacgtttaccgaagaagacgaatgcaatatttgtaaaaatcctcgtcgtcaaatgagcggtcaactttgtgtagttgaaatgccggaagatattcaagcaattgaacaaaccggacaattttcagggcgctattttgtattaatgggacatctttccccattagacggcattggaccgagagaaatcggcttagatctattacaaagtcgtttagagaacgaatcttttcacgaagtgattcttgccaccaatccaacgattgagggagatgcaacggctaattatattgcggaaatgtgccgcatccacaatgtgaaagtgactcgaattgcacacgggattccggttggcggctcattagaaatggtagacggtacaaccctttcccactcttttgccggcagacgagatatttcgttataaggtgaaaaggttatttggctagtcataaaagtctgatacaatcactcaggtattaatcactagaggttatcatggaaactatcgatactattgaaaaaatcaaaaaacaaatcagcgaaaacccaattcttctttatatgaaaggttcgccgaaattcccttcatgcggtttctctgctcgtgcggtggaagcggtaattaactgccaagtaccattcggttatgtagatattttaactaacccggatattcgtgctgaattaccaaaattcgcaaactggccgactttcccacaattatgggtagaaggcgaattaatcggtggttgtgacatcgtattagaaatgttccaaaaaggtgaactacaaaccttattaaaagaagttgcggcaaaacacgcttaattctttgacaaacattcagcccaagcaattcgcttgggctttttttcgacaaaaaaatgccattttgctcttacattccgcttcgtttttggcttacaatgtaaaaattcatttgtaagaaataacaataaggacacaacaacatggctttaaaagatttagattgggctaacttaggcttttcctacattaaaacggattatcgcttcatcgcacattggaaagatggtaaatgggatgaaggtcaattaaccacagataacactctccacattcatgaaggttcgaccgcacttcactacggtcaacaatgtttcgaaggtttaaaagcctatcgctgcaaagacggttctattaacttattccgccctgaagaaaatgcaaaacgtatgcaaggtactgcacgtcgtttattaatggcggaagtgccgactgagttatttgtgcgtgcttgtaaagaagtagtaaaagcaaaccaagattggttaggcccatacggttcaggtgcaacactttacttacgtccattcttaatcggcgtgggtgaaaatattggtgttaaagcggcaccggaatacattttctccgtattctgctgtccggtgggtgcgtattttaaaggtggtttagcgccgtctaacttcatcacaaccgactacgaccgtgcagctccaatgggaaccggcggagttaaagtgggtggtaactatgcggcaagtttattaccgcacgaattagcgacagaacaaggtacagcaacacgcaaatttgccgatgcgatctaccttgatccgaaaactcacactaaaattgaagaagtgggtgcagcaaacttctttggtattaccaaagataataaatttattaccccagcgtcagaatcgatcttgccaagtattaccaaatactcgttattacatatcgctaaagagcgtttaggtatggaaacgattgaaggcgatgtatatatcgatcaattagatcaattcgctgaagccggcgcttgcggtacagcggcggtaattacaccggttggcggtattcaacataaagataacttccacgtattctattcggaaacggaagttggcccagtaacaaaacgcttatatgcggaacttaccggtatccaattcggtgatgttgaagcaccggaaggctggattgttaaagtagaataatccgatttaagctatgacaagcggtaaaattttgcaatttttttgcaaatttctaccgcttgttttctttcaaacataaggaatattatgattaaacgcattgatgtcagtaaacgtttctctgaagttgccatttataacggcgtggcttatctcgccggtcaagtgccgacagacgatagccaagacgcttatcagcaaaccaaacaagtgcttgcggaaattgataaattcttagctaaagctaataccgataaaagtaagatcttaatggcaaccgtttatcttgccaatatggcttattatgatgaaatgaaccgtgcgtgggacgaatgggtggcggaaaacaatgcgccaccacgtgctgcggtggaagcaagacttgcaaatccgaattggaaggttgaaatcgtagtgaatgctgcggtataactaaaagcgtggggctgaacaggcttacccacgcttttttactataggaggtaatatgcgatccccattttatcgtcaggcgcatatattcttaatcggtggtgcagctgatcaagaaccttattattttgttggcccgctccgcaatatcagcctagcaaaacaacggctggcaagaaaaattaaaagctgtattcctaattacgagcaaattcatattcatacgctcggttacaaccatatttttcatcttagcgacattgaattaaatgtactcatcaaaattcagccgcaagatcttatctatattatcggacacagtttaggcggctggaatgcaccacatctggccggaatactaaaagacaaaggctatcgcgtacgtttgctcgcaacccttgatccggtgggagaagggacactcgtttggcttggttcaaatatctataaaacaccgcaaccccaacccaatgccgatttatggattaatattcgtgcggaaaccaaagctgaacacgatttatccgatattgttgctcgcctcggtcaacagtggaacttaaccaacgaaccggatattaatcaaacactcaatattcaccacgctaatgcgcaacgaatgctaagtacgaaattacaaaccggaaaatcaattctggattacctcattgagaatcttaaacagctattgtgattcttactttacgattcattgcttacagagaaataaaaaccacggaatacaccgattacacagaaaatatccgagtaatcagtgtattccgtggtgaacatttatcttactgttccaccataaaacaggctattttggtgccgttttcatagctttttaattgaggttgttccgctttacatttttcggttgccaaacgacaacgagcgtgaaacgcacaacctttcggcggatttaacgggcttggtaattcaccggttaatttaatccgctcacgacgttgctccggatttaaacgaggtgttgccgaaagtaacgcttgggtgtacgggtgacgaggattactgaaaatcgctttagtttcgccttgctcgaccactcgtcctaagtacattaccatcacttcatcggcaatatgctcaaccaccgacagatcatgcgaaatgaaaacataggaaagccccatctcgtcttgcagatccatcatcaaattaagcacttgcgcacgtaccgatacatccaatgccgaaaccggctcatccgccacgaccacatcaggattgagcattaaacctctggcaatcgcaatacgttggcgttgcccaccggaaaacatatgcggatagcgatcgtaaaactcaggttttaaaccgactttgcccatcatttctaacactttcgctttacgctctgctgccgataaatcggtattgattaataacggttcttctaaaatgctacccacttttttacgcggattcagcgagctataagggttttggaacacaatctgaatttttttacggcgtaatacagcggtatctttatcattgactaagaaattctgccctttataaaacagctcgccttcagtcgggctttcaatcatcgtgagcattcgccccaaggttgatttaccacaaccggactctccaaccaccgccaatgttttgcctcgttccaattggaatgacacaccgtctaccgctttaaccgttttcggtttagcaaacaaaccttgcttaaccggataatattttttcaaatttttcgcatcaagaagcggtgcgttttgttcatttttttgcaaatcagtcatttcgcttctccgttattgttgtgtagttggcacaccattttcatttaatggaaaatggcatttcacttggcgaccgtttaaaactcgtaattcaggctcgctggcacggcatttatccgttgcatacgggcaacgaggattcagcaaacagccttgcggtcggtcgtatttaccgggaaccacaccgggcaacgattgtaaacgagatttaccttcggcaaattcaggcaacgctttcagcaatgcttgcgtataggggtgaagcggcgctttaaagattaattctgctttgccctcttccaccacttgccctgcatacatcacgataatgcgatgtgccgattctgcaaccaatgctaaatcgtgggtaatcagaatcaacgccatattttctttgcgttgcaattccaataataaatcaataatttgcgcttgaatcgttacgtctaatgcggtggtcggttcgtccgcaatcaataatttcggattgcaagcaatcgccattgcgatcatcacgcgctggctcataccccccgaaagctgatgcggatacacctctaaacgagattgtggatccggaatccccaccatcgtcaataactcaatcgcacgttcacgacgggtcgcttttgagccaccttgatgcaccttcaacgcttccataatttggaacccgaccgtataacttgggttaagactggtcatcgcatcttggaaaatcatcgacacgtccgcaccgacaattttttgtttttctttcggttttaacgctaataaattattgccgttaaactcaagcgaatttgccgtcacacgaccgggaaagtcaattaagcccataatcgctaacgagctaaccgacttacccgaaccggactcgccaacaatacctaatacttcgccttcgttaatcgtgtaactgatacgatctaccgctttaaagggggctttctcatcaccgaaatggacagaaagctgatctaccgttaataaagccatcttgctctccttattgtttcagttttggatcgagtgcatcacgtaagccatcgcccattaagttaaatgctaatacaagcgataaaatcgccagccccggaatggttaccaaccagtttgccgattgcataaaaccgcgtgattccgccaacattgtgcctagttccggtgtcggcggttgtgctccgatacctaagaagccaagtgcggcaagttctaaaatcgcattggaaatccccatcgtcatttgtacgattaacggggctagacagttcggtaaaatcacgataaacattaaacgtaatacaccggcgccggcaactcggctcgcgaccacataatcacgatttttttcgctcatgaccgaagcacgggttaaacgtacatagcttggaatcgatacaaccgcaatcgcaatcgccgcattaatcaaggaagggcctaaaatggtgaccacaccaatagtgagaagtaggctcggaattgccaacataatatcgacaaagcgcataatcacaatatcaatcacaccaccgtaataaccggcaagtaagcctaaaattacgccaaatacgcatgataaaacaacgatcactaaaccgataaacacagataagcgtgcaccgtaaataatacgagaaagaatatcacgcccaatatcatcggttcctaacagataagcggaattaccgccgtccatccacgccggaggcaatagtaaagcactacggttttgctcaatcgggtcaaaaggggcaacccaacctgcaaataccgcagcaaaaaagacaagagtaataaaggcaagcccgataaccgcaccacggttttggcaaaaataataccaaaactcttgtaaaggtgtcttcggagccggtgccgaaagggttgttgaagacattatgtatctcactccattcaaatcattttgcaaaattttgcgtaaatttaaccgcttgtaaaagctgaaaaataggcttagttatggcgaattcttgggttaactacaccataaattaaatcaacggttaagttcactaaaataataatcgtcgcaataattagcactgaaccttgtaaaaccggatagtcacgagcattaatcgcatcgataatccatttaccaatacccggccacgagaaaatattttctgtaagtaccgccccagaaagtaactgccccacaatcagtcccactacagtaaccaccggaatcaaggcattacgtaacgcatggacaatcacaatgcgagtggtattcaaacctttcgcttttgcggtacgaatataatcttcgcctaacacttccagcattgaagaacgggtcatacgcgtcaccactgccaatggaatagtgcctaacacgatcgaaggcaaaattagtgatttaattgcggcaataaatgcccccgactcatctgaaacccaagtgtcatacagcataaagccggtttccgcttcaatccaatattcggaaggtaaacgtccggaagccggtaagcctaacggtgtggaaaaatagagaattaagattaagccccaccagaaaatcggcatcgaataaccggttaaagataaagtggttactgtatgtgaaatccacgaatctttcttcaccgcagcaattacaccaaggaaaatcccaaatatcagcgaccataacaacgcaaagaaggctaattcaaccgttgccggaaacagtgtgaaaaactcttttaacaccggctcattgttacgaaatgaattaccgagatcgccctgaaacacccctttaatataattaaaatactgctcatgcagcggtaaatctaaaccgagctgcgccatcatctgagcgtgaactgccggatctaagccacgctctcccatccgaatttcaatcgggtcgcccggaattaaatgcactaaggcaaaagtaattaacgttatcgccaaaaaggttgggataaccatcaaaagacgtttaagaataaatgaaaacattaggtaatactcattatttgaaccacggaaaatatgaaaaacacggcattaagcggtaaaattcagcgaattttttacaaatagccgataactctctgccgtgcttttcaatggttaataagagaacttattttgcctctaaatcaacaccgtagaaattatgtaagctaaatggactaatcacataacctgttacttccttacgaaccgggaaataagtggttgagtgagcaatggttacccatggtgcttgttctttgaaaagtacttgcgcttgtttataaagctcggtacgttttgctttatcagttgtttgaactgcatcggtcattaacttatcaaaatctttatgacagaattttgcatagttagaaccttgttttaccgccgcacaacttaataaggtatttaggaagttatccggatcgccgttatcaccgttccagcccatcataccggttgtatgttcgccgtcacgcatacgattgagatattcaccccattcgtaactcacgattttggcattcacacccacttttttccaatcttcttggataagctccgccatacggcgtgcattcgggttatacggacgagaaaccggcattgcccacacttcggtatcaaaacctttttccaatccggcttcttttaacaaggctttggctttttccggatcatagtcataatccttcacttcatcgttatagctccacattgtcggtggaatcggatttttcgctttttcgccggaaccttgataaacagactgaataatcgcctctttattaatcgcatagtttaacgcttgacgcactttcacatcatcaaacggttttttctgcgtattgaaatgtaaatagccgatatttaaacccggtttggtcattaaattgatattcggatcttttttcaatgcttccagatcagccggattcgggtaaggtgcggcatggcattcacctttttgtaatttcgccatacgcaccgatgcatccggtgtaatcgcaaagactaaacggtcaatcgccggtttaccttcccaatattgctcaaagcccttgtaacgaatctgagaatctttttggtaatcaacaaattggaatgggcctgtaccaaccggattttgatctaatttttccggcgtacccgcttttaataatttctcagcatattccgcagagaaaatcgaagcaaagtccattgcaatattcgctaagaatggtgcattcggcacttttagattaattttaaccgtataatcatccactttctcaacattttgaataatattgcccatatccataccgataaaatattcatagttaccaccggataccttatggaaagggtgattcggatctaattgacgattgaatgagaacactacatcgtccgcattaaaatcacggcttggtttaaaatctttagttgaatggaatttcacccctttacgtaaataaaaggtataacttttaccgtcttctgacacatcccatttttccgctaaagaaggcataactgaagtttcccccttagcgaaatctactaatcggttaaaaatcgtttggctggtcgcatcaagcgtaccaccgtctgttgcaaattgaggatttaagtaagtaggtgaggcttctaagcagtagacgaatgttttaggtgtagccaaagccgaactcgaggcggcaatagccaatgagaacaaagaaagttttgtgagttttttcattgaatgctccaatgttgtgtttgttttttatttttatgaattaatcgaatatacaagtttttcgatgaagttcaatactttttcagtaaaaagcggtctaaatccaacgaaaatttgcaaatttccgcaaaatttagaccgcttatcatatttactacaatctattaattatttcctaactccgctcgatagaagttatgcgataagaaaggactaaccgtatagcctgttacttctttacgcatcgggaaataagttgttgaatgtgcaatcggcaaccaaggcgcttgctgtttaaaaattacttgagcctgtttataaagtgcttttcgctttaccttatctggctcttgcgctgcttgcgtaactaaatcattgtaagatttatcacagaaatgtgcataatttgagccttgtttgaccgcattacaacttaataaagtatttaagaaattatccggatcaccgttatcgccagtccagcccatcataccggttgaatgttcgccttgttccattcgcttgaggtattctccccattcaaaactaacaattttggcattcaccccgatttgcttccaatcctcttgaaccatttcagccatacgacgtgcattcggattatacgggcgagaaaccggcattgcccataattccgtttcaaaaccattttccaagccagcttcttttaataacgccttcgctttttcaggattatattcataatcctgaatctcatcgttatagccccaaattgtcggcggcatcggatttttagcaacagaaccagtaccttggtacactgattctaaaatcgcttgtttatttaccgcataattgagtgcttgacgtactttctgattatctaacggtttcttatccaaattaaaagtaatataaccaatgtttaagccagatttttccaatacttgtaagttagtatccgctttcatctgagcaatatcagctgggtttggatacggcattgcctgacattcgtttttctgcaatttggcataacgaacagtcgcatccggcgtcacactaaataccaagcggtctaatttcgctctgccttgccaataatcatcgaaagctttaaaacgcacataagcatctttttgtaaaccagcaaattcaaacggccctgtacctatcggtgcggtatcgactttttccggcgtgccggcttttaacatttggtcggcatattcagcggaagaaatcgaagcgaaatccattgcaagatttgctaaaaacggcgcattcggcacttttaagtggaatttgactacataagtatccactttttcgactttttcaatgatattaggcatatccatacctaagaaaaactcatagtttccgcccgaaacattatggaaataattatatttatttaattggcgattaaagacaaacaacacatcatcagcattgaaatgacgagaaggggtaaattctttattcttatgaaacttaacccctttacgtaaataaaaggtataggttttaccatccacagaaatatcccatttttcagctaatgaaggaataagatttgttgtacccggttcaaaatcaattaaacgattatataacgcttgtgccacatctaatgttgcaccgtctgtgccgatttgcgggtttaaaaaagtaggcgaagattcaatacaataagtaaatgttttaggagcagcgagtgccgaattagagaaaagtaacaacgtaaacgctgataaagagaaaaatttttgcatgaaataccctgatgttgtgctataaattattttttgaataatttacatattatcagccctatttcatattgcaacgttcaactgcaaccttttattacccctcataagagataagactaactttattcattccactctgacaagcggtcaaatttccctgccgttttgcaaatcattagtaaggcagcttaaatcagcaaaaaggaaaaaaggaaaggagaaaatgaaagtaaagataaggatgaggttgaggctgaggctgagaataaggctctggataaaacaacatcgttgtccgttgtaaaaaagcaaaaaccccgtggttatcgctaaccacagggtcctaaattcaatctggcgatgccctactctcacatggggaagccccacactaccatcggcgttactgcgttttacttctgagttcggaatggagtcaggtagagccacagcactctggtcgccagaatattctgttgatgtcttttgtcttctttctttgtctttgttctttcttcttaaattcgaaacaagctgctactgagtgtagtgctcaaaaacacttgagcgttgtatagttaagcctctcgggcaattagtatctgttagctcaatggctcacaccacttacacaccagacctatctacgtcgtagtctccaacaacccttaccgacttatagtcggggagaactcatcttgaggcaagtttcgtgcttagatgctttcagcacttatctcttccgcatgtagctacccagcaatgcctctggcgagacaactggaacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattacactaacctcacgatgtccgaccgtgattagcaaaccttcgtgctcctccgttactctttgggaggagaccgccccagtcaaactacccaccagacactgtccgagaccgcgttccgcaatcttcgttagaacatcaaacgttaaagggtggtatttcaaggacgcctccaacaacactggcgtgtcatcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgaccggttcaaccttcgagagtaaatctctacaatctacgccggcgcaccttctcccgaagttacggtgctattttgcctagttccttcacccgagttctctcaagcgcctgagtattctctacctgaccacctgtgtcggtttatagtacggtttagtataacctgaagcttagtggcttttcctggaagcgtggtatcggttacttcatctccgtagagactcgtcatcacttctcggtgttaacggaattccggatttgcctaaaattcccacctaccggcttaaacagacatccaacagtctgataacctaaccttctccgtccccacatcgcagttataccaagtacgggaatattaacccgtttcccatcgactacgcttttcagcctcgccttaggggccgactcaccctgccccgattaacgttggacaggaacccttggtcttccggcgaacgagtttttcactcgttttgtcgttacttatgtcagcattcgcacttctgatacgtccaccaaacttctcaattcagcttcatccgcttacagaacgctcccctacccaacagtctttcgactgatgccgcagcttcggtgactagttttagccccgttacatcttccgcgcaggccgactcgactagtgagctattacgctttctttaaatggtggctgcttctaagccaacatcctagctgtctaagccttcccacttcgtttcccacttaactagtactttgggaccttagctggcggtctgggttgtttccctctccacgatggacgttagcacccaccgtgtgtctcctgagtatcactcttcggtattcgcagtttgcatcgggttggtaatccgggatggacccctagccgaaacagtgctctacccccgaaggtgtccgctcaaggctctacctaaatagatttcggggagaaccagctatctcccggtttgattggcctttcacccccagccacaagtcatccgctaatttttcaacattagtcggttcggtcctccaattagtgttacccaatcttcaacctgcccatggctagatcaccgggtttcgggtctataccttgcaactaaaacgcccagttaagactcggtttcccttcggctcccttattcagttaacctcgctacaaaatataagtcgctgacccattatacaaaaggtacgcagtcaccccacaaagaggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgtcgttagcttagtaccacaatagacacttcgaatacgggactatcaccctttatagtcgagcttcccagctcgttcttctgtgtctactgctatcactaacaggctcttccgctttcgctcgccgctacttacagaatctcggttgatttcttttcctcggggtacttagatgtttcagttctcccggtttgcctttactacctatgtattcagtagtaaatactagattcttcatctagtgggtttccccattcggaaatcttggattaaacgcttcttatcaactcatccaagcttatcgcagattagcacgtccttcttcgcctctgattgccaaggcatccaccgtgtacgcttagtcacttaactatacaacctcaaatgttttcaaatcttattcaaatccattcaatgctgtattttattcaactaaacacttgactgcttttgttcagtcaagatttttttaactactcagactttctttcgaaaatctctcagtttttcagcttgtttccaattttttaaagaacaatttaagacaataatttgacttatcatcatgactaaataaacaaatcttttacttattcacttagtcatgatgattggtggagataagcgggatcgaaccgctgacctcctgcgtgcaaggcaggcgctctcccagctgagctatatccccatacatcatgactgaacataatctcacctttcagttttcactcgtttagagtggtgggtctgagtggacttgaaccaccgacctcacccttatcaggggtgcgctctaaccacctgagctacagacccaaaaggatgccggattatgtccgttttcgtcttctcttctatcaaacaatctgtgtgaacacttgcagtcgcttaattcttggtaaggaggtgatccaaccgcaggttcccctacggttaccttgttacgacttcaccccagtcatgaatcataccgtggtaaacgcccccccgaaggttaagctatctacttctggtacaacccactcccatggtgtgacgggcggtgtgtacaaggcccgggaacgtattcaccgcaacattctgatttgcgattactagcgattccgacttcatggagtcgagttgcagactccaatccggacttagacgtactttgtgagatttgctccatgtcgccatattgcttccctctgtatacgccattgtagcacgtgtgtagccctactcgtaagggccatgatgacttgacgtcatccccaccttcctccagtttatcactggcagtctcctttgagttcccggccaaaccgctggcaacaaaggataagggttgcgctcgttgcgggacttaacccaacatttcacaacacgagctgacgacagccatgcagcacctgtctcatggttcccgaaggcactctcgtatctctacaagattccatggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagcttcgggcaccagacttaaagtccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttgaccagtatgaaatgcaattcccaggttaagcccggggctttcacatctcacttaatcaaccgcctgcgtgccctttacgcccagttattccgattaacgctcgcaccctccgtattaccgcggctgctggcacggagttagccggtgcttcttctgtagttaacgtcaattaccaaatctattaaatttgataccttcctcgctaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatctcatggcatgtggccttgcggtcccacactttaatccgaagatattacgcggtattagctacagtttcccgtagttatccccctccatgagccagattcccaagcattactcacccgtccgccactcgtcacccaaggagcaagctccttcgtgctaccgttcgacttgcatgtgttaagcctgccgccagcgttcaatctgagccatgatcaaactcttcaattcaaaaagtttaatcgctcaataaactgcttagctaaagtttacatattacttcaaaagtaaaaatgaatttctagtttaagcacctattaagacttcaaaatcaaaaatattttttcaattaagtcaatcaacaagtgcccacacagattgtctgataaattgttaaagaacaaaaagaaacgacgcactggcaatcaattttaaatcgttcacaacagtgcgtcgttgtgtgaggtgcattatagagaaatctaaaatccttgcaagcactttttgcaaaaaactttaaaacaattctcccttcgcataacatttattcaaattgagtaaaacaagagcatttttgagtaattttctgataacttttgactatatgtctgattttgtgatcttcctcacaaaattattggtactttttcgagaagttactggtattatatatgccattatccttattcatctatttttataattttatataaagaggaaccttttatgagtcaattagatgctttacgtgaaatgactgttgttgttgcagataccggtgacattgaagcaatcaaacaatatcaaccgcaagatgcaaccactaacccatctttaattttaagtgcgtctgcattaccgcaatacgcatcattaattgatgacgcagtagcttatgctaaagcaaaaagtgatgataaagctcaacagcttattgatgcagaagataagttagcagttaatattggtttagaaattcttaaaatcgtaccgggacgtatttctacagaagtagatgctcgcctttcttacgatacggaagcaacaattgagaaagctcgtcaaattatgaagctttataacgaagcgggcattagcaatgatcgtattcttattaaaatcgcttcaacctggcaaggtatccgtgcggcggaagtgttagagaaagaaggtatcaactgtaacttaaccttattattctctcaagcgcaagctcgtgcgtgtgcagaagctggcgtttacttaatctctccgtttgttggccgtatcttagactggtataaagcagcagagaaaaaagaatatgcaccggcagaagatccaggtgtaatttctgttacgaatatctataactactacaaacagtacggttatcaaactgtggttatgggcgcaagtttccgtaacgtaggtgaaattaccgaaatcgcaggctgtgaccgtttaactattgctccaccgttattaaaagaacttgctgaaagcaatgctccgcttgttcgtaaattagaatataaaggtgaagtgaaaactcgtccggcaccattaacagaagcggaattctactggcaacataaccaagacccaatggctgttgaaaaattagcggaaggtatccgtaaatttgcagtagatattgagaaattagaagcaatgcttgctgctaaactttaattactgaatgattgaaacaaaaatcccaagcgaatgcttgggattttttatgcgatttagataagcaagcggtcaatttctcagaataatttgcaaattcttaaggaaaattaaccgcttgtcattttgtcatttgatagtgctaagctaaattggctgtctcggtacagaaccttgataaccgaattgacgccatgcttcatatacaacaacagctaccgtattggataaattcatactgcggctgtctttgcacattggtactcggattttttgcgacatcggtaaactatccaaaatcgccatcgggataccacggctttccggcccaaacatgaggaagtcgcctaattcataactcacttcactatgattcggttcgcctttagtcgttagcgcaaataaacgttttggtttcgcacgttctagaaaatcttcaaaattcttatatttttgaatatcgacaaactcatgataatccaagccggaacggcgtagctttttgtcgtcccacgcaaaacctagcggttcaatcatatgtaatctaaaaccgcaattcgcacataagcggataatattaccgctgttttgtgggatttccggttcatataaaacaatatctaacatttttatttaccatcaaaatatggaatgcacaaaactttccgtgcattccgtgattattaattttcaatatggcgaatgatccaacagttatggatttgcggattacgctcaaaatcaagcggtaatgttttatgtgaaatattttccgcttgtaaacctaattcggttaggccttcgaaatccattttaaaaccacgtttattattcgagaatacgattgtgccgtccgctgtcaaaatgcgtttaagctgcatcattagcttaatatgatcgcgctgaacatcccaactgtcttccattcgttttgaatttgagaacgttggcggatcaacgaaaatcaactcaaagcgttcccgacattccgccaaccactgtaagcaatcggcttggaataagcggttattacgtagcggtaaattatttagctctaaattttgttccgcccaattcaggtaagtatttgacatatctaccgtagttgtggacttcgcaccgtttaatgcggcatgaatggtcgctgaacctgtgtaagcaaagaggtttaggaaagtttttccttttgccatctgccctaccattttacgtgttagacggtggtctaaaaataagccggtatcaagataatcggttaaattcacccataattttgtaccgtattcggttacgtagaaataatcgcctttattagccaatttctcatattggttcgtgcctttttgcttttggcgaacttttaataccaacttattggtttccacgcctgttacatacaaggttgcagacacggcatccagtaagcgttggcgagctttttgttcgtcgatgtttttcggtgcggcatactcttgtaccacaatattatcatcatagcgatcaaccgctaaattatattccggtaaatctgcatcatataaacggtacgcattaataccttgctgcttcgcccatttttcaattttcttaatatttttcgttaaacgattcgcgaaatcaggcgcaacttgtgcattctgttcaaatttaagttcatcagcttgctgttctgtcgctgtacgctcactaatttggtaattcttttgtaaacagtctaacggaccgtttttcgctttgaactgacggtgtgaacgcaaacgtaaacagttcagtaattccggctcgccactgaaaatagacgcattccaaccgccaaattgttgttttaaacgttgtccgaacaccgaataaagagcaattaacgccggtgttgtgcctaaacgctcaccgtacggcgggttacaaatcacagtgccaacttgtgccggacaaggattttttaacgccgctacatcgccttgttgccattgaattaaatgtgctacgccggcatttttcgcattctgttttgctttagctaatacgcgatgatcaaggtcgaagccaaagaaaagcggttgaatttcttcattttgttgcaaataggcctgctctaacacttctttccaaaccgcttgttgatgtcctttccacgcattaaagccccaatgcttacggtgtaattgtggtgcaatccccgcttgcatttgtgccgcttcaatcaacaacgtaccggagccacacatcggatcaaccagcggagtgcctttttgccagccggaacgaagaataatcgccgctgccaatgtttcacgtaggggtgctttacctgtgtcttcacggtagcctcgcatatgtaacgcatcaccgcttaaatcaagcgataccaccatattttctcggtcgagataaacgtgaattcgaatatctgcatgatctttgtccacggtcgggcgagcgaagcctttacgttcaaaataatcgactacaccgtcttttactcgcatcgcaccgaattgggtgttgcggatctctcggttagtcccgttgaaatcgacaaagaaagtatcacgaggatcaaaaatttccgcccagttgataccgacgatcgttgcgtataaatccagatcactaaaaattttggtggttaccaacggtaataagatacgagaagccaaacggctatgtagtaatgcctgatatgctcctcgttgggtcgttgtaaaatgcactccaccttgtgcaactttacactcagcttcacagatctgctccagttctgtttttaacatttcttcaaagccacgagcagcagtggcaaaataagttgtttgagtcgtcattgttatcattcttttagctaaaattagcgctattatagcggaacaagcggtctaatagttgaaaagttttacaaatcaacaggaaatttaactagacaagaaattggctaagatcaaaaatgtttcaaattacccaaaatgggtaacttgctttaggtaagtataaccctcaaaatttatgccaatttttattggaggcacaaaatgaccgaaccttataaaattcttttgattgatgaccacccgcttatgcgtcaaggcatgcgtcaaattcttgaactagaagataattttgttgtaattggggaagcaagtaacggtactgacggcattgcgttagcgttagataaagatcctgatctgattattttagatttgaatatgaaagggatctcaggtttagacactttacgttctctacgcacgcatggcgtggatagccgtattattgtcttaactgtatcagatgaacaatccgatatttttgcgttgatggatgccggtgttgacggctatttgcttaaagacagtgatacggctgatttagtcgaaaatattcgtagagcggcaaaaggtgaaatggtcttaagtgaagcggtacagcaacatttattagatcgccgcccggaaaatgatccgttaagtgttttaaccgaccgtgaacgtgatgttttacagtggatcgcaaccggtatgtcaaataaacaaattgccggtcagttgttcatttcagaagagacagtgaaagtacatattcgtaatttattacgcaaattaaatgtgcattctcgtgtagccgctaccgtgctttatctagaacaacaaaaaggctaagcaaatttatctgcaaaaaagaggagcaattgctcctctatttttttatgcgatgaaataaatactttgatagggtgcaagccaaatcccatgttcggtttgcgagacttgttggtaattattcatcaaaattcgaccgcttgtttcaatattaacgagctgcttctccgcacttaaattggcaacaaccgttaagctctcttgcgatgtttgacggcgatacgcccaaaccagcggatgttccggcagtaaatccgtataatcgccattcgttaagaccgccaatttcttacgtaacgcaatcaatgattgataagtgtagaacaccgaatctttatccgccaaagcttgttccacattaatttctcggaagtttttcgccacatcaatccacggcttaccacttgaaaaacctgcattgtcagttgcatcccattgcactggtgtgcgtgagttatctcgcgatttttgcgccaaaattttcagaataagcagttcattttcacctttttcttgcaattctgcataagcgttgaggctttccacatctcgatattcggcaatgctagtaaagttcgggttggtcatcccgatttcttcgccctgataaatatacggcgtgccttgcattccgtgtagcaacatcgctaacatttttgccgacgtggtacgaagctcaccttcatcaccaaagcgagacacaatacgaggctgatcgtgattacaccagaacaacgcattccacgctttgttgtgcattccctgttgccaatagttaaaaatcgacttcagttccacataatcaggttgagcatacgtccatttttcaccattcgggtaatccactttgagatgatggaaattaaaggtcatcgaaagctccgtgcctgccaaatttgcatattgctggcaatgctcgagcttagtcgaagacatttcgcccaccgtcatcaaaccataaggagtaagcgctttttgattgagttcttgcaaatgttgatgaattttatatccatcggtgtaaaaacggcgaccatcgccctcaaagtcgtcttcatagtgttcaggtttagaaatcaaattcaccacatctaaacgcaaaccgtcaatgcctttctccgcccaaaaacggcaaatatcaaataattcggcacgcaagtgaggattttcccagttcagatccgcctgttctggggcgaataaatgtaaatagtatttttgcgctttatccgaccatttccacgctgagccaccaaatttcgatttccaattagtcggagtttctcgccaaatatagaaatcatgatattcagattgcggatcttcgccttgcttgaaccattcatggaaagttgaactgtggttaaacaccatatccatcacaatgcgaatattgcgtttgtgagcctctgcaatcaattgctcaaagtctgccatcgtgccgtaacttgggtcgatttcacggtagttagcaatgtcatagccgttatcaatttgcggagaaacgtacatcggtgtaatccaaataccgtccacccctaaggtttgcaaataatctaaacgcttaataatcccctgaatatcgcccgtaccggaaccggttgtatcttggaaagatttcgggtaaatctgataaatcaccccgtttttccaccaatttttgctcattctgctttccttataaaattaacaagcggtcagattttggtaaaattttgcaaaaatctaaccgctatatatttgattattccaatgttcccgctttttctttgcgtttataaaccattgcggttagtgctagcggaacaacaatcgccactaacattgcagctgcaaacgttccccagtaaacgtgttgaattgataaaatacctggtaaaccacccacaccgataccgttcgctagcacaccggcgaagccacaaatcaaacccgctaatgccgcgccaatcatcgcacatagcattgggaagcgatattttaagttgataccgtacattgccggttcggttacacctaaataagctgaaagtgccgctggtacggaaacctcacgttcgttcgcttttttgctcacaaacacaatcgctaacaccgcagaagcttgcgcaatatttgataaagcgatgattggccaaacaggtgttccgccaatgctttgaatcatttgcatatcaattgctaacgtggtttggtgtacgccagttactacaagcggtgcataaaggaaaccaaataacgccgcaccgattggggcaaaatcgccggtcatcgaatgtttcactacgaacgcaataccgttaccgatttcacgtccaattgggccaataatcgtatgcgcaaggaacactgctacaataattgataccaccggtacaatgatgagattaagataattcggcacaattttcgtcataaagcgctcaatataagctaatgccaaacccgccataattgccggaattacttgcgcttgataaccgaccttttccactgctaggaagccaaaatcccaaacctccggaatttgcgaacctaagccgtaagagttcattaactgaggtgaaacaagagtcacccctaacacgatccccaaaattggcgatgtccccattttacgagctatcgaccaacaaattcccaccggtagaaaatggaaaatcgcctcaccaatcagccataagaaactatgcacactagcccaaaaactgctgacttgcacaagtgttttggtaccgttttcaaacatcgcaatatcgccaatcacgttgcggaaacctaaaatcaaaccgccgctaattaacgcaggcaacaacggaataaaaatatccgccatatgcgagatcaaacgttcatagcctttttgattttgacgagcagccgctttcacttgctctttatcaacattcgctaagccggttttctccaacacgattttgtagtaatcaccgacttcctgcccaataacaacttgatattgcccgcctgtagcaaaattcgcttttaccatcggtaagccttctaacgctttgctatccactttgctgtcatcatttaacacgaaacgcaaacgggtaatacagtgagtgacagtcgcaatgttttcgcgaccaccaataaattcaattaatttatccacattttgcggatcgatttttgctttggccataggaatactcctgttattggatgtttattaacctgaaaattaagttgaattatagatattggctattttttgtaaatgggaacgttccccaaaacataagtaaatttaaaatttgcgatctagatcacaaaaatttttcgttttagcgtaaaatatctgtaaatctaaattatcttttcgttttacctgtataatcgctcactttttagaatacgttgaatttatggctttactgattacccacaaatgtaccaactgtgatatgtgcttacctgaatgcccgaatgaagcaatttcaatcggcgatgatgtgtacgtgattgatccggtgttatgtaccgaatgtgtcggacattatgaaaagccgacctgccaaaaagtttgcccgattactaactgtattattccagatccggaacatcaagaaacgcaagaagagttatgggaaagatttgtgatgattcatcacccggacaaaatataaaaataaaatataaaaaaacggagaatgaaccttcattctccgttttttattatgcgtctttaaagctgtaaggcaaatcgcaaatcgctaatggaattccgttgatcctaaatgcactatccgcttcaacatcattattcatcaccacttgtagccaaagtttattttgatatgccacactgtttaagattgtgccggttgcacgccaattttcaccgagctgcatttcaaccgagccaccgacttccggcaagtttagctcaccttcgaaacgaccgactaaggtaaacatcgctcgcttatttgctccacgatattttgcacgcgctactgtttcttgtccgatatagcaacctttggtaaaagaaatcgcattttcgaccgcttgtaaattggttgcctgcggaatcaattcaaattgattcgcttttagcaacatcgggatcccgtcttgaatgtcgattaaatcccacaattggctatcggcattggtttctaaagtttcgccccaaacaatcgcacgtttttgcccttgcggaatcaccaaagcggttgtattttcgcaaagttttgccaaaatctcaccgcttgttactccataaatcggcgtatctaattcagtgaaagtgactttagaaaacaccgcatattttttcaattggttaagcgcttccggtaataaatccgcatgaatcatggcgacaaatttatctgccgcttgacgatataaacggatcaatgcactcattttgcctttcggatcacaatggcaagttaaggtatgttctccctctgccaatttcgctacatcacaggttaattgtccttgaagatatttctcagcatctacacctgcaatttcaattaaacgatactgagaaagttgcacgcagagatctgggtggctattactgattttgctgcattcacacgtcataaaaaacacctactctaaattctgaatttgctcacgcatttgttcgattaacacttttaattcaaccgctgaattggttacatccgcattaatagattttgatgccaacgtattggattcacgatttagctcttgcatcataaagtccaatttacgccccaccgctccaccttttttcaagacgttagtcgtttctttcacgtgtaattgtaagcggtctaattcttccgccacatccacacgctgtgcagttaataccatttcttgctctaaacgttgcggatctaattgtaaattcagctcgtcaaaacgttgctgtaatttatctttctgccattgcagaatttccggcatttgcgcttgtactttggttgcgatctcggcaattgtgtctaagcgttgttggatcaacgcctgtaaattcgcaccttcacgaccacgcatcgcaataaagtccgctaaaatttgttcgaaaccggctaacagatcttgcccgatttgatccaaatcttgtgtttgagcatcgaccacgcccggatagcgtaaaatatccactaagttgatctcgccctcaccggcaatgccacgcaaggtttgtagtgagctgattaccttttccgcatactctttatttaatgctaattcactgttttggttattacttaattcgatacgtaaactacattccactttcccgcgtgttagtgaggcacgtaaacgctcgcgcaaggtcatttctaaattacggaattgctccggcaaacgaaaataagtttctaaaaaacgttgattcaccgagcggatttcccacacggcattaccccactcttttttaatttctaaatgggcgaaagcggtcatactataaatcattttgtgttccttcttgttaattaacctcggaatatcactgaaaaacacggaaagatttttgcaaaattttcggaaaatttaaccgcttgcagtccttcaaaaaacctttccgtgtatttccgtattttccgaggcaataaaaatcacattgtactgttttatttgttaaaatggcgaaaattttttagtaaaaggaagaaatcatgcgcccaaataatcgtgaactgaatcaagttcgtccggtaaaaattactcgtcactatactcgttatgcagaaggttccgttttagtcgaattcggcgaaaccaaagttttatgtaatgcaaccgtggaagaaacggttcctcgctttttaaaaggtcagcaacagggctgggtaaccgccgaatacggtatgttgccacgctctacccacagccgtatgcagcgtgaggcggcaaaaggtaaacaaggcggcagaaccatggaaattcaacgccttatcgcgcgctcattacgtgcagtggtagatttaaaagcacttggcgaacgtacgattacgattgattgtgatgtgattcaagcggacggcggcactcgtacagcggcaattacgggtgcgtgtgtagctttacatgatgcaatgagtaaattagtcgctgacggcgtactgaaagaaaatccgatgaaaggtttagtagcggcaatttctgtcggcatcgtggacggtaatgcggtatgtgacttagaatatgttgaagactcaaatgctgaaacggatatgaatgtggtgatggtcgaagacggcagattagttgaagtacaaggtaccgctgaaggcgagccgttctcacatatggaattgttacaattactcgatctcgctcatcaaggcattaatcaattattagatgcccaacgtaaagcattaggcctataaacaaaaacggcacaagtaaattaaatacttgtgccgtttttgtttctcatgatgagtgattaaacttcaatcccgaatttttctttcactaacgcttggaaatcagtacaaccgccaacgtgaacgttatctaagaaaatttgtggtacggttgcaaccggtttgccaacacgtggttctaaatcttcttttgaaataccctcggcaatcatatcgataaatttaaaatcgaaatcagttaattcgcctttcattttttccgctaatgcttttgcacgtgtgcaatatgggcaagtcatacgaccataaatttctacgaacataattcattccttataaaattgagctaattattcaatggcaaatgccagtttcaacagactggtaagcggtcaaattctatcagttttttgcaaaaaatcctaaaaaatgcccgcttgctaggtaattgcaacgggcattgagcattctgaataattagataatttctgttgtagttgcggtaggtaaattcacttgtacggtcatagtacctccatattccacgagagaaatacccacaccgatttgatctttgaaattaaattgttcaatatgatttgcagcatcagttgcaaaatcaacaacttctacaaagtttttactattatttaccacagaaattaataaattagtgccatttaagctaaataatacatcactgaggttcaaatcagtgaatgagataacatcaatctcactgttatcggatgcgcctcgatctgccacaacatcataaccgaatgccccactgaatacgtaagaatcagcgccccagtccccggataaatagtcattgccctgtgaaaaatattgatcgcctgattctccatttaaaatatcatcgcctgcaccaccaaagaggttatcgtgaccaacgccaccgaaaagcagatcatttccatcaccaccatcaatcatatcattatccggattacgcatagttgacgaaggattagcatcttggttgccatataaaatatcatcgccaaattgaccataaatttgatcagcgccatttccaccataaatgatgtcattaccgcccccagtcgctttaatcgcttcagaatcatcatcaccgtagatgatgtcattcccattattaccttgcgctttatcgttacctacaccaagatagaagcgatcgttactatcaccacctactgcaatatcattacctgatgccatataaaatagagtagcggcagatttttttatcgtagtcgcttggtcatctcccgctaaagccatcacaatatccttgccgccttgagagtaaataatatcgttagcttccgtacctgtgagtgtttcacttgccgaagtaccatcaataatattgacggtaagcgcttttttaaacaccgagttagcctctaaatactcctctaatgtgatagtgcgatcttcaaacacaaatgtgatcggttgtttattagcgaaataatcggtaatagtgacgctatcagtggtatctccgtaaacctgaataataagatgtttaaaatctacacggagaactaaatcagctagatttgcgccgacaaattttaagattgtagtgtcattagcattggtttcgctttgaattttatcgccttcatgacccttcgcaaaaatatacgtatcagtaccttcgcctccaaataattcatcatagccggcattgccaattaaggtgtcattaccttcattaccataaagtgggttagctttttcagaaccgataacggtatcatcgcccgctagcccagaaattttgcggtaatcgctaccacgtccataattcgtgaccggagctgtgagcgtatcggaaaattttgtgccgtcataaccggtataagtcgtaattgcagtattattcgcaatataagtatccaactctaggctagtcagtatcgcatcctcaaattgaatagtaagtgtactatcagtatccgttaaataatttgttacgattattttatcagtgccactgttatcaagagtaataactaagttactgcctaaacgactaaacattgaagtggataaatctgccgctttgtagcccgccagttgaatattttccgttgccgaaatagtgagcgaaccttgccccttagtaaatacggttgtcataaaaactctccagataataattgattaaataaggcagattaggatagtaagcttttttatacaaagagaagaaaattgatctatatttttaacagatttgaccagtaaaaaaccataaaaaaatgcccgcttgctaggtaatagcagcgggcattttcttaaatcaacacaaattatttcgtgctggtacttgttgtcgtacggcttgcacgtttacgatcattttcggttaataaacgtttacgcacacgaattgattgtggtgttacttctactaactcgtcatcatcgataaattctaacgcttgttctaacgtcatacgaaccggtgttgttaacacgattgcatcatctttacctgacgcacgcatattggttaatttcttaccttgtaaacagtttacggttaaatcgtttgaacggctgtgaataccgataatttgaccttcataaacatccacaccgtgatcaatcattaatttaccacgttcttgtaaaccgaataatgcgtaagcaagcgctttaccggttgcgttagaaattaacacaccgtttttacgctgaccgatttcacccggttttacatcatcataatggctgaagcttgagtaaagtaagccggtgccagaagtcattgtcataaattcgttacggaaaccgattaaaccacggcttggaatcacgtattctaaacgtgtacgacctttaccgtccggaatcatatctttcacttcacctttacggatacctaatgcttccattaccgcaccttggtgttgttcttcgatatcaatggttacttgctcaaatggctcttgttttttaccgttttcttcacggtagattactttcggacgtgataccgctaattcgtaaccttcacggcgcatattctcgattaataccgataaatgtaactcaccacggccagatacacggaactcatccggatttggtgtttcttctacacgtaatgctacgttatgtactaattctttgtttaaacgctcaaggatttggcgtgatgtaacaaatttaccttcctgaccacagaatggagaagtatttacacagaagaacatcgttacggtcggttcatcaacagttaacgcaggtaatgcttctacgttattaatatcacaaatcgtatctgaaatatttaattcgcctaaaccagtgattgcaatgatgtcgccggcaaatgcttcagtcgcttcataacgttgtaaacctaagtgacctaatacttgacccactttaccgttacgggttttgccttcagaatcgatcacagtaaccgtttggtttggtttgattgaaccgcgtttgatacgaccgataccgattacacctacataattgttgtaatctaattgtgaaatttgcatttggaacggtgcgtttaattccacttttggcggttcaacgtgatcaacaatcgcttggaataacggagtcatatcttctgcaagatcttcgtgctctaaacctgcaacacccattaatgccgatgcataaataattgggaaatctaattgctcgtcagttgcacctaagtttacgaataaatcgaatacttgatccacaacccagtcaggacgtgcgcccggacggtcaactttgttgataactacgatcggctttaaaccgtgcgcaaatgctttttgcgttacgaaacgtgtttgcggcattggaccgtcaaacgcatctactactaataacacagagtcaaccattgaaagaacacgttctacttcaccaccgaagtccgcgtgtcccggcgtatctacgatattgatacggtaatcgttccagttgattgctgtattttttgcaagaatggtaataccacgttctttttcaagatcgtttgagtccattacacgctcgtctgcgtcaccacgcgtttcacctaatgtgcctgattgttgtaaaagtttatctacaagcgttgttttaccgtggtcaacgtgcgcgataattgcgatattacgcaatttattaatatctaaattttgcattgaaatgtctttattgagttgaatatagggtgcgtttacacacaccgtggaaagctttagcaggggggaaatcgccccctcttattgcgacctagtgtgatcaagatcacaattcacgaaagggcgagattatacagaattttttatttattggctatgatttaagcggtctgatttactaaattttttgcaaattaagcgcttttagcagaataatccctcgctccaaaaatcgccgtgccgatacgcaccatcgttgagccacattcaattgcactttgcatatcatcactcattcccattgaaagcgtatcaatgccttcaaacgctgcttgcaagcggtcaaaaagttgctgcattttacgtaacgcaattttttgctgttcagcttcactttccggttttggaatcgccatcaaaccacgcaaacgtaaattcggtaattggctaatcgcttttgctaactcgtctaattcttcgggttgaatacctgatttagactgttcgtcactaatattaatctgaatcagcacattgagcggtgctttatttgccggacgctgtgcattcaatcgttccgcaatttttagacggtcaactgtttgaatccagtcaaaattttccgccactaaacgagttttattcgactgtaacggcccgataaaatgccactctaaatttggttgctgagcaaaataagcaattttctccacaccttcctgcacataattttcaccaaatgcagtttgtccagctgtaatcgcttcttcaattgcttcaactggtttggttttagagactgctaataggcgcacattagtacgattaaattgctgtgagatttgctgaatttgctgattgatctgagataaattttgagaaatcgacatttgtaactccaaaaactataatgaataaatcatagcatattgaggaacagaataatggatttaaccaagattaaattagtgattaccgatgtggacggcgtacttactgatggcggaatgtattacaccgctgaaggtgaagtaatgaaacgcttccacgtccatgacggcttagggatgaaaatgctgcaaacctgcgggatccaagttgcgatcttatccggcggcgattcggcattgttacgtaaacgtattgatgtactcaaagtgcctctgtttaaattaggtaaaatggaaaaacgttccgcgtgttttgaattgatgcaagaagcaggcgtaactgcggaacaaaccgcttttattggtgatgatacgttagatttaccggcgtttgaggtttgcggattggcaattgctactcgtaatgcgcacgactatgtaaaagcaaaagcggattgggtattagaaaaagccggtggcgaaggggcttttcgtgaagtgtctgaccgtattctacaagcgcaaggatttgaagaaatttatgctaccgcagacggctttctaaccgtagctgaaaaaatggctcaatagactaaaacgttgataaaaaaataagcggtcgtttttcgcaaattttttgcaagaaacgcccgcttgttataagggaggaaataattagaaacggtaacctacgtttgccgtaaattcattaccttttaacttatcaccgcttttcttcaagttgctacgagtatattccgcaccaatctctacattacttgatacagcatatttagcacctgcaccatagccgtaaccacggaaattcgtatcaccaattttactttgtgctacatcaactttaacataagggagtaagtctgaaccaacacggtaaccttgttgatacgccacagtgtatttagttttttgttttacatcactaaatacttttgtactgcctacttttaccttaccttgtacaacaccaacaaaattattgccgtagtccataccgtaatcgaccactaatgctgggccggttgattgtttacctttaacaccatctacttcatatttcacggtagttaaatcaacacccacacctacgccggtaaatgtgctacctaccggagcagcaaatgctgatgctgaaaataaacccgctaatgctaatactgttaaatttttcatagaatataccttttctgttgtatcaggatcttcattatatgcaaaaagatctgataaagatagaatctaaacaatccttactctaattcaccacaaaaacgatagccttcaccatgaatcgtcacaatgatctccggtgtattcggatgatcttcaaaatgcttacgaatacgacggattgttacatctaccgtacgatcatgaggtttcaattcacgacctgtcattttaagcaatagatcttcacgtgtttgaattttacccggattctcacagaagtgtaataatgcacggaattcactacgtggtaatttattgactaccccttccggcgtaatcaagctacggctgtttacgtctaattcccaaccgttaaaacgataactttctaccgaaatactttccttggccgctttatctttttcattcattgtacgatgtaaaagattacgagcacgaatcgtcaattcacgagggttgaacggcttggtaatataatcgtccgcaccgatctctaaacctaagattttatcaacttcattgtcacgcccggttaagaacattaatgcgactttagtattttcacgtaattctcgagccaacattaaaccgtttttgcccggaagattgatgtccataatcacaagattaatcgcttgctctgcgagtatagcattcatctcaacgccatctgtcgcttcaaatacttcataaccctccgcttcaaaaatgctttttagcgtgttacgagtgacaagttcatcttcaacaatcaagatttgtggattttgcattgtataagccttctaagtaattttaaaaatctgttattgcaaggtgttgaattattgttgcaaagttgtggcaattttaccgctgttgcagcttactagaaagagttaattcaagttttgttatattaagtcaaatttttaatgctaattgaactaagcagcctttaatttttattataatcgattaagaaacacacattatcgattatctcgatcatctacaccaacaattaaatagttaccatcaatatccgataaacttctaaagccgatattaaaaatatcacacgccttattacgattaattgatttatagtcaaaattatcatgatggtgcccgtgaaaaattttgcttactcccatttttcgagccagctgattaatcacagcaaaaccttgcggatgcggacgaggcgcttcgtgtgaaattaaaatgtctgcctgctggttttccaacgcttctatatcagaagggaaaatagaagtacggtgtcttaatggcaaaccaccccgccaaattcgttcttgcggacaatattgacaataatgaatcggatcaaaaaacatcggccgattcggcggcatccagatatgcccacggaatactccgcctaaaccggcaatttttaccccttgaatatccaccactttgccgtgaatattacgttgcttccattcgctattccaaatcgaatcaaatgctgcaaccgtcttactatcatgattaccgtgaataaaccaaatatcacaatactgtgaaagcttatctaattcttcgggcgttgttagttgcaaatcacctaaaataaccaatgcaacctcttctcctttatgcgcttgcaaaataggataaagatgttggtaactaccgtgaggatcgcccgcaaaaagtatcattagttatcttccgtttcgtgctgattatactgtttaaattgcaatggaatcgcttcatcttttaaaatcgcctcaaccacttctttcgtttgattatagcgatccaaataacttggtgattctatttcaatataaggtacgcggtacttttccaataattttttcagtaattgttggaaacgttggcgttgttttaccgagccaaggctacgcaaaccgtcatcaacccatttggtgttattcgaaagtaaaatggtcacatcaaatggatactctttaatcattgagtctaaaaacggatgtgctttaccttcatactgaatacaaaatgcctgagtcgtgatgtaatcagtatcaataaacgcaactttatgcgcatgcttcatcgcataatcgacataacgctggtgaccaagcgccattcgaggataatccgaatactgcatcgcttgctcatcaccaccaagctgctcaaacacaaattctcgtccgtattcccaagccgaggtagtattaaatacgttagccaatttgctgactaataccgatttaccactactttctccacctaaaatcgcaatagttttcacaaagaatggacgaacttctttcgggataaagcgccagtattggaatggattattacgaatacgcgttgcggaaacgtcaaacaattcacgtttaggatcaactaaatgcacttccaaattaaggtatttttcgtaaggcgctttatcttgcacttcactactgaataccactgtcggattaatacttttctcactgaacaactctttaacacgagccgcccagcccgcccagccgttcggataactaggaatcccatcttctttcaagtgatggataaaaatttgctttttctgatatttaaaaatctgttgcatccaacgcagcctatcctcattggttggcatacgcttcattttactgtctttaaaaagttgtaaatctcgttcagtatcagtacatacaactacatgtaatatatctactttactgaatgcttcgtaaatcatattaatgtgaccggtatgtaccgggtaaaatttaccgaaaatgacaccgacacgcagattcatatcttcaacaatatttaatacttggtgcagcgatttcagtttatttgcacttggattttttatttttccactgaccagttgattaaaataagctcgtgttacacctgcttgctcacaaacatcatttactttcatttttaactgtttgcgcttgagctggagataagcgaaatctgtcataattctttcctcaatataagttatcgtataataaaacaaaatgtagcatttgagtatttatttatttgcaaattccactttacatgcggtatttttgcaaaattttagcttaatttaaccgcatatttcctgagctgaagaaccttgctttgccagtttaaaaacgacaaaaaacctgctttaactgtcaaaacgaaagaaaatcgctgaaattgccacccttacctttccatttttgcttgataaacgttataatcacagcaattttctatttaaattttggcaacattcttaatgcaattaattcgaggctttcataacttggcgaactttcacgccctacaaaaaggctgtgtgctgactattgggaactttgacggcgttcatattgggcaccaaaatattttggctcgtttatgtgataaatcattggagctaaatttaccctcagtggttatgctatttgagccacaacctcgtgaattttttgcaaaaaaatcggcaaatttaaccgcttcttcagcccctgctcggctaatgcggttacgggacaaattgaaatatctggaagaagccggtattgattttgtcctctgcgtacgttttagtgataaatttgcgcagttatctgccgatgcattcattaacgaattgttagtgaaacgtttgcaagttcgttatctcagtattggcgatgatttccgtttcggtgagaaacgtgccggcaattttgaaatgttgcataatgcaggtctaaaataccgttttgcggtagaagaaagccacacgcacagttttaatcgtgaacgaatcagcagctctttgatccgccaagctttgcagcaagataatcttcacttggtagaaaaattattaggcagaccttattcgatcgcagggcgagtagcacacggtaataagctcggtcgaaccattggtttcccaactgcaaatattatgcttaaccgcttagtaataccgctgcaaggcgtatttgccgtacaaattcaaactcaaaccggtaaatataacggcattgctaatgtagggaatcgtccaaccattaacggcagtaaagccttattagaagtacatatttttgattttaaccgttcgatttacggtgaagcgatagaagtgttctttatgcacaaaattcgtaacgaggtgaaattcccaagtttcgaagcacttaaagtacaaatcgagaaagacaggcaacaagcggtcgaattttttaaagaatttgcaaaatagcaagtaacctaataattacacaaaattaaactaaaattttattaactggaaaacaaaaatgattgattacaaaaacaccttaaatttgcctgaaacaggctttcctatgcgtggggatctcgctaaacgcgaacccgatatgttaaaaaattggtatgacaaaaacttatatcaaaaagtacgtgaaagttcgaaagggaaaaaatctttcattctgcacgatggtcctccgtatgcaaacggtaatattcatattggtcacgcagttaataaaattttaaaagatattattatgaaatcgaaaaccgctttaggtttcgatacgccttatgttccgggttgggactgccacggcttaccgatcgaattaaaagtagaaggtcttgtcggcaaacctaacgagaaaatttctgcggcggaattccgtcaagcttgtcgtgattatgcaaaagagcaagttgaaggacaaaaagcagactttatgcgtttgggggttttaggtgattgggaaaatccgtacctcaccatgaatttcgatacggaagcgcacattatccgtactttaggcaaggtgattgcgaacggtcatttatacaaaggttctaaaccggttcactggtgtttagactgtggttcatcattagcggaagcggaagtagaatatgaagacaaagtgtctccatctatttacgttcgttttaaagcggttgatagcgctgcagttgaagcaaaatttaatgcggtaggtaaaggaagcggtcaaatttctgcaattatttggaccacaacgccttggacattaccgtcaaacaaagcaatctcaattaatccagaattcgactaccaacttgttcaattcggtgaagaacgtgtcattttagttaaagatctagttgaaagcgtacaaaaagccgcaaacgtagaatcagtcgaagtattaggtgaagtaaaaggtgacgcattagaattaatgcaattccaacacccgttctacgattatagcgtgccattaattttaggcgatcacgtaacgactgatggcggtacaggtttagtacacaccgcaccggatcacggtcaagacgactttgtggtatcgaaaaaatacaacatcgaaatggctggtttagtagcaaatgacggtaagtttatctcaactacgccattctttgccggcttaggtgtgttcgaatcaaacgaaaaagttttagaaaaattaaaagaaaccggtacgttattaaaattagaacgtatcaaacatagctatccacactgctggcgtcacaaaacaccgattatcttccgtgcgacacctcaatggtttatcggtatggaaacacaaggcttacgtaaacaagcattaggtgaaattaaatcagtacgttggatcccaagctggggtgaagctcgtattgataccatggtagcaaaccgtcctgactggtgtatctctcgccaacgtacttggggtgtgccaatgacaatgtttgttcacaatgaaaccgaagagctacatcctcgtacacttgaaatcttagaaagcgtagctaaacgtgtagaagaaaagggtattcaagcatggtgggatcttgatccggttgaagtactaggtgaagaagatgcgaaaaactaccgtaaagtaccggatactttagacgtatggttcgattcaggatctacttatgcatccgtagtagaagctcgtcctgagttcaatggtaatagtacggatatgtatcttgaaggttcggaccaacaccgtggttggtttatgtcttcattaatgctttcaacggcaacaaatggcaaagcaccgtataaacaagtgttaactcacggtttcgtagtagatgaaaaaggccgtaagatgtcaaaatctttaggtaacgtaatcgtaccttcagaagtttggaataaaaacggtgcggatattttacgtttatgggtggcttcaaccgactataccggtgaaatcgccgtttcgcacaatatcttaaatagcgcaggtgaatcttatcgccgtatccgtaatacggcacgtttcttattagcaaacctaaacggctttgacccgaaacgtgacttagtgaaaccggaagaaatgatcgcacttgaccgttgggcggtaagttgtgcattagaagcacaaaatgatattaaagaagcatacgataactaccaattccacgcagtagtacaacgtttaatgcgtttctgttctatcgaaatgggttcattctatttagatattatcaaagaccgtcaatacacaaccaaagcagacagccttgcacgccgtagctgccaaacagcgttatggcatatcgcagaagcattagttcgttggatggcaccaattctatcattcacagccgatgaaatttggggttacttaccacaagtggaaggtcgttcggagtttgtatttaccgaagaattctacgaaggcttattcggtttaaccgaagcggataaattagatgatgcttactggcaacaaatcttaaaagtgcgtgcagaagtgaaccgagtacttgagcaagctcgtaaagacaaagtaatcggtgcaggattagaagcgaaagtaactgtttatgcaaatgatgaaatttgcgcaatgttggaacaacttggcaatgaacttcgttttgtgcttattacttcacaagcaattatcaagccgttaagtgaagcggatgttacagaaggtgaagtagctggtttagcggtgaaagtcgaacgtgccgaaggtgaaaaatgtcctcgttgctggcacttcgcaaccgatattggcactcatgcggaacatagctcagtatgtggtcgctgtgtagaaaacgtggcaggcgacggtgaaaaacgttcatttgcttaaatatgcttaagtaagataacctcgcactctgtgcgaggtttcatattacaaaagttattaaatattttgtcgctgggcggcaatgctatactaacccgatagataaaatatcgggtctatcatataggatcgtaaaatgctcattctcaataaacctaatcacgcaaaaaaacagctggaagcattgcgttttattccgcaaacagcggataaagtagaatttctagcaggtagccgtgagttcaaagctcgcattttacagctcattaaaactgcaaaaaaacgtatttatttaaccgctttatattttgaacaagatgaagcgggacaagagattttagatgcgctctatcaagcaaaattagcgaatccaagcttagaaattaaaatcttggtagattggcatcgtgcgcaaagaggtcgtattggtgaagaaactaccagctctaatgccgactggtatgccaaaataaaacagcaatatgatttaccgctagcacaagaaattgaattttggggcgtaccggttaacggtagagaaattttcggggtacttcaccttaaaggctttattttcgatgatacgctactgtatagcggcgcaagtattaataatgtttatttacaacagttagaacgttatcgctatgaccgttaccatgttattgaaaatagtgtgttagcagatacaatcgttgcctttacacagcaatatattttatcgaatcaagctgtaaaccgtttagatcagattgaacgtccggcaactgtaaaaattcgcccacaaatcaaagcatttcgtaaacagctaagccaacaaagttaccaatttgtaggccagccgaaaagtgatgagctttgcttatcaccgattgttggtttaggacgtaaaaaccgtttaaataagacaattgaagcattgttttatcaagtgcaaaataaactgacgatttgcacgccgtattttaattttccgcgctcgctcttaacacgcatttcatggttacttgaaaacggcagacaagtagaaatcattgtcggtgataaaacagcaaatgatttctatacatcgccggaagaaaaattcacgatggcgtcggcattaccttatttatatgaaaaaaacttacgtgcctttgctaaacgttttgatttttatattcaaaatcagcaattgagcgtacgtttatggaaagacggtgacaatacctaccatctgaaaggggtatggattgatgaccgttatattctattaaccggtaataatttaaaccctagagcttgggggctggatgctgaaaatgcggtattaatttatgatccgaagtcagaattaggcgataaagtgcagctagaactcacgcaaattagaacctatacacaacaattgagccattatagcgatttagaaatggttaaagactatccatacgatgttcagaaattactgaagaaatttggacgagtgaaattggataaaatcgtaaaaatgttgttataacgatttaattgactacggataacttagcgctacacaaacttcttttcgatgtgttttcttcgttatccgttgtttatttacaaaggaataaaaatgagcgaacaaatttatggtattcatgccgtaaaagctttcttagataacgcaccggaacgcttaattgaagttttagtgctaaaaggacgtgaagataagcgtctaaacccattattgaatgaattacaacgcttaggtatttccattcagcaagtaaatcgccaaacattggataacaaagcgcaaggtgaagttcaccaagggattattgcgaaagtagtaccgcaaaaagagctaaacgagcacgatcttgatgtaatcttgagtcaaaagcaaaatccgtttttattaattttagacggtgtgacagatccacataaccttggtgcttgtttgcgtaccgctgatgcggcaggtgtggatgcggttatcgtaccgaaagataaatcggcacagctcacctcaaccgcacgtaaagtggcttgcggtgcagctgaaactgtgccgttaattcgtgttactaatcttgctcgcacaatgcgagagctacaagaacaacataatatttggattgtcggcacggcaggtgaagcgacttccggtatttatcaggctaaattaaccggtgctatcgctttagtgatgggagcggaaggtgacggtatgcgtcgtctaacccgtgaacattgcgaccagttaattagtatcccaatggctggttcggtttcttcactgaatgtttcggtggcaaccggcgtatgtttatttgaaatcgtacgccaaaaactggctgcgcaataataattagtctcttcaaatatggaagatgataaagcttcatctaagtcactgggcattggcaaagtttgctaaaaatttaaccgcttgtctcttccatattttctctattgatgacacgcttcatacagcggtaataattggcgaatggtttggtaaataaattccgtcatatcaatctgatcgagctcggccttttcgatattacgtccgatacaccaaaaatcttcctcattttcaagcgataacgaatctgtttctttaagcgttttaaaatcggcatactcgctttccgcaccgtgccatacttcaaaatcttggtattgagaacgatctaatttttccaaccattgattatattgcgctaataaaatctgcgaacgatccgctcggtaacaatgccaatccaagcacacctgtaaacggcgacgatttaaaatcactgataaaattgcagctgaatttcggttaaattcgtatttgtaataagcgaaaaagtgcgctctaacctgccaaccgttacaccatttttcaatatgcggttcggcaaacggcataccaagctgacgtgctacctctaaatgcaacgctttccatttttgccactccgctttgtaatttgcttttatcaacggaatatcttccggacaatattttttcatttgcgcaaattgaaaaaacggaatttcaaataattcacaacttttggcattcagcattttgattcctcaaataaaaagcggtcgaatttgcaaattttttcgcaaattcaaccgcttgtcattagctaggattagctacgggtgtaaacaaattccacaccttcttcatcttcttccgaccaatcatcatcaaagtcatcccaatcttcttcgatagggttttgcattgcttcttgatgataatcatcccatttaaatttcacttcatccgcttctttattttcttctgcgatttcacgagggttcgcttcgataaagtccataatatcacgggtaagattttgcacgttttgaccggttgcagcagatattaagtaataatcgccttcccaaccgatttgttctgcgatttcttgcgcacgagcttgtgcttcttcttcaccaatcgtatcaatcttattgaacactaaccaagtcggtttttccgataatttttcgctatattgataaagctcactttcaatcaccgaaatattttgtgccggatcgctttcatcaatcggcataatatcgactaagtgaattagtacgcggcaacgttcaaggtgttttaagaaacgaatacctaaaccggcaccgtccgccgcaccttcaattaagcccggaatatccgccactacgaaactgcgatccgcaccgacacgtgctacacctaaacttggcacaagcgttgtaaacggataatccgctactttcggttttgcagccgatacggcacggataaaggttgatttaccggcattcggtaagccaagcataccaacatcggcaagtagcattaactcaagtaataaatcacgtttttcgcccggtgtaccgttagttttttgacgaggcgcacggtttaccgacgatttaaaacgagtattacctaagccgtgataaccgccttttgccaccaacattttcataccgtgtttggttaagtcaccgatgacttcttgggtgtcattgtcgattgcacgagtaccgaccggcacacgtaaagtaatatcgttaccacggtatccggtacagccggcactacgaccattttcaccacgacctgctgcgtaacgtttttcaaaacggtagtcgataagcgtatttaagttttcatcagcgattaaataaacatcaccaccgtcaccgccgtcaccgccgtccggcccgccttttgggatatatttttcacggcggaaactcacacaaccgttaccgccatcgcctgcttcgacacgaatcagggcttcatcaataaatttcattgttattccttttttactcccctctttaattttactctctccccttgtgggagagagacagtctacggattcgttcagaaaccgtaggcagagagaggggtatcatattaaaaatcaacttgtctcccctctcccgaatttcaattctaaacgaattgaaattatccctctcccacaaggggagagggtcatctaaaagagggaaaatgttttacattttttcaatcgtcttaatacctaagagatctaaaccttgttttagcgttttcgccgttaatgcggctaaacgtaaacggctgtttttcacgttttcttccgcattcagcatcgggcaagcttcgtagaaacttgagaatgcgccggctaattcgtataagtattggcaaagaatatgtggcataccgtcttttgctacgccgtttaacgcttcttcaaactgtaaaagtttaaccgctaacgcacgttctttgtcttcagttaagttaatttcgccatttaagccatttacatcaatgccggcacggttgaaaattgaacgaatacgagtataagcgtactgcatatacggtgcggtgttgccttcaaaggtcagcatattatcccagtcgaatacatagtctgtggtacggtttttcgagagatccgaatatttgaccgagccgattgccaccgcttccactaccgctgctttttcttctgcggttaaatccgttgaacgctctgaaattaatttatccgcacgttcaaccgcttcatctaatagatcttttaatttaaccgtaccgcctgaacgggttttaaacggcttaccgtctttacctaacatcattccgaagaacggatgttcgaggctgaaattttccggcacataacccgctttacgggtaattaaccacgcttgttgcatatgttgtgcttggcgagaatccgagaacactaacacacgatcagcatttaacgtttcatagcgatatttcgctgcagcaatatcagtcgtggtatataagaaaccgccgtcttttttctgtacgataacgcccattaggtcgccgtctttgttcttaaattcatctaagaacactactaacgcaccgtcgtcttctaccgctaaaccttttgcttttagatccgctacgatttctggcaacatcgggttgtaaaggctttcgcccataacatttttttctgaaagcgtgacgtttaaacgatcgtagttttcttggttgtggtgcatggtaatatcgactaattttttccacatcgtacggcaatattcatcaccgccttgtagtttcaccacatagttacgcgctttttcagcaaacacttcatcgctatcataatgctcttttgccgcacgatagaacgcttccaaatcgcttaattccatttgactggcgtgttcattttccattttttctaagtaggcgattaacataccgaattgcgtaccccagtcgcctacgtggttggcacgaatcactttattacctaaaaattctaaggtacgcaccactgcatcaccgataatggttgaacgtaagtgacctacgtgcatttctttcgctacgttcggcgaagaatagtcgatcacgatggtttgcggatttgcagttttaatcccaaaattgaccgcttgtaatgcttcacttgcttgatttgctagccatgcttggtttaagaaaatattgataaagcccggaccggcaatctctaatttatcggcaatagcgtttaaatctgcgttatctaaaattttctgtgcaaattcacgtgggttcatacctaatttttttgctgcgcccattgcaccgtttgcttgataatcaccaaattccggtttgcctgattgacgaacaagtggctcaacattgctttctgcaccagccgctatcattgcttgtttaattttgtctgataaaatctgttgaatattcacgaatatataacctttttctacgtgcaatctcctgcacgatactaatttaaaaatccgaatagtgcagaaaattgcactctaaaggaaaaacgctctatgatacaagaaaatgcaaaattttacgagaaaatgaccgcttgttttggtgatttttctgaatttcaacaaaaaattcagcaaattgcccatttggcgatgctggatttaaatcagtttaaaattgaccatttagcagtcagaatgaatgattggctgacggctgaacagtggcgttcatttttactcgaacacggcgaattattaaaagaaagcgaagtaaacgggcgaccgataactcttatcaaacttaatcagccgttatcttttttaggacaagatgtttcgattatcgaattaccgttcccgaaagataaagtttacccgcagcaaggctgggaacatattgaaattgtttatccgatgcagaaaaacgaaacggttgagcaatggactcagcgtgcattaaaacaatttcagttattgattaatgccaaccttacgcttaaaatcagccagcccaaagtggagggagaacaattgcctaatccaagtattgcaatttcagtaaagagtgcaacttattgcaatccttattgtctcaagctccacccttatgatataaatgaggtgatttgttcagaaagtcatttctgagcaatttttcattggagaataatatgaaaaaattaagtttcgcagcagctttaatggcaagtttaactctcgtaggttgtgcaaataccgatatttatagcggtagcgtatatagctcaaaccaagcgaaagaagcgcgttcaattagctatggcaccattgtttctgtacgtgacgtaaaaatccaagcagataaccaaggtgtattaggaactgttggtggtggcgttcttggtggcgtagccggctcaacaatcggtggtggtagcggtcgtgcagtagcaacagcagttggtgcggttgccggtgcacttatcggtaataccgttgaagaaaaagcgactcaggtttcttcattagaaatggtgattcgcaaagatgatggcaaggaaattgttgtcgttcagaaaaaagaaaaaggtttcgtaccgggtaaacgagttcgaatcgtaggttcaaactcagacctgaacgtatctgttctttaatctatcttttttaaggatattgcataatgaaaaaattctctctcgctgtattagcgacagttgcacttgcagcttgtacgcaagacttttactcagataaaggtaatgcaactgtattaagttctaaagatctttctaaagatgtcgtagaactcactgttcgtaaagataatggtgaagtagttaccatgactcgtgaatatgattctcatgctgctgttggtgcacgagtaaacgtgtcagataactatgagcataaagatccggatttaaaaacaattcatcgttatgaatttaaataatctgcagaattaaagttaaaagtcctgaacaacctgttcagggcttttttcttatataactaaagccaacgccgtacttgccggcaatattgggtaaaactttcctcaaattttttctgtaaagctcgctcttccgatttaatttggaaccgatttaaatagtacacaaatccaataatcaccagtgaagcaaaatatctattaagccatactgcccatgcaataagcaaaaacattaatccaagatacatcggattacggctaaagcgataaataccccaagtaaccaattgtgaactttgctgtggcgtaacagggctaatcgttgtttttgcttgtttcaacgcataaagccctgcaacgcttactgcgatgccgactccagcaaataaaaaaccgagccattgaggcaatggataatgctcgccacttggtagtaagtaaatcaacaacaaacaaaacacaaacaataacggaggcggtagtttaagttccataatgtaaatttccgttaaaaaataaccgcttgcggtatgccacaagcggtcaaatttacataattttttgcaaattacacgttaaagcggaagtgcattacatcgccgtcttgtacgatataatctttcccttctaaacgccatttacccgcttctttcgcaccagcttcgcctttattatcaataaagtcttgataaccaatcacttccgcacgaataaagcctttttcgaagtcagtgtgaataactgccgccgcttttggtgcggttgcaccaacagaaacggtccaagcacgtacttcttttacacctgcggtaaagtatgtttgtaagtttaataaacggtagccagcacgaattacacggttcaagcccggctcttcaatgcctaagtcttgtaaaaactcgactttttcttcgtcatctaattcagcaatttccgattcaatcgcagcgcataccggcacaactactgcgccttctttttcagcgatttcacgtacgcgatctaaatacgggttattttcgaagccgtcttcgttcacgttcgcaatgtacattgtcggttttaaggttaagaagttataacctttgatcgcgtgtaattcgtctttatctaaatcaacagaacgaatcataccggcattttcaagcaccggtaagattttttccataatcgataattcgaatttcgcttctttatcaccgcctttcgcacgtttttgtaaacgttgaattgcacgctcacagctgtctaaatccgctaacgcaagttcagtattgatgatttcaatatcatccgccggatcaatcttaccggcaacgtgtacgatatcgtcattttcaaaacaacgcactacgtgaccaatcgcatccgtttcacgaatattggctaagaatttattgcctaaaccttcacctttacttgcaccggctactagacctgcaatatccacgaattccatcgtggttggaagtacacgctcaggtttcacgatttccgctaatgcgtctaagcgaggatccggcattggtacaacacccgtattcggttcgatcgtacagaacggatagttagccgcttcaatacccgctttggttaacgcattgaaaagagttgatttacctacgttcggtaaacccacgataccacatttaaatcccataatttcctcttaattttcacggaatacacagaagaatattgaaaatgacaagcggtctgattttgctaaaaatttgcaaatttctaaaagaaaataaccgcttgtttatgccatcaagcattcttccgtgacaaataatattatgctttaaaaccgttgagacgattggttgctttcgtcacaccgtctttaaatagaacatctacacagcgaccggcttcatccaccgccgcattaattttttcttgatcctgcgggcttggtttacctaatacataaccggcaaccaattctttactgcccggatgcccgataccaatacgcacacggtaaaaattattactgttaccaaggctggcaataatatcttttaaaccgttatgaccgccatgaccgccaccttgcttaattttcgctacgcccggcggtaaatccaattcatcatgagcgactaaaatttcttccggtttaatacgatagaaattcgctaaagcgccaaccgctttaccgcttaaattcataaaagtggtcggcacaagcaaacgaacctcgccgcccgccgtattaatttttgcgacttttccaaaaaatttagcttcttcttttaagctgacattaaattgacgagcaatttcattaattagccattcaccggcattgtgacgagtatcttcgtatttcgcccctgggttagctaatccaacgataagtttaatttgtgacattctctgtcctattcgattaacagggaaaagccctaaaatgaaaagtcgttattgtaggcaaaaagggcattttctacaaggaaaatgcccttttttagttgaatttatactgctaaagaatttgctacttcactgccatttttaaccgctttcggatcttcaccgtatttatttgtgaaacgttgaccatctttaagcattaaaaacagtataaaaatccatatacatcctatacttgcaagtgtcaaaaaatataaggaatattcaacatcactaatcgaccccaattcttgatctaaagagaagactgttgcaatacttaaaataataacaatcacataaggtaataactgccaccaaccagaccaacctaaatcgtgtaaacgtcgagtcgtgacacttatcgaaggaataaatatcgcaaattggtagaggtataacaggattgttaatccgtttgcaacattttctagtccaatagcaaaacaaacaccaactaagatatttaatataatagctatcaaaatattgattaaataaaaccaaccatattctctacgtctagctcgaacggtaaagttaaaacttcgttttaatgcgaataaacaccaattcatcaagttctccttttatcttattaaattatgagtattggtttaatactgaatatttaggacttttaccaaatcgattagtaaatggctgcccatctttgaatgttaggtataagaaatatgcaaaaacaatcacgagactgaccatcataaataatccgcctttttgagaagaagataccgcttcgataatttcatccggcataaatgtgagaacacacagtgaggtatttacaataaccaacaatgattgccaccaaccagaataacctaaatcatgtaagcgtcttgccgttacactcatcagcggtaatagcaacaaaatatctaaagcataattaacaaaattaaaggcgtcagctatatgcggtaaacgtaatgcaaataatacttttgccaaaaaccaaattaataggctacttgcttcataaatccaaataaaccaagcaaactctaagcgtcttgctcttccagaataatcaaacgtatggcgtagcacatacataaaccattccattcatacctccttacaatcacacatcaaataataattattcgttttctataaattttgaagcaaattgggctacttgtcactcaatttgaataaatttgcatacttaggttgtcctaaacccataaatcagcgaaaatagctcaatatttttaaggtggctcgtccacctttttgtttcaattttaatctagagaaaagcatgtcatacccacaagaagttaataagcgtcgcacctttgcgattatttctcaccccgatgcgggtaaaactacgattaccgaaaaagttttactttacggaaatgccattcaaacagccggctcggttaagggcaaaggctcaagcgcgcacgcaaaatccgactggatggaaatggaaaaacaacgtggtatctctattactacgtctgtcatgcaatttccttacaatgattgtttagttaatttattggatacgcccggacacgaagacttctctgaagatacatatcgtacactaaccgcagtagatagctgtttaatggttatcgacagcgcaaaaggtgttgaggaacgtacgatcaaattaatggaagtgactcgtctgcgtgatacaccaattttaacctttatgaataaactcgaccgtgatatccgtgatccgatggaattattggacgaggttgaaagcgtcctaaaaattcgttgtgcgccgattacctggccgattggttgcggcaaattatttaaaggcgtatatcatattgcgaaagacgaaacctatctttaccaatcaggtcaaggctcaaccattcaagaagtgcgtatcgtaaaaggcttaaacagccctgaacttgatgctgcagtcggcgatgatttagcgaaccagttacgtgaagaattagaattggtacaaggtgcatcaaacgaatttgatcacgaagcatttatcaacggcgaactcacaccagtatttttcggtaccgcattaggtaacttcggtgtggatcatttcctagatgggttaaccgaatgggcgccaaaaccgcaagcacgtcaaaccgacgtgcgtacggtagaatctagtgaagaaaaattctcaggtttcgtatttaagatccaagcgaatatggatccgaaacaccgtgaccgagtggcatttatgcgcgttgtatcaggcaaatacgaaaaaggtatgaagctcaaacacgtacgtatcggcaaagatgtcgtgatttccgatgccttaacctttatggcgggcgatcgttcacacgctgaagaagcctatgccggcgatattatcggtttacataaccacggcacaatccaaatcggcgatactttcacccaaggtgaagtaatgaaatttaccgggattccaaactttgcaccggagctattccgccgtattcgtttgaaagatccgctcaagcaaaaacaattgttaaaaggtttagtgcaactttcggaagaaggtgcagtacaggtgttccgcccattaatgaacaatgacttgattgtaggcgcagtcggtgtacttcagtttgacgtggtggtttctcgtctgaaaaccgaatataacgtggaagcgatttatgaagcggtaaacgtagcaactgcccgttgggttgaatgtaaggatgcgaagaaattcgaagaattcaaacgtaaaaacgaacaaaaccttgcgttagacggtggtgataacttgacttatatcgctccgacgatggtgaacttaaatctggcgcaagaacgctatccggacgttgagttcttcaaaacacgtgaacattaatcgaaaacaagcggtcaaattttgcaaattttttgcaaaaaatcaccgcttgatttaagtaaaaaatgcgaccttaaggtcgcatttttcttatacctgattcaaagtataaattaccagaagtaacccataccgacagaaccgccaagctctttacgtgtattcgcactgaaagacactttcacgccaacaccacttggtagagattgtgagtaacctaccgctaccgcactttggctttcatattgacccactgcagccgttacacctgattgacctgccggtgcttgtaataaacctgcggttgcaattgctgatgccgtgccagccttacgatctttatttaaacgatttaaacgtttgtcaaaatcattacgcgtttgatttaactggcgcacatttactgcgtcgcctgcttcaacaccatccgcaacattagtaatacgtttgttattcatattaatgccgttgctatcaatcgttgggccattcttaactgaaaccgaatcagccgttactttcgcaaaagtcggattatcgatagttgctacagtaatcgtattcgcattttgagtgattgcaatattcttacctgaatgtaccgctaccgtttcacccgatttcacattatgggtagtaactttaccatctgccgctttagttgaaacattcacgcctttatttgctgccgctgccgtatcaatcttcgatttcacttcatcagataagccatataccactttaccttgaccgtctgtagtcacatttagatctgaagtcgcaccaaaggttaagctatcgccttgttccaatgtccaagtatccgctaacgcatcagaacttaacgctgcttcattgttgcttacgttgaaggtataagcggttgatttatctgctttttcatcaagttgtgctttatttaccgcatctgtactgtttgtgccggctgtaacattactaattactttatctgccgcatcaatacctgccgccgtaagttccggaccgtttgtcacaccaagtgaagtcgttgcaattgcttggttagcattcattacattactatcaatacgtgcaatctcagaagagcctgcaataatttgatcagtatttacacgagcgatattacctgtacctgcaactaataaatcagtatttacatttgaaatgttacctgtacctgcaactaataaatccgcatttacatttgaaatattacctgtaccaccgacaatttgatctgcatttacacgagaaatattacccgtaccgccattaatttgatctacatttacacgagcgacgtctgttgtacctgcaacaatttgatctgcatttacacgtgcagaggttgctatatctgcagtagatacgacggctgatgtctcaaggaatgcttccgccgtagcactatctacactttccagaacaaggtttaccggatctactgtcatcgtcattaattcaggatctgcgctgaaatcctcaaaactatctaatgatcttctgctacggctacttctaggcgctgcttcagtattctccgtttcacttgttaaacccgtgttacttactaactctgaaggagcaatgtttggataataaagtaatgcattactcactaaaatttgatatagctgtccaccattgattgcatctgtactgaattcagaaatatcaccagcagctaaattagtaataccgtttgagctaattttcggcccatccgcaacattaatcgtatttactacgtgtaaattatctgtattaacagtatttgaagagaaacttgccgtacggattctattcgcatcaagcacacctgaaaccgctaatgattctgttcttacacgagctgcatcaacaattcccgaagcagataatgaaccggttctgatacgtgctgcatcaatcacacctgaagccgctaatgaccccgttctaacacgggcagcatcaatgatacctgatgctgccaaataatttgtattaactttttccgcatttacttttgttgcattcactgcgtttgaagccgttaatgatgctgtattaacttgtgttgcattcactgcatctgacgctgttaatgaagcggtgttaatttgtgttgcatttactgccgctttcgcggtaattgagtcggtgtttacttgcgttgcatttaccgctttcgcatcaactgttgttgatttcacattttccgcattcactttttgtgaatttactgcatttgaagcagttaacgatgccgtattaatttgcgttgcattcaccgcatctgatgctgttaatgatgctgtattaatttgtgtcgcatttaccgcatctgatgccgttaatgacgctgtgttaatttgggtcgcatttactgccgctcttgctgtaattgagtcggtgtttacttgcgttgcatttaccgctttcgcatcaactgttgtggatttcacgttttccgcattcactttttgtgaatttactgcatttgaagcagttaacgatgccgtattaatttgcgttgcattcaccgcatttgatgctgttaatgatgctgtattaatttgtgttgcatttactgcatctgacgctgttaatgaagcggtgttaatttgtgttgcatttactgccgctcttgctgtaattgagtcggtgtttacttgtgtgctattaactgtttttgcatcaatttcattggtacttacagtaaaagtatttaagcgattcgtatttgaagttgtcgcatttacaacatttgctgcaacattcaacgcatttacctgtgcagaattaaccgcttctgaagctgttaaggcaattgtgtttacttttgttgcatttactgcgcctgaggccgtaagaccagccgtattgatttgcgttgcatttactgctcctgcagctgttaacgaagcagtattaatttgagttgcatttaccgcacctgatgcagtaatagaacctgtattaatttgagttgtattaattgcatcgctacctaatgttgtagtacgtactgatgaaaatactacattatcagcagaagaaatatttaatgtatttccttgtgcagcaagatttaaattattatctgaataactttatttaagttatcggcagtaaccgttgccgttgttaattcatttgccattgatgttgtataaagagacgataaagctaatgcaattatcgttttactcatttttttatttacatacatattcccacctcaaattaaggaatttgatttctttcagttaaatttcattcattctttatcaaattaatcgtaaacaacattcaatcttatttagataaataatctaataaagaactaaatgaatatataccttttaatctatatttactaactaatcggatctccactataaaaatatattctttattacacatcggatttgcttggctatctttacaaaacaaataactactttttttatggatttatgatagaatcagcgccatatctgtaaaatacttgactaaattaaaaggaaattataatgaaaaaatggctgttcccattacttgcaactacactatttactgtgggttgtgaagataaatcggtttctcaaaacatccaacaagacactaaaaaaactgaaacaaatgaattaaaaaacaatgagttaacacaagttaccgttattgcgccttgggagctaaatagcttacacccgactcaatccggtgttattttccagcgaatgaacttagcagagaccttagttgaagcaaatgaaaaaggagagttaatccctgggcttgcgactgaatggaaaagcaataaagatgcaacggaatggactttcaccttacgagatgccaccttccataacggcgaaaaattaaatgctcaaattgttgtaaagaatttaaatttagtaatgaatcaaccaagcattctaaaaaaggcatttattaaagaaattaatgttttaaatcagaatcaattaaaatttaaattaacaaaatcttttgtaccattccctgcatttttaacacattattcaacaattattttagctgaagaatcatttaatgaaaaaaatgaagttgttaaattaattggaacaggtgcatttaaagcaaataaaattgaagcaccacaaaaaatagaggctattcgctttgaacaatattggggagaaaaaccaaaagttattcatgccaattatttagcaagcagccgtagcgaaacgcgtgtattaatggctcaaagcgatgcaagttcattagtgtttaacttagatacggcgagtgtcgcacgtttaaaaactaatcctgatttgactgtcaccactggttctatcgctcgtactattcaaatgaaaatggatgtggcaaaaccgttttttaaagacttagcaattcgccaagcgctttcacaggcaatcaatcgtaaagcgattgctgaacaagttttaaaaatcgaagatggcatagcggatcaaattctaccgaaagcctttgctgattggcgtgtggaaagtaaagatgaaactgttgatattgcaacaattaaacaaaatttaatctcggccggctaccaatttaatgatgaaggcaaattaaccaataaagaaggaaaaccattcagctttactttaagaaccttctcggatcgtccggaattgccgattattgcgactattttacaagcacaatggaaacaaatcggaattgatgtaaatgtatcggtcggaaactttagtgaaatccctgccggtcataaagacggtagcttagaaatggcgctatatgcgctgaactatggtaaaactatcgatccattcggtgtaatcgtgcaagattatgccaaaggcggtagtgattggggtgtgatgaactggagcaacgaccaattggcgcaaaccttagagaaaatcgaaacagaacgtgatccgcaacaagctaaacagttaaagcaaactgttagccaaatcattcacgatgagttgccgattattccggtagtgtattatcagcaaaatgtggctacacataatgagttgaaaggcgttacactcgacccattcgaaagaagattctttttagaaagacttacaaaataacattatcaaattagcgtttaaaacacggaaaacagcacagactcttgggcaaatttccgtgttttttaatgaattcatggttagaaatatgcttaatattatttttagacgactactgcaaattattttagtggtttggtcggttggtactctcacttttattctgactcgacagctctcgggggatatggcttatcgtatagcggcaagtcgttacggttatgatcaagctgatagtgctgctgccgaattagtacgcgccgaattaggactagaccaaccgtggtggcaaagctacggaagctggttactcgaccttttacaacttaatttaggtaaatccttagttaccggagatttagtctggaacgaaattgcccatcaattcgggcatacacttagtcttgctattgttgcgctcgttatggcaattatgattggtccgattcttggtgtgcttgccgctcgcaaagaaaatggcttttttgaccgcttcaccctcgtatttagcactctgtttcgttccgtaccagcatttattatcgccatcggactaattacgctcttttcggcaacattacactggctaccagccggcggttacgggaaatggcaacattttgttttaccggcatttacgctcgcattagggctgagtgccgtttcggtacgtgttactcgtgcggcaatgttacaggtaaaacaatccgaatattaccaattcgctcgtttaaaagggctttcaaaatggcaaacttttactcgccacggtatccgcaatatcgctattccagtaattgcttaccatgccgtacagctggtttatttgattgaaggagtggttgtagtagaaagtctcttcgcttggccaggtagtggacacgccttagtgcatgccgttattgctagagacgtgccaatgatccaaggtacttctctcgtgatgggcggtttatttgtcctgttaaatatgtgtgcagatatgctaagtgcatggattgatcctcgaattactaataaacgtcatggagaataataatgaataaaatgacattcagccaaaaagtcggtgcagcgattcttgccgtgttgcttgcttttgcctttttacagccctatttttatccaatggatattggcttccaagatctgacaacgattctcgccaaacctggtgaacttgcgtggtttggcacggatcacctcgggcgagatatgctagcccgccttgcttcggcgattcgtttatcattcggtctatctctttttagtgtattttgtgcattagttgccgggctggtatttggtattctagccggctttttcggtggatgggtggatcgactattcagctttatttgcgatttagtgatggctctccccggcttattactcattctattatttgcttcattgtccccagggtcattttggacgctttatttaggtatcgctttagtgatgtgggtggagtttttccgtgtgattcgagcggtcagtcaaactctagcttccagtgctgaaatcgaatcttctcgcttaatgggaatgggattagtttatagctttaaacgccatcttttaccacgtttactaccgcttattgtaaccctaagcgctttctcgctaggtaatgccattctggcattggcaacactcggttttgtgaatgtgggactacgtccacctacagctgaattaggtttaatgatgactgaattatttccttactattatgaagccccttggatctttatgcagccggtgattgctgtctttttaatggttctcagccttcaacttttatcagggagagtaaaataatggcactattacgcattgagaatgttggagtaaaaactagcacaggtttaaccttagttgagccgataagtttaacgctagaacaaggtaaaaatatcacgattctcggtgaaaccggctcagggaaaagcctgttaattcaggcaattatgggtgctttgccagaaggacttgaagcaagcggtcaaatttttgtagaaaatagcaaaaccgaaaacacacagctagaatcgctttggggtaaaaccttggtaatgttgccacaagagcctcgccgttctcttgacccaattatgacgattggtaaacagctttgggaaagttttttcttcgtagctaaaaaagataaacaagcggcaaaaaccgaaggaacaaacactcttgagcatttgggcttaaaagcatgggaaactgcatatccgcaccaactctccggcggtatggctcaacgagcttctttcgctgtcgctacggcagccggcggtaaaattttattagctgatgagccaaccaaagggctcgatcaaaaaagcaaaaccaatgtgatccaattactaaaacagacttatcagaatcaaggcggtttgctcactatcacacacgatattgaagttgccgaacaattaggtggcgaaatcttagtgatgagaaaagggcagttattagaaaaaggtgctgcggaaacatcgcttgctaacccgcaacattcgtacaccaaagccttgattgccgccgatccgaaacattggcaagcggtcgaaaattcgcaaaattttgcaaaaaatcaaccgcttgtctcggtaaaacatctgagtgttgcacgaggtaaacgaacacttttcagcgaactttcatttgacttacaccaaggcgaaatcttaggtgttgtcggacatagcggtatcggcaaaagtacgctcgctgatgtgttatgtggtttgcttaagcctaaatcaggcgaagtaatttggcacagccagcaacataaaaaacaccaggtattgaaactgtaccaagatccaccggaagcctttgcaccgacagtcagtttacaaacacttttggatgacgtggttaataaacataagttagatcgttcgcaaattccaactttactgcaacaactggctctttctccggaaattctcacccgtaatgcagaaaacgtctcaggtggtgaattgcaacgtgttgcgatcttacgtgcattattgcttgagccggtgttactttttgccgatgaagtgacttctcgcttagatccgatcacgcaaaaagagacgattgagttattaatcaatcaatgtcgccaacgcaaatgtgcattagtgattgttagccatgatccatatttaattgagaaaagctgcgataaagtgattgatttaactcagtttatttaatacttcagaaaatagctgatttatactaacgaatcatagcaacaagcggtcgtttttgatgaaagctttgcaaaaattgctttgttctcttaaaaacgaccgcttatttttattttattcgctgatattattcaactaagtctaacatctcctgtgcattagcaagcaccgcatcagtaatcttacttccgcctaataatcttgctaaggcctggactcgttccgcttgagttaatagcgacatttgagtttccgtctgattattttccacatacttttgtacattgaaatggtgatgaccgtaacttgccacctgcggcaaatgggttacacaaagtacctgacatttcttacctaattggcgtaacagcttaccaactgtggttgctgtcgggccgctaatcccaacatctacctcatcaaaaataattgtcggtgtggataatttatttgccgtcaacacctgtaccgccaaggaaatacgggataactcaccaccggaagctatcttggctaacggctgagcctgttgccctaaattactgcgcaaattaaattcaacagcatcagctccgttactcgatagctttttaccgtcgtgttgtacatcaataaaaaactcaccgttttccattgaaagatgtttgatttgtgcggtcacttgctccgctaattttttacctgcctcaagacgcttttggtaaatttgctcagccaactgaatggattgctggtaagcggtttgctcctctgctattaactgttcttcatttccggcaaaatccaccaacttttgtaattcatcttggagtagcgaatgatgttgccataagttttccggcaatacatggtgcttgcgagctaattgaatcgttttactgatacgtccatctaattcatttaataaatccggatcttgctctattttgctggctaaatcacttacttcagaactagcttcctgaacttgaataagtgattcatttagcatatttagtgctgattgataacgtgaatcaacttcgactaaatcttctaaatgacgaattgccttatataacattgaatcgacatttaattcattttcgctcagtaaatctgtcaccccttgggataatgcggttaatgcttctgaattggataatcggctatgcgtttcttccatttcctcaaattcaccttgcttaatcgcgaactcatctagctcatccacttggtattgcaatagctgtttacgagcttcattctcttggcattgttggcgaaagtttttaacttgctgatgtaatttcttccaacaatagtattggctactcatttcattcaacaagctatggatacctgcatagttatccaatacctccaactgatactcactttttaataataattgcggtgcgtgctgcccattcaaatgaatcagatattggcctaactctcgcagttgagaaattggtaacgggcgattattcacgaatgctttagaacgcccttcttgattaatcatacggcgtaaaatacattcttgcgggttatcttcatctaacaactcgtgttgctgtagccacgaataagcagggctagtcggttgcataataaaagttgcggtaatatccgctttatctgcaccattacgaatcatgctactttccgaacgatagccgaggcaaaggcttaacgcatcaatcgcaatggacttaccggcaccggtttcgccagtaatgaccgacattccttcattcagttctaacgttaagtgacgaacaatcgcaaaattattaaccgttaattgagtgagcataaaacacctgtaaaaatatatcctgtatagatatatactataactgtttttttaaacagtaaagtatttttgcaagatttttgctaaatccgaccgcttgccataaaaaaatcctcgctgattttcatcaacgaggattttcaaactaattaatcttactattaaataaagacttgttcaccaatacgatacccttgtggcgcttgttctttatcttcaaaagttacaaattcccaagcattttcgttagcgaggattgcacgtaataacttgttatttaagccgtgtcctgatttatatgcgctaaaatcaccaaggatattatagccacacataaataagtcaccgattgagtctaacattttgtgcttcactaactcatctttatagcgtaagccttcttcattcaggatacgatattcatctaatacaatcgcattatcaaggctaccgcccaatgctaagccgattgattgaagatattcaacatctttcataaaggtgaaagttcttgcacggctgattttgtgaataaagttttcagcagataattccattttgaaattacgcacatctttgctgatcatcggatggctaaaatcaatagtgaaatctaattttaaacctttgctataaggtttcatttccgcccatttatcaccttcttccacacgtaccgtttctttgatacggatgaattttttcggtgcatcttgctcttcaataccagcatctaataataaatagatgaatgggctcgcactgccgtccataatcggaatttcaggcgcatctacttcaacaattaagttatctaaacctaatgaagccattgccgcatttaagtgttcaaccgttgaaatacgtacaccgtcatcattaatcatacaagtacaaagttgcgtatcacgaatggattccgcacttgcaggaaaataaactgctggctctaaatctgtacgagcgtaaataatccccgtattagctggggcaggacgtaacgttaacgttacttttttaccgctgtgcaagccgatacctgttactttggttgcttgttttagcgttctttgtttaatcattattctgtccttattccctatattgggcgatcttactgaccgtttctcataaaccctggaatggagttcggagaccaaacttgagaagaatcaacttgttgtggttttggtgccgcaggttgcgattggctaaattgagcaggttgctgagtataaccttgctgaggctgcgcaaacgctggctgagccggttgtgcctgtggctgatatgcagcttgaacttgctgctgaacttgttgttgcaacactggcgttcttggtaaagttaattcttctgcttgaccaatacctgtcgctactaaagttacacgtaatttaccttccatttcagggtaaaccgatgtaccgaatacaattgttgcatctggagctgcaaagctatggatataatccatgattacatcaacttcgttaagttcaatatctaaacctgatgaaatacttactaagataccttttgcaccggataaatcaacatcttctaatagaggacttgctaccgcatcatgcgccgcacgctctgcgcgatcttcaccctctgcaataccggtacccatcattgcacgtcccatttcagacataactgttttcacgtctgcaaagtccacgttgattaaacccggtgaagtaatcatatcggtaatccctaaaacggcattgcgtaaaatatcatttgccgctttaaaagcatccatcattttcgtatttttcggtaatacttttaataatttatcattcgggatgatgattaatgagtctacgtgtttagacagctcttgaatgccttgttccgcatagctcatacgtttgttaccttcaaaacggaacggtttcgttacgattgcaactgttaatgaaccttgtgattttgcaatatctgcaataaccggtgccgcaccagtacccgtaccaccacccataccggcagagataaataccatgtccgcacctgcaagcatattagataatgcttcacggtcttcttctgcagcttgacgacctacattcggatttgcgccagcacctaaacctttagtgatattcgcaccaatttgaatggtttggcgaacagaacttgtacgcaatacttgcgcatccgtattcactgagaaaaactcaacgccaccaacaccttcgttatttaggtttccgtcaaccatatggtttagcgcattaccgccaccgccaccgacgccaacaaccttgattaccgcatcttgtgttgtttcataaataggttcaaacatttttcatctccctacgtgccaacttgctcgtcaacactattaaaaactcgattttgcccaattaacagctttctttacgcctctgcctaaaacatcaaggagcgtatctactttctcaccaatttcaccaccgctacccttttcgtcagaattgtaatggctatactgtaaaagaccgagtactgttgcatattgtggtttatttacatagtccgttaaccctgtaatatttaacggatatccaactcttacttgagagccgaagatatttcttgcacattctacaatatcttcgatttgcgaaccaccaccagtaagcacaaaacctgcaattaattcctgttttatgcctttttggaacaattcatggcgtaattgagttaactcgttctccaccaccttcaataaatcactataacattgtgaagttactgtcgcaacttgcgccttagtgaaggttctcggcattcgaccgccaagtccagctacctcaatttttttctcagcattatgagttggagggttaatcgcactaccataattcattttgatactttcggcttcattacgtgaagtcgtaaatacatgcgcaatataatcagtgacgttattaccagcaaatggaatcactttactaaaacgtaatgcaccatctgtataaactaaaacatccattgtgccgccaccgatatcaattaagcagacacctaattctttctcatcttcggttaatacggaataacttgatgcaagacccgaaaagaccactttatccactttcaattttgcacgttctactgcattttttaaattgcgtaaccaatcttgatgacaagcaatcagatgtgcttgagcttgtaaacgcataccggatagccccacagggtttttcgttgccggtaatcgatctactttatattcctgtggaataatatgtaacgtttctaatccatctggtaatttaattgagcgcgcaatatgaatagcagaatcaatatcttcattcgttactgttccaccaagtggcacagtaccgctttcatttaaagcagtgatatgttgtccagaaatagcaagcgttacaccaataatttggcaatccgatactgattcggcttgttcaatcgctcgttggatcgaattcaccgcggcatctaaatcaataacaccgcctcgatcaacgcctttagctgggcaaacacccgagccaatcacatttataacgccgtctggcaaaacttcaccaacaacagctacaacttttgatgtgccgatatctaaaccgacaattattttggattctgctatttttgtcatatcactatattatgcttgctaagaattattgatgtacaggactaaaaccgacagccgcaccatgttcatagcgcagatccacataagccagtctttgtccttcaggaacattaatttccggaaaaatcgtcacaaaacggtcgattttaggtgtccattcccctcgaccgaggcgcagctctacatgatttgataaagtgatcgtccaagaacctctgttatccactgcaacggattgcaactctaaatttcgagcttttaagtccgctttaattttactccacgcatctagaacaacttttccttctgtatcgggcccataaagtaccggaagtcccgttttatccattcgatctgcgggtaaactaaagaccacaccctgctcagaaagaaagttcgtattattccaaatagcaactggattatgctcaattaacgtaatgcttaaacgatcaggataaagctttctgactaccacatctcgcacccaagaaataccaagtaatttctctttaacttgttgaatatcttggccgaaatatccttttagaacaggcttttgcgataaagtttcccgaacgtccgcatttgttgtgaatcgagttttatgagtaagtgcataagctcgaatcggagatttatctaaattctccaaccaatgatgccaattactataaacgataaatgcgaagattacgcataataacacaatcaacggtttaattaatactaaccgattaaagggatttgctgaagattttgcttttaacggcttaaaacgaaccgaaggtgccgtttttttgcgtaaaacagaaaccattaggcacttaactccaatacacgctcgactaatttttcaaacggaataccgaccgttgccgcagatttcgggaaaatactatggcttgtcatacccggacaagtattcacttcaactaaattaaagtgaccatttgcatcttccatcacatcaattcggctccagccacgacaaccaaccacatcgtaagccgctttaactaattttgctacttccgcttggcgttcatcgtttaatgccggcacgacatattgggtattatccgatacatatttcgcatgatagtcataaaactcaccatccggaatcacttgtactgccggtaatacttgaccatctaatacaggaacggaatattccttgcctgccaagaaagcttcaactaatacgattgaatcgaactttaacgcttcttctaccgccggtaataattgctcaaccgtttttactttagttacgccgacacttgaaccttcgcttgaaggtttcacaaataccggtaaacctaattttgcaataatttgttcggaatcgaccgcttcaccacggcgaacaaccaccatttctgctgttggtaagccaaccgcttgccacattaatttggtacggaatttatctagagttactgctgacgccattacgccacaaccggtataaggaatgcccatttgctctaatgcgccttgtaacacaccgttttcaccgatgccgccgtgtaaaatattgaatacgcgttgaattcctttttcttttaatttttcaattgggaaatctttagtatcaataccttctacattatagcctagtgattttaatgcttcggttactgctgcgcccgaatttagcgatacttcacgttcttgagaaacgccgccaaatagcactgcaattttttcatctttaatgctcattttttatcctttcttaatttggacacaatgcatcgtgcccctactactcaattcaagattcacaagcggttaattttgcaaaattttttgcaaatcttaccgcttattaagctttccagctctctgctaaaccacgtgaaatacggcttacgctgccggcgccttgtgcaagaattaaatcaccgtcttggataatttgatctaatacttcaccaagctgatcggtatctgaaactaaaattggatcgactttacccaaattgcggattgaacggcataacgctttactgtccgcaccaacgatcggcgcttcgcctgccgcatacacttcgagcataattaacgcatctacttgcgataacacttgtacgaaatcatcaaataaatcacgagtacgtgaataacggtgcggttggaaaatcatcacaacacgtttatcttcccagcccgaacgagccgctttaatcgttacatccacttcggtcggatggtgaccatagtcatcgactaacatcactttaccgttcggacgaataaatgaacctaattggtcaaaacgacggcctgcaccttggaaatcggcaagcgcagataaaatcgcttcgttgccaatgccttcttctttcgctaccgcaagtgccgcagttgcattcagagcattgtgtttacccggtacattcaacaatacgtcaatacgttcaccgttcgggcaaactaccgtgtagtgaccttggaaaccggtttgttggtaatcttcgatacggtaatcagctttatcactaaagccgtaagtcacaacttggcgaccgacttgcggtgcaatttccatcacggtttcatcatcggcacacataaccgctaaaccgtagaacggtaagttacgcaggaattttacgtaagttgctttcatctgctcgaaatcaccgccgtaagtatccatatgatccggctcgatattcgttaccaccgaaaccatcggttgtaaatgtaagaatgacgcatcgctttcatccgcttccgcaattaaatagcggcttgcacctaaatgcgcatttttacctgccgatttaaccaaacccccgttaacaaaagtcgggtctaattgtgcttcggtatagatcatcgaaatcattgcggtggttgttgttttaccgtgagtacccgcaatagcgataccgtgacggaaacgcataatttccgctaacatttgcgcacgttgaatcactggaatacgagcttcttttgctgcttttacttccggattagtatcatcaatcgcacttgaagccacgactacgcttgcaccaataatattttccgcttgatgcccgataaaaacttttgctcccgcttcaactaaacgtttagttacagggccttcggcaatatccgaacctgaaatttggtagccttcattcaataacacttcggcgataccgctcatgcccgcaccaccaataccgataaaatggatttgatttacacggcgcatttccggcactaattttttaactttatcttggaaatttttcattgttgttttcctatctgtacaaccaaatatttttgttggttgcgtttaaaactatttcgcttgttcgataatcacttctgctacacgttgagcggctgtaggcgttgcttttgctctggctttgatcgccatttcagttaacttttggcgatcagcaattaacggctgtaacgcacttaataaactttctaccgtaaaatcttgttgttcaataatgattgccgcaccgtcatccgctaaataagtcgcattcaaatattgctgacgatctttatgttgataaggcacaaaaattgccggtaaacctgctgcggcaatttcacatacggttaaagcgcctgaacgacaaatcactagatccgcccagttataggcttgtgccatatcgtcaataaattcggcggcaataccgttaccggtcgcttgataaatgtcttccacaccactgagattgccttttcctacttgatggctaatgaacacattttgaccaagttgcttagccgcttcaggtacggtttggttaatcactcttgcgccttggctaccgcccatcactaaaatattgatcggataacctcgttcggcaaaacgaatttctggcgcttcaagctgagcaagatcttcacgcacaggatttcccaccacttccgcatttgggaatgcggtcgggaatgcttgtaaaacacgacgagcaatttttgataaccaaacattagttaaaccggcaaccgcattttgctcatgtaaaataaccggtacgccgcataatttcgctgcaatgccgcccggcccagatacatatccacccataccgagcaccgcatcaggttgataatttttaatgattttacgcgcctgcatcaccgctttgaaaatggcaaaaggcgcttttagcaatgccccaataccttttccttttaatccggaaatttgaataaactcaattggaataccatgctttggcacaaggtcagcttccattcgatcttgagttcccagccaacggatctcccaaccctgtttttgcagttctcgtgcaaccgcaattgccggaaacacatggccaccggttccacctgccatgacaagaagttttttagtcattttgatctcttttacaaaaatttgagcgtaatcgctcacttattagattttttagacaaattgttgttattgtacaggaaattgacaatttacggaaaaagaaagcggtcagtttttgcaaattttttgcaaattccgaccgcttgtttctttaaatttccttgatttgtgcatgccctatcaaagcaaggcgattttcgtaatcaattcgcagtaaaatcgcaatcgcaatcgacataatcactaagctggatccaccataactgactaatggaaatgttaaacctttggtcggtagtaaacctgaagcgacccctagatttacgaagccttgtaagaagatccaaatcgcaatcccaaaagctaaaaagccacggaagcgttcttccaatttcagtgcatctttactgattttaagcgctcgtaacgccaaagaaacgagcaagatcacaatcgcgacaataccgataaatccaaattcttcgccaactaccgccataacgaagtccgtatgggcttccggcaagtattccaatttttgtaccgaattacctaagccttgtccccagaactcaccttgaccaaatgccatttgcgagttagaaagctggaaaccgtcaccataagcatccgcaaaaggatccataaatgaggtaacacgtttaagacgatattcggatgtcaggaccaaaaaggcaaacaagatcgccgccgcaatacctaggaacaggaactgtaaaattctcgcccccataataaatagcatagcaaacgttaatacgaataatacgaacgtactacctaagtccggctgtagcagtaacaaaataccaaaaatagctaaaatcaccatcggacgaataaagctcgcacgcttggtacgcatttcatcatatttacgcacatagaaactggcgaaataacaaataatggctaattttgccaattccgccggctggaaatttatcggcccgagcgggatccaacgtgtcgcaccgttaacattacgtccaaaaaccagcacgactactaaaaacagtaacgatattaagaaaaaggcaacgttacgtttttcccaactttcggtcggaatttgaaccacaaccacaaaggcgaataatgacgccgctaaatacattccatcacgcaccgcaaaataaaacggatcattatttaaacgggtactgaccggaattgatgccgaggtgaccatcacaaaaccgataactaataagccaaaaaacagccaaatcaatgtgcgatcatatagcgaattagtcggtgttaatcgtatccatttatcccattctgtcttaaatctttctaacatattaagcggttacttcctgagctaattttacaaaaacgtgtccacgttcttcaaagttcttaaattgatcgaggcttgcgcaagccggcgacaataacaccatatcgccttttttcagttgcgggcggatttgttcaatcgcttgctgcatagtttccaccaacacgctttggtttgataatgcggctaattgcgcaccgtcctgaccgaagcaataacaaacgatattcggtttattgataagtggttttaactcggaaaaatccgccgctttaccgtcaccaccaagtaataaataaagcgttcccgctacttgtaaaccgttaagtgctgccaccgtactaccaacattggttgcttttgagtcgttcacccaacgtacgccgtcattggttttgaccgcttggaaacggtgatccaaaccgccgtacacttgcaatgcttttacaatcccttcacgcggaatgcccgccgcttcggctaatgccatcgccgctaacgcattcatttcattatgacgacctgaaatcagcatttctttggttgggataattgcatcatcacccgaatataaaataccgttacgcatagtgtactcggcattatgttctgcaaaacgaatcaattttttgaccgcttgcgtttcaagcggataagtcagtctatcttcaccgtttacaatcacattctcagcattgtcgtaaatacgcaatttcgctaaacgatattcttccaccgagttattgtaacgatccatatgatcttcactgatatttaaaatggttgccgcgactgcttttaaagaagaagtggtttctaattggaagctggacagttccaacacaaacaattcatattcttcattcaatagacttaataccggcaccccaatattgccgcccataccgactttaatccctgcttgttttgccatttcagtcactaatgtcgtgactgtgcttttgccgtttgccccggtaatcgcaataatcggcgctttcgcttcacgcacaaataattcaatatcaccaaccacttccacaccggcgttgatggtttgttgaatttccggtgtagccaacgcaagtcccgggctaatcacaattaaatcagaagctaatagccactcgctgtttaaaccgccggtatgcaacgatacatctgccggaagctggtcggcacctgccggtttttcacgggtatcaattacttgtacttttgcttgcttatccgcaaaaaattcgacacaagataaacctgttttgcctaagccgataatggtaacgaccttatctttatattggttttgcataattgaatctctttataattggtaaaaatttggataaatcagaccgcttgcaagcgaaaaaggtgggacaagcccacctatgattaacgaagttttaacgtgactaagccaactaatacaagcatcaaggtaatgatccagaatcgcacgataacacgaggttccggccaaccttttaattcgaagtgatggtgaatcggcgccatacggaaaatacgtttttgacgaagtttatatgaaccgacttgcaagattaccgagagagcttccaccacgaatacaccacccataatcacgagtaataattcttggcgaaccaataccgcaatcgtgcctaatgcaccgcctaatgaaagtgagccaacatcgcccataaatacttgtgccgggtaggtgttgtaccataagaaacctaaacctgcgccaacaattgcggtacagagaattaccaattcaccggcattcggtacaaacggaatatgtaaatattgcgcaaaattaaagttaccggtcgcccatgcaatgagtgcaaaagccgatgccaccataatggttggcacaatcgctaagccatctaaaccgtccgtgaggtttactgcgtttgaagtgccgacaattacaaaataagacagaatgataaagaaaataccgagctgcggcataaagtctttaaagaacggtaccactaactgagtcgctgctgtgtctttacctatcgcatagatgccgaatactgcaaccagcgcaatcactgacagccagaaatatttccagcgggcaattaagccatcggtatttttacgtttgattttccaataatcgtcaacaaaaccgaccgcaccgtagccgaataatacgaacagcacaaaccaaacatagctgttacgtaaatccgcccaaagtaaggtactcacaccaatggcgattaaaatcataataccgcccatggtcggcgtaccgcgttttttgaagtggctttccggaccgtcattacgcacttcttgaccgaattttaataactgcaagcgacgaatcacttcagggccaatccataaaccgatacccattgcagtaagcaatgccataatcgcacggaaagtaatataagatacaacgttaaatgccgtattgtattgaactaaatactcagcaagccaaactaacataagaaaaacccttgttaaatcatactaagcgggcaatcgcccacaaattttatccatattaaatagcgtcacgagtcataacccattttcactatctaccttaaaattaaaaagaaacacctaaagaaaggcataaagcagaaatcaatgtttccattttttggctacgagaaccttttgctaacaacactagcggttgtttttctgcaattttttgcgaaataatcggcaataagaaatcgtgcatcgcttgtttatcagtaaagtgatgtgcagtctctccactaattaccgcactttgctgaccaaaactcacaactaaatctaaatttgcttcacggacgaaatccgccacttgttgatgacaagccgcactttcgtcaccgagttccgccatatctccgaccgcaaaaatgcggaacgccggataatttttcaataccgccaccgccgatttcattgaatcaacattggcattataggtatcatcaatcaataaacaatgctgattaacttcaaccggatacaagcgacctttcacttgcgaacgttgctccaatccggctttgaccgcatttaaatccgcaccgaccgccatagcgagcgaagttgcggctaaagcattgctaacattatgtgcgcctaaataaggtaaattaatttcgatttcgccttgcggagaatgtagagtgaaatgagaaccggataagcctaattccacattttccgcccaaaaatctgcatacgaatcttgatccgaaccggtatagctgaatgattgcagctcatgctcaccaatttctttttgccattgtgggtaatagaacgcttggttcacaatcgctttaccaccggcttttaagcctcgataaatttcgcctttcgcttgtgccacaccggcaagtgagccgaaaccttctaaatgtgccgctgcaacgttattcactaaacaagcgtccggttgagtaatttctgtggtataagcaatttcaccgatatggtttgcaccgagttctaccaccgcaaatttatgttgcggcgttaaacgtaataaggtcatcggcacaccgaggtcattatttaaattaccaaaggtataaagcacctcatcttcacaagcggtcattttttgtaaaatttttgccgtcatttcttttacggtggttttgcctgaagaaccggtcatcgccacggttttcggattaagtttcgcttttaaccatttggctaactcgcctaacgctaagcgtgtatctttcacgacaatttgcggtacggaaatttcacattcacgttcaaccaccactgccacacagccttgttccaccgcattagctaagtaatggtgcgcatcaaagttctcgccttttaacgcaaaaaacagcccgttttcgaccgcttgtcgggtgtcggtgctggtggtttccaccactacattgccatcaccaatcaactgcgcattaagaatgctggcaatttcatttgttgttagttttatcattttcttctttcaaaaatatttgctgtaaacctcgtactatatgtacgaggttactgattgtgcggttgctctgcaacctaatcactcgtcgcagagcgacgatactatgcgtaacctagcatatttatgctaggcatctcgccgctgtctcctgatccgaaaaatgatgcttagtcgtaccaataatctggtaatcctcatgtcctttacccgcaatcaaaatgacatcttttgcaccggcttgttcaatcgcagttttaatggcttgttcacgatcgtggatcacttgtactttctccacttgaacgaaacctttgagaatatccgccataatcttggtattatcttcagttctcgggttgtcatcggttgcaatcactttatccgctaatttttctgcaatcgccgccatcatcgggcgtttacccgcatcgcgatcgccgccacaaccgaaaatacaataaagctcaccttcggtatgcaatcgtgccgcttgcaatgctttttctaacgcatccggcgtatgggcataatcgactaacacaagcggtctattttgcggatttttttgcgaaacgacacattccattcgtccagcaaccccttgcagaagcggtgcggtttcaattaatttttgcaaatcgtgaccaagtaccaataagctggctaatgtagtaagcaaattattgacgttaaatgcaccgattaaacggctatttagttcgccgtttccccagcttgattcaaacgcaatttttacgccttgtaagctaaagctaacatcggtcgctttaacgaatttatggtcgctactaaagtgagcatcggtactgacggcaactgcattcggtaattttgctaaccattcacggccaatctcatcatctgcatttaatacttgtgttttagtatttaattcgctaaacaaacggaattttgcttgtgcatattcttccattgtcttgtggtaatcgagatgatcacgacttaaattggtaaatactgctaaatcatagcttaacgcttccgcacgatattgtgctaagccgtgcgaagagacttccatcgcacaaaaatcagcacccatttccacaaagctggctaaattgcgttgtacttcaattgccgaaccggtggtatttgccgcttcttgtactttgccgtataaaccgttaccgatcgtccccattaccgcagattttccgcctaataggttgtgccattgggcaagtaattgagcgcttgtggtcttgccgttggtaccagttaccccgactagggtcagtttttcggacggattggcataaaacgcaccggcaatttccgataaaatacgagctaaattcggcactgaaaccaccttacaagcggtacgatctaagttatattttgcaaatttcgcatctaactcaatttcagtttgcccttcatccgcttccgctaagactaaacccgcaccttgctcaatcgctttttggataaattggcgaccatcaacttgatgcccttttagcgccacaaacagatcgccttcaccaacttggcgagaatctaacgtcatttgcttaagcggttttaactctgctacccaagcatctagttcggtaagaaaaggaagtaaacgtttcatattgttacctaatttattgttgttctaatttactttttgttccgttctaatttcacgcacggcactttcagtgtcgattagattatccggtttgatatttcttgctttcaaggtgtaacccataatgcttgagaacaacggcgctgaaaccgaaccgccataataagctccggctttcggctcgttaattaacaccactaacgcaaagcggggatcacttgccggtgccacacctgcggtataggcaatatatttttctacgtactgacctttttcaagtttacgtgccgtaccggtttttaccgccacacgataaccgtcaaccgctgctttctgccccccctcacctttttgggcgacactttccatcatatgcactacgtctcgggtgattttttcaggcaatacacgctcaccgataactggtggatcaactttagtaattgaaagcggtcgataaatgccgaaacttcccaaagttgcataagctcgagctaactgtaatggcgtaacatttaaaccgtaaccgtatgccatggttgcacgttcgatatcagaccaacgcttacgatcaccgttcgttcctcgttgttcacctaaacctaagccggtatctttaccaaagccgactttgctatacgtatcgaccaatgcggtcgaaggcatacgtaatgctaagcgactcaccccgatattactcgatttttgcaaaataccggttagagataaactctcacgaggcgcaacgtctttaatcgtatgaccatttaccacaaacggacgtgtgctaatcacctcgtcacgataagtcgcaccgttttgcaatgcagttaataccactaaaggtttaaccgttgaacccggttcaaaagtatcggtaatcgctcggttacgcattaattcgggtttgaagctatttcgtttgttcgggttaaacgaaggcgcatttgccattgctaaaatttccccggtttgcacgtcaactaataccgccgtgcctgactcagcattattggcaataaccgcttctttaattttcttatatacttcggattgcaattcttcatcgatactcaacataacgtcttgcggatcgtattgtttttcatctcgaatattttcaatcacattaccacgtgcatctttacgaatcacttggcggccgtttttaccaatcagtaaagaatcgaagctacgctctagaccttccgtaccatgtacgtcatcaatatcggtaaaaccgattaattgcgaagcttcttcagctaacggatagaaacggcgtgattcggcttttaacaccataccgtcaattttcagttcttgcgcataattggcaatactttcagattcatgacgtgcaatataaataaaacgttggcgagaagctttatacaaacgattcattaaatcgttatatttttctccaactgctttagcgatagcttccatctttgaacgatccaattgcgctgctgcaatttcttgcgccacaaattgtgaatgcggattattgcgcacagtgctaatcaaactgttgtaatccaaaccggttgattgcgccaacaacgtccaataattctcacttttagtattcaaaattgaacgaggatcaaactctactttttctttagatttattttttttctcaataaaatcgctgacacttttctcaattttactttttgaactgcccatttccattgctagcaatttccaacggtctgatgagcgtttgagtttgctgtcaaaatattcacggggatctaaagtaagagagtacatcggtacactgatagataagaagcgtccgtcacgatctaaaattcgacctcgggtaaacggaagctctttagtacggagtgagcgattattcgcttcattgataagacgttcagagtcaaataactgaatatgcgcagctttagcaattagcattcccgccatcacaagtatgaaaagaccaacaacaccaaaacgaatcgggagataactcggttcatttttagtgctggcttgtttttttgcctctatattcggctctggtgctgcgggtttacgctttaatttaactgactttgccattatttattcaaccaaaataacttcttgctcttttttaatctgttgtaaaccgaagctagctgctgcagcttcaacacgagatttctggctttttgcattttcttccagctgtaagtgaatatattgattttccaacttacgattttgctgaactaattttccttgctctgcggtaagcaaacgagtttggtgagtaatccaaatagtaccaattgcggttaacaccgttgctatcagtaaaatcaatgcaactttattgtggccggttaaatcatctagaataatttggtggagcggataacgttcattacttgccattcgttaactcctctatcttttttccgcaatacgtaatacggcactacgtgagcgagggtttgcttcgatttccgcctcactcggcataatcgctttaccaatggtttttaacggaatatttttatttaattccgattccaaaataggtaggcctttcggcacatccatacctttactgtttttcttcataaattgtttaaccattcgatcttctaacgaatggaaactaataattgataaacgaccttccggtgccaatacgcttaaggctgattgtaacgctttctctaactcgtctaactcgctgttaataaagatacggattgcctgaaacgagcgggttgccggatgtttgtgcttatctttgaaaggaacggcatcagcaataatctgcgctaattgaagtgtacgagaaatcttgtctgttgtagatttattataagaaacgaccgcttgtgcaatacgtttcgcaaagcgttcttcgccgaaggtttttaacacccaagctaaatcatccactgacacttgtgccaaccattcggcggcagatagacctttagtcgtatccatacgcatatcaagcggcccgtcacgcataaagctaaaaccgcgttccgcatcatcaagctgcggagaagaaacgccgagatcaagcaaaataccgtcaattttgccggttaaacctaattgttcgcacacttcaggaatcgcagagaaagcggtatgcacaatttgaaaacgagcatcggtaatcgtattcgcttcagcaattgcacgaggatcacgatctgtcgcaattaagcgaccttgttcggaaagttttgagagaatgagtcgagaatgaccgcctcgtccaaaagtaccgtcaatataaataccgttcggcttaatcgccaaaccatcaacggcttcatgtagcaatacggtaatatgcttatggactgtgtcgttcattatttttccaactcacttatttatcttataaagaaaggttttttaaggcttcgcaattcagcatttccgccgaactgcccaatgcaagatcttccgcaatctgtgattgccattgtttttcttgccaaatttcaaatttatttaattgcccgaccaacataatttgttgctcaagctgtgcatgctgtcttagtgccgggctaagtaaaattctacccgaagcatccatttcacattcggttgcaaagccttgcataactcgctgaatacggcgctgcatcggctcaaaattagaaagtgcaagcaatttttgttctacaacttcccattcgtgtaacggataaagtaataaacacggctggcgaatatcgacggtacaaaccaaaatgccctcgtgtttttcacgcaattcggcacgatagcgagtaggaatcgctattcgccctttactatcaatactaattgaagctgcgccacgaaacattttctgtcctgccactaaaaattactgtatttagtgagatccggatttagaaaatccacaatctcccacttttccccactaaaagatcagaattttatcggttagttgttcatcgggcaagctgttttaatgttttgtttggtaaagataagtagaaaaaagcaagcggtcgacttttgcaaattttttacaaaaatcgaccgcttgatcattcgttcttagacaagaatcattagattagaatttctgctaaagatagaccgattaagcaggctgtgattaccccaattaagcccggtaccataaagctgtggttaaaatagtacttaccaatttttgtcgtaccagtcatatcgaagctcaccgttgcaatatcagacggatagttagggatgaagaagtacgcataagttgccggcattaaaccgattaataaatctgctggtaaaccaattgcaatacccaccggtaataacattttcgcagttaccgcttggctgtttaccaccacagataccgcaaataaagcaaatgcgaaggtccaaggctgtgctttaaccatttcagtaataccagctttaaatgaaggcattgcataattaaagtaagtatcactcatccacgcaataccgaagattgcaatggttgccaccatacctgatttaaataccactgtattcggaatttttttcacatcggttttagccaatactaaaattaaaccaccgaatgctaacataatcatttggatgattttatccattggagcaactttacctgaagcggcaagcgttggtttcaatgacgggaacattgcaataactacaatcgttacaatcgccagtaagaacagataaacggcattttttgccgattgcggtaattgttcatttaaggttgtgctactggtttcttcaatacgtttacggaattcaggatcttgtaaacgacgttgatattcaggatcatcttttaattccttaccacgacgtaagctataaagcgacattgccactacaccaaggaacgttgccggaatagtaatagctaaaatttgtaataaagtgatatgttctgaccctggcatattgactaattcggtcaaataatatgcaacaactgcagaaaccgggctaccggttaaaccaagttgtgatgccacagaagcactcgccattgggcgctctggacgaatatcattcttcacagcaatatcggcaatgatcggcataatagaataaaccgagtggccggtaccaagcattaacgtcattgtgtaggttacgataggaccaagaattgtgatacgtttcggattcgcacgtaaaattctttccgctacttgtagcataaattttaaaccaccggcagcttcaagcacagaagcacaagccactacggcaagaataactaacatcacactaatcggtggctcagacaatggcatttgtaaaatgaagacctcaatgaataagcctataccagaaaccacacctaaaccaacaccgccgaaacggctacctacatataaaaatgctagtaacaacagaaattctgcataaagcatataaactccaaaaaaataataataatcactggttgcaagtttacttgagctgataccccgattctttgcatttgatcaaaccagcgtaacactttagtggtattttcgctaaatattgaacaaacatataaataaaggctctcggtacaccaaacagaaattctgttgatgatccgagtgctacgatacccgatattgaatagaataaaaacaccaaaaaatataatgttaaattgatgatttatttatacgctaaaataaattattacctattttatttaggggattttagtactaaaataaaaaagagtctcatactcatttgttaaggtctctgacctttgtttattatttttataactttatataacaatttaaaaggatgacatatgaaatctaccattaaatctatcgccgttacggcaattgcaagccttatcgccctttctagccacgcatcaggcgacaaagttccttatacccaagccggttttaccgttcgtcaagcagaacaacaagcaccgattcactgggtttcgattgaacaaatcaaagcaagtttaaaagatacgccaccaatgaacgttagttttgatattgatgacaccgttgctgcaaccagcggctgtttttattacggtcaacaaaagtattcaccaaatgaccatagctacctgaaaaaccaggacttttgggatgaaattaatgccggctgtgataaatattccattccaaaactgtctgctaaagcattaatcgaaatgcatcaggcacgtggcgaccaagttttactgattaccggtcgtcatgcaggtaaagatgatcaagtaacagaaattttaggcaaagcattaggcattaaaaatatgcaaccggtgaattttaccggtggccaaaaatccgaatataaacaaggaaaaacggctgcgatcattaaacataaagtacaacttcactatggcgacagtgatgatgatattttagcggcaaaagaagccggcattcgaggcatccgtgtattacgtgcggcaaactcaacttatgtccctcacccgcaagctggtggttacggtgaagaagttttaattaactcaagctactagttatgcgctaaaatagaagctgttggtcaatatcaacagcttttatttttaggagttacttatgattgagatttatctactgctcattccgctttgttttttaatctatcttgcctcttcatttgcccgtaaaggctttcttaaagccgtattgcatagtctgttactggcaatcagctggccgatttccttacctttactcgtattaaaacgtttattcaaacgttctcattaaagtataagcggttaaatttcctctcttttttacaaaaaaagcttgaaaacagaccgctttttctctccttaatcttcataaatttttattttctttataaaaacgccttgcattaaattgaataaaaatgcaaaataaaagcataattaatcaactcagcattttaaatttaattaaaaacttgatggcaatcgtttgctttgttagaattatgcgcctacttctacaagaaaggttaatggcgactctcaagtaccaacccaataaatttttaggagtaaaaatgttaaaccctaccctttttatacctttaacaggtataactcataagatagcaatcgcctttgctatcgcaacgcaattctttttaaagcattctcgccttgcaattcaatatttcctttatcaacgatcccgaataagtcctttcacttatacaagcggtcaaatttttaaaactttttacttatagcagacacaggagcaatatcatggcatttaatcttaaaaatagacacttacttagccttgtaaatcataccgaacgtgaaatcaaatttttactagacttagctcgtgatctcaaacgtgcgaaatatgcaggaacagaacaaccacaattaaaaggcaaaaacattgcattaatctttgaaaaaacctcaactcgtacccgttgtgcatttgaagtagcggcttatgaccaaggcgcacacgtgacttatatcgacccgacttcatcacaaatcggtcataaagagtcaatgaaagataccgctcgtgtattgggcagaatgtacgatgcgattcaataccgtggctttaaacaatctgtggtacaagaattagccgactacgctggcgtgccggtattcaacggtttaaccgatgaatttcacccaacccaaatgttagccgatgtactcactatgattgaaaactgtgaaaaaccgttaagccaaatcagctatgtttatatcggtgacgcacgtaataatatggggaactccttattattaatcggtgcaaaattagggatggatgtgcgtatctgtgcacctaaagcattgttaccggaagacagcttagttgaaatgtgccaaaaatttgcagcggaaagcggtgcaagaattaccgtgacggaagatattgataccgcagtaaaaggtgtagactttgtccatacagacgtttgggtatctatgggtgagtcacttgaaacttggggcgaacgtatcgaaatgttaatgccgtaccaagtgacaccggaattaatgcaacgcaccggcaatccgaaagtaaaatttatgcactgcttaccggcattccataacagtgaaaccaaagtgggcaaacaaattgccgaaaaatatccggctctagcaaacggtattgaagtgaccgaagacgtattcgaatcaccggcaaacgtggctttcgaacaagcggaaaaccgtatgcacaccattaaagcggtaatggtagcgagtttggcataataaagcccctctttagtaaagagcgggaaataatgaaaggaatataacatgaaaatcgtagtagccttaggtggtaacgctttattaaaacgcggcgagccaatgactgcccaaaaccagtcggcaaatatcaaaatcgccgcagaacaactagcaaaaattaaaccgaataatgaattagtgatttcacacggtaatggtcctcaagtcggattaagtgccttacaacacgccgcttaccatgcgattgataacaaaatcgagccttacccgcttgatgtattagtttctcaaaccgtaggaatgattggttatatgttgcaacaagaactgactaatctcgtgccggaacacccgactcaaaccttagtaactcaagtgattgttgatgctaacgatccggcttttgccaaaccgagcaaaccaatcggacaggtttactcaaaagaagaagcggaaaaattagctgctgaaaaaggctggactgtaatggcagacggtcaatattatcgccgtgcggtagcaagcccgaaaccacaatccgtcaccggtattgaagcggtaaaagcgctattggcgcaagatcaaatcgtaatttgcggcggcggtggcggcgtaccgagtattcgtgatgcacaaggtaaattacaaggtgtggaagcagttgtggataaagatcttgccactgcggtaatttcacagcagcttgatgcggatttatttattatcgcaaccgatgttaaagcagcgtgtgtaaacttcaacaaaccggatcaattacaaattgcgaaagcaaacccggcggaattggaaaaactggcggacgaatttgcaccggggtcaatgggaccaaaagtacaagctgtgattaactttgttaaagcaaccggtaaagatgccgcaatcggctcgctttccgatattcaagatattgtagccggtaaagcgggaacccgtgtcaccaacagcatttctggtattgagttttataagtaagcgaaaacaagcggttagattttactaaaaatctgcaatatgtaggggcgtaccgagtacgccccttttaatacaaattgattggttataaatgggaatattcataccatcgttttctgtgaagttccgtgtattccgtggttaaactcccatttgcaaaaaatcgaacaaatttaaccgcttgttgcataaacgaaagcccctaaaccataagatttaggggctttctctattgctttatcgctaaattattttttagcttgtgcttttttcacccataccgctgagattgagaacgcaacgataaatgaaattgccatacctacagagtacattgcaaggctgtccggtttgattgaaggcacacctaagaaacctgccgcacctaatgcaatcgctttcacattaaagaatgcgatgaatgcagaagccacacctgaaccgatcatcgcagcaatgaatgcttgacggtaacgtaagttcacaccgaacattgccggctctgtgatacctaataatgcagagataccagacggcacagctaaaccgcgtactttcgcatctttcattgcaaacgccacacctaaacacgccgcaccttgtgcgatgttagacattgcagcgattgggaagataaatgtaccgccagtgttcgccacttccgctaataattgtgtttctaccgcaataaaggtttggtgcataccggtaattacgattggtgcatagaatgtaccgaagattgcaccgccgataaaacctaagctgtcgtataaccatgttaagcctgctgaaatcgccgaaccagcttcacgaccgaatggaccgattaccgtgaatgccaagcaacctgcgatgaaaagcgacatcattggggttacaaggttatctaagtaagacggcacgaatttgcggaaacctttttcaagagttgctaacacccacgcagacacgattgttgggattactgtaccttgatagcccactttttcaatttctaagccaaatatattccaatattcgatgttgccttccgctagtgttttggcatagttccagccgtctgctaaatcagtgtgaactaaaagcataccgagcgccgcacctaagaacgggtttccgccaaatttgcgggttgccgagaaacctaataacactggtaaaaacacgaatggggcattcgcgatggtgttgataaaattgactaaatccgcaatgctagggaatttatcaacaacagaataacctgtgattgccgctttgttcaaggcttcttgcgttgctgcaatgagggcttggtcgccagaagcttgggctgcgttaaaggcagattgcgcttcggcaagtgctgcgtataatgtttcaggcacttcccagaagaacccttgcgcggtaagcattgagtggatacccattagcaaaccgcctgccacgatggcaggaatgattggcacgaaaatatccgctaaaccttttactaaacgttgtaataacggttggtttgctgcacctgccgctgcaacttcagaagtactcatatcgccgatacccatttgtttttgcatttcagcgtgtactttgtttactgtgcctgaaccaaaaataatttggtattgaccgctggttgagaattgacctttaacaccttcgatattctcaatcgcttctttatctacttttgattcatccgcaagggttaaacgtaagcgtgttgcacagtgtgcaagcgttgtgatgttgcttttgccaccgagtttctcgatcgtttgctccgcaattttcgggaagttcatagtttgccacctatttttatataaaaattaaacgattgcattttaactaaaacggtttagctaacaaagcaaattttgctaaaacgttttagttttgtcgattagatcacaattttagcaagtttagcaacaattaatgaataaattttgtacaaacaaagttaatttcttattaaactgcattcattaactggtcagaaacaatctgaccattttcaatcgtaataactcgatcaaaaagtgcacgactctcttctaattggtgcgtcaccattaataaagtcagctccgcttgctgacaaatctccgcaaccagtagctgcaattcttcacgacgtttcggatcaagcgctgaaaatggttcatctaataacaaaatcggttgtttgcgtaacaacgttctggcaagcgctacccgttgtttttgcccgccggaaagttgatcggctcgccgccttagtaaatcagcaatacccatttgttgggcaatctgctgaacttgttgttgctgtgcatcattcagcttcaaactagcaactaacgccaatccgatattttgttcaacagttaagtgtggaaacacattattatcttgaaacagcatagatacagggcgttccgctacttgtgtcgccgtatgattgcaagaatttagccaaatttgaccgcttgtcggcatttcaaaaccggcaatcagattcaataagctacttttacctgccccactttcaccgacaatcgccactcgttgccccttaggcacgtccaacgcaaagtgcattggcatttgttcataatcaaaatctacatttaagcgaatcatttcgtgttttctttttgttcaataaataaaaacggcagtaaggtaaataacatcaatactaaagcggtgaccgccgcatcttcggttcgatagctgcctagctgttggtataataaataaggcagagaactaaaatccagactgccaaaaaatgcaatcaccgcaaagctgcctagactggaagacattgcaaaagcaaaggcactgataagcggtcgaattaagtaatctttttccactatccaccaacggcgaaatccggttaaaccaaggctgcgggctaatttatcttgcgcagtaaacgaatgccacatagcggcaaatatcagtcgataaatataaggtaaaagaatcacaccattacaaacaccgactaaccataataattgcgtactgcttaattccacatcaattaataagacaaataaccctaccgctaataaaaataccggaaaaatcagcgggtaagttgccacactgtttaataatccgtattgccattttttatttgcaaatgccaattttcgtgtttctaaagctaataaatacgctaacactaacactacgctcgaggcgattaggcttaataagaaagaaaaccaagccgcttgccataagcttggattgagtaagcgctcaccaaaatcggaaacggatattcccgcccataagatggttacaagcggtaaaataatggcaaaactttgcaaaaaaagcaccgcttgcaagcccagctttcgccaaccaaaaggctttggcttccataactccaccggcaagggcgcttgccttgtctctttaaacgccattttactcgctatatccatcaataattgtaacaaaagccctactgctaattgcagcataatcagcatagtggcttttgcaaaatcaaactcaaaagtgaccgcttgataaatcgcaacttctaaggtgctgtatttagggctcccccccaaaataagcacaataggaaaactggtaaaacagatcagaaatacattggcaaagacataaggcaaaatactttttaaggtcggtaattcaactactcgaaaataattccatccttgcaaattaagttgtgccgctaaacggtatcgcccatttggaataagatttaaaccatctaagctatatttcatcacaaaagggatattgaaaaataaatgagcaagcaaaataccatgcaaaccgtaaagttgcagttcccactttaatcctaaaaattgaagaaagtaagcaaatacccctgcgcttccccaaaaaccaataatggcaaaaataacaaccagcgaaggtaatgcccaaacaaaagaaatgattttatagagaatagatttaccaacaaaatctaaataaaaaaaagaacgggctaataagacaccaaataaaatagaaaataacgctgacaacccggcttgtaacacactatattttaaaataggcagcatttctgaaaattgccaaaccgtctccccttgctgatgtccgaccaatgcaaacaaactaaaaatataaatagcgacaatggtaatatatattaaccatgcggggaattttgatacagaatgaaacattatttcctcagtaataaaattaatcgatttattttaacatttttttaaactatttttacgcaaacgtttggttatattttgtctcgtaaaaattgatatggggcaaagttaactcattttggttaataaatacgctaatattcaacctttaccacaagtttttctggttttgagcgtgtttttagatcttttttgtagtaaagttagcacaaatagtaataggtttgatgaccaaaactgatttttttcactttaaaaattcaagaggaattttctatgtactcaaaagacgttgttattactgcacctaacggtttacacactcgcccagcagctgagtttgtaaaagcagctaaaggtttcgcttcagacattaccgtaacttctggcggtaaaagctcaagcgcaaaaagtttattcaaacttcaaactttaggcttaactcaaggtacaacaatcactatttctgcggaaggtgaagacgagcaaaaagcagttgatttcttagtagatttaattcctactttagaataattattctttagctcccatttacaagacaaccctatcctactcgactaaatcataaagtggagtaatagggttgtattatgctatctaagcattaccgaatcacttttaaaacaaggacagactatgattacaggtatcgcagcttctccaggcgttgtgtttggcaaagcactcgtattaaaagaagagccaatcgtactcaatactcagaaaatcacagcggatcaaatcgaagttgaaaaagcgaaattctttgctggtcgtgaaaaagccgcagcacaattaactgcaattaaagaaaaagctagacgcactcttggtgaagaaaaagaagctatcttcgaaggtcacttaatgatcttagaagatgaagagcttgaagaagaaatcttaggctatattgctgataaccttgtaactgcagatgttgctacaagtaaagtgattgatatgcaagcttctatgcttgcagaaattgatgatgaatacttaaaagaacgtgctggcgatatccgcgatatcggtaaccgtctattacgtaacattcttggtatgcacatcatcgatttaggtgatattcaagaagaagttattttagttgcttatgacttaacaccttctgaaacggcacaattaaacttagataaagtattaggctttattactgatattggcggtcgtacatctcacacttcaattatggctcgttcattagagcttcctgctatcgttggtacaaatgatattaccgcacgtgttaaaaccggtgatacattaattttagatgcagtaaataaccaaattcacattaatccttcagacgcagaaatcgcagaattcaaagcggttcaagaacgtgttgcggctgaaaaagcagaacttgcaaaattaaaagaattaccggcggaaactttagacggtcaccgtatcgaagttgcaggtaatatcggaacaatccgtgatgttgacggcgtattacgtaatggtggtgagtctgtcggtttatatcgtaccgaattcttatttatggatcgtagcgaattaccaggcgaagaagaacaattccaagcatataaagaaattgttgaagcaatgggcggtaaacaagttgtgttacgtaccatggatatcggcggtgacaaagaattaccgtacttaaacttaccaaaagaaatgaacccattcttaggttggcgtgcggtgcgtatcggtttaacacgtcgtgaaatcttagatacgcaattacgagcagtattacgtgcatcagcattcggtaaattagcggtaatgttcccgatgattatctctgttgaagaaattcgtgaattaaaagcaatcgttgcggaattaaaagaacagctccgtgcggaaggcaaagcattcgatgaaaaccttcaattaggtatcatggttgagactccgtcagcggcggtaaatgcacgtcaccttgcgaaagaagctgacttctttagtatcggtaccaatgacttaacccaatataccttagcggttgaccgcggtaatgaaatcattgcgcacctttacaacccattaagcccatcagtattaaacttaatcaaacaagtaattgatgcgtcacacgctgaaggtaaatggactggtatgtgtggtgaattagccggcgatgttcgtgcaacggcattattacttggtatgggcttagatgagtttagtatgagtgcaatttctgtgcctcacgtgaaaaaacttgcacgttcaatcaactatgcagatgcaaaagcattggcagacgaggcattagcacagccgactgcagctgacattgaaaaattagttaacgatttttacgctaaactgaactaattttcaataaatagcatacaaaaacagaattctcgtatagaatgtacgggaattttgtttattatttaaataacggagatttctatgggctttttcgacaaattatttggctcaaaacaagcagcggcaaaagaggttaaagtttatgcacctctttcaggtgaaattgtaaacatcgaagatgtaccagatgttgttttctctgaaaaaatcgttggtgacggtgttgcaattcgtccaaacggtgacacaatcgttgcgccagtaaacggtactatcggtaaaattttcgaaacaaaccacgcattctcaattgaatcagatgaaggtgttgaattattcgttcacttcggtattgatacggttgaattaaaaggtgaaggttttacccgtgtagctcaagaaggccaatcagtaaaagctggtgacccgattatcaaatttgatttagaattacttgaaagcaaagcaaaatcagtattaacgccggttgtaatttctaatatggacgaaatcagcaacttagacaaaaaagtcggtcaagttgttgctggtgaaagcgttgtattaacattaactaaataattgatttagttgaataaataactgccacgatagtaaaatatcgtggcatttttattggtctaattttatttagttatagcgaaaaaataatcaaacgggtaaaatggacataagtttttgcgtaaagggatttctctttacgcttttattttctacttattaataacttattatttttgagacattatggcgaaattacatattacaacttggggctgccaaatgaatgagtacgactcatcaaaaatggcggatcttctaaattctactcacgggctagaacttaccgataaaccggaagaagcggacgttttattacttaatacctgctcaattcgtgaaaaagcacaagaaaaagtattctcgcaacttggtcgctggaaaaactggaaaaaagataaaccggaattaattatcggcgtaggcggttgtgtggcttcacaagaaggtgagcacattcgtgagcgtgcaccgtttgttgatatcgtattcggcccacaaacattgcaccgtttaccggaaatgatcaacaaaatccgtggtggagaccgtgcgatcgttgatatttctttcccggaaattgaaaaatttgaccgcttgccggaacctcgtgctgaaggcccaactgctttcgtttcaattatggaaggttgtaataaatactgctcattctgcgtagtgccttacacacgtggtgaagaagtttctcgtccggtggatgacgtattatttgaaatcgcacaattagcggaacaaggcgtacgtgaagtgaacttactcggtcaaaacgtgaatgcttatcgcggtgaaacttttgacggtggcatctgcacatttgcagagctactgcgtttagttgcagcgattgacggtatcgaccgtgtacgctataccaccagccacccgattgaatttaccgatgacatcattgaagtttatcgtgacacacctgaattagtgagcttcttacacttaccaattcaaagtggtgcggatcgtgtattaacgatgatgaaacgtaaccatacggcattagagtataaagcgatcattcgtaaactacgtgaagttcgtccgaatattcagatcagttcagactttatcgttggcttcccgggtgaaacggcggaagacttcgaacaaacgatgaaagtgatcgaacaagtcaactttgatatgagcttcagctttatctactctgctcgcccgggtacaccggcagctgacttaccggatgatatttcggaagaagagaaaaaagaacgtttagcgcgtttacaacaacgtatcaatcatcaagcaatgcaattcagccgtgcaatgttaggcacggaacaacgtgtattggtggaaggcccgtctaaaaaagatattatggaattaaccggccgtaccgaaaacaaccgtatcgttaacttccaaggcacaccggatatgattggtaaatttgtggacattaaaatcaccgatgtttataccaactcattgcgtggcgatgtagtgcgaaccgaagacgaaatgggcttacgtgtcgtagaatctgcggcaagcgttatcgcccgtacgcgtaaagaagacgaactaggtgtcggcaaatacgtggtaaatctgtaaaagattagataaaaaaactcagccttatggctgagtttttttatgtacaaacgttagagacagctgtaacaagcggtcaaatttagcctattttttgcaaattttgcaacaaaaaagaccgcttgtcgaatgatctccttatgccgctttcttacgtgcaagaatacggtttgcacattctgctgccgcggttaaaccgcctgccatcataataatatctttcacaatcaagcgaccaacaccggataaataagggaagccgtgtgccggcgtcggcatatcaccgccaaggtttggtacccacgcctccggtgtcgtaattaagaaagagagcgtgacaatcgacataccaaaggtaagtaaaccaccggctaaacctgcagttgcattccaaataccaagtaaggttaaaataccaacggttacaatcgttgcgccaataatataagaagcggtgtaagtgccgttttctttatgccattcaatatttttcgccaccattttgccttcaggatttttatgtaaggtatattccatcaccatttcacctttatcattcggcacaaggttagggcctttttcatacatataactgaagaatggactattcgacacaaaatgcgcaataccgtccgcttcatattggcaaactttgagtccgccaatccatgccataacgataaaaatcgcaatacgaataaagttgataaattggcgctgcatcggcgcaacgattttcgcaacaaattcaacaaaaatgttaaatgcgttcatttttaacctctataaatacaaattcaaggataagaaacaatttcttatcactgtttcgtaccccttaataagtatttcttacaggtcaaaacaaataaattttaatttataattaaaaagtctaatcaatatattcttatgttaaaaaagcataaaaaatgtttattatgtaggcaaaattaatgaacatagcccgcatcaatatcggcatccggatttactttatcgtatttttgttcgttggttttaccggtataaatttccggattttctgcgccttcaacaattaacttaccttttgcccctttatcagttctaaaaatactgtgatcaataaaggtatattcgcccggcaccttcatttccatttcaaccacagtaacaccgcctgccggaatcaatgtcgtttgcacatgatggtttttaagcgctccaccttcaacatagaccgtatcaaacggttttccgatcaaatggaaagaagagactttatttggcccggcattaccgacaaacaaacgtactttttcaccgacttttgcctttaaagcattttcacctgtcgttgaaccgactttaccgttaaacaccacatagtcaggtaattcataactcgcttttgtcatatcgaaaattttcagttcaggatttgcgccgtcttttacataaaattcattttgcattaaataaaattctctatcgactttcggtaatccctcttttggttctaccagcattaaaccgaacattcctttacccaaatgcactgaaaccggatcggctccgcaatggtataaatataatcccggtgacatcgcccgaaaggcaaactttgtttgcttaccgatttcagttaaacttgctttagctccaccgtccggtgcagcagcagagtggaaatcaatcgcatgtgccattttaccgtttgccggattggaaacctgaacttcaaccatatctccctcacgaactcgaataaaaggtgccggcgttgaaccattgaacgtccaatatttaaatttcacccctttttcgatttccatcactttttccagagtttccaatttaaccactacttttgccggtgtattgcgcactaacggcttgggaacattcggcgcaacggttaattccgcctcaattgtcggtaaatttttaaccggaattaaatctggattttcagctattgtttgttctgccattagtggagcactaactaaaaatgcagcaaaacaaagggtaataagagactttttcatcggtaattccttcgtgtatgaaaccttcgtttaaattataatgactaaaatcaacaagcggtagaatttgaaatagtttttgcaaaactaaaccgttttagctaagataaattaactattttttactagataaagaggcgtgtatgagcaagatttgggtaacaggcgatgcggtggttgatttaattccggacggtgaaaaccactatttaaaatgtgcaggcggtgcgccggcaaacgttgcggtaggagtttcacgtttaggcgttgaagcaggtttcatcggtcgagtaggtttagatccgcttggcaaatttatgcagcaaactcttaatgcggaaaaagtttcgaccgaacatatgatccttgatccaaagcaacgtacttctacggtgatcgtaggcttagatgacggtgagcgcagttttacctttatggtgaacccaagtgcggatcaattccttgaagtcagtgatttaccaaccttccaaaaaggtgatttcctacactgttgttctatcgcacttatcaatgatccttctcgctctaccacaattgaagcgattcgccgggtaaaagaagcaggcggcttcttctcatttgacccgaatttacgtgaatcgctttgggcaagtcttgaagaaatgaaacaagtggtaaatagcgtggtagcgatggcagatgtacttaaattctctgaagaagaattaacgctgttaaccaataccactacacttgaacaagcaactcaagtgattaccgcgcaatatccagagaaattaatcattattactttaggtaaagacggtgcgatttatcacttaaacggtaacagccaagtggttgcgggcaaagcgttaaaaccggttgataccaccggtgccggcgacgccttcgtaagcggcttacttgccggtttatcacaagttgcggattggaaagacgaaagcgtattagtggatgttattcgtaaagcgaatgcttctggcgctttagcaacaacagcaaaaggtgcgatgtcagcattaccaaacaaagcagagctagaagcatttttagcgcaataatcacaacaagcggtgaaatttcaccgcttttttgcaatttaggattttactatgcacattttcaataacggcaaatacaaaagccttcacgcagcagaacaaggcgaattagccacaatccgccaaaccgtgctttctgataaggatttctatccaacctaccatttagcgccacaaatcggtttatttaacgatccgaacggtttaatttttgacggtgagaaataccatatcttcgcacaatggttcccttatgatgccttgcatggaatgaaacactgggaacattttattacccgtgatttccaaacttttgaaaaatccgaccgcttgatcccagatgaaatgtttgaatcacatggttgctattcaggcggtgcaattatgtggcaagacaaaatcgtagcgttttacaccggtaatactcgccgtgcgagcgataaccaacgtgttccgcaccaaaatattgcgatttttgataagtcgggcaaattattggaaaaacgttgcattatcgaccaagcaccagccggctataccgagcatgttcgtgatcctaaaccgtttgtgactgcggaaggcaacattcgctttgtgcttggcgcacaacgtgagaacctaaccggaacttgcttagtgtatgaaatggacgatctcgatagtacacctcgtttaatttccgaattagcggtaaaagactttgataacagcaatgtgtttatgtgggaatgtccggatctgttccaacttagcggtaaagatgtgtttgtttggtcgccacaaggcaaattacgtgaggcgcatcagttccaaaacaattatcacgcgacctatgcgctgggcaaattagaggggaataacctaacagccgagcatattgaagagctagactacggttttgatttctatgctcctcagtcagtacaaaattctgatcgtattgtattcggttgggtcggcttaccggatttaacttatccgactgataaatataaatggcattcaaccttaagcctgccacgccaaataaaagtagcaaacggtaaaattcagcagacaccaatcgttcaactcgccgcaaaacaagcggtcgaaattgaccaaacaattgcaattgacaatcttgatacggcttatttgcaaatttctgtcgaaaatcaaccgcttgcattaaacttctttagcaatgataacggacaaacattgggcttacgttatgagaacggtttattaacactagatcgcagtgcaacggagcagaccgatttaatggaaaaatttggtagccttcgtcattgccaagtggataaactcgacagcttagagattttctttgaccgttctgtggtagaaattttcatcaatagcggagaaaaagtgatgacatcacgattctttattgcaaatcgaatcaatctgttagaaacttctcgtccgataaccgtacaagttgcccaagtgcaggcaattcaaatccaaaattaaaataataaggcacaagtaaagcttgtgccgttttacttccatacgaaaatcattttgaggaaaaaaccgtggaatcaaaacctaaaaaacgtctaacgctcaatgatattgccgcactcagtggggtatcaaaaacgactgcaagtatgattcttaacggtaaaagtgatgattttcgtatcaagcctgaaactcgccaaaaagtacaagcgattgccgagcaatacggctatcgtgctaatgtttatgccaaagcattacaagcacaacgctctaacgttattggtttggtgattccggatctcaccaattacggctttgcatccaccgctcgtaatcttgaaaagctatgccgagaaaacggtttacagctagtgattgcctgttccgatgataatccgcaacaagaaaaactggtgattgagcgcttattggatcgtcaggtcgatttgctgattaccgcaccaactcaccaagatccgaactattatcaaaaaatcattcgtcatacaccggtcttgcatatcgaccgccatatccctaatttggaactaaattacataatcagtgatgacacgccaagtgtcgcgaagttggtggaaaatatcgtacgagcttatcaaccgaaagaatttttctatttaggcggtcaattatcactttcaccgagcgcctctcgtctagaaggcttctatgaaggcttggagcaatcacacttagcggcccaaagcagttggattttacataaagattaccaaccggaatcgggctatcaaatgtttgccgagatcgttgaacgcttgggacgtttacccgaagcggtatttaccgcctcttacacgattttggaaggtgtattacgctatttgaccgaacataagcaaatggcaaaattgatgaatcaagagttacatttagcaacttttgatgatcatcacttattagacgctttgccgtttcatattcactcgattgcacaagatcatgaacaaattgcgctgaaaacattccagcttatgcgagaaaagctacaacgcaaagcaattagtaacgccaaagttgattgcgaaattatttggcgacactaaaacaaatatagttatttttaaaaggatatcctatggcacatttttatgaatatttagaatttagcagtgacgaagaccgtgaaaatcagcttgaggtttacgttgatgttaaactggaagcggaaaccgaagaaaagcttaaagcactcggcgtacaaggcgactggctagtgatggctgagccttattgccctgattgtgtagaaatcgtggcttacttccaacgtatgacgaagctcaatccgaatatcaaagtgaaatacgtttcacgtaaagataacaaagagcgtaagcattttgacagtgatgagcaacaacaagcggttatttctgcacagaaaattccaagtatctttgatattcgtaacggcaaaactgaattagttttatgtgagtttccgcaattcttaaaacagaaaatggaagcggagccggaaaaatttgatgaactaaaagccgatttccgtatgggcaaatttggtaaacaagtcgaagcggaattattagcgattttaacgaagaacgcataagctattgataaacccaccttacaagtgcaaccaagccctaataggtgggttttctatataagacgttttatataaaacaaatgataatacgcataaaacttcggaatacgctgcttgcttgaggaaagagaaattttagatataaaaaaagcacctcatggtgctatcttattttgaattgataaaatggagcgggaaacgaggctcgaactcgcgaccccgaccttggcaaggtcgtgctctaccaactgagctattcccgcattgaaattattttaatttaaaataatactgcgttgccttcgcttcgctgtactatttgtactatccttcagctcgtcgccttgtcttattttaaatataaataatttggaagtttattatcgaatggtgcccgaggccagacttgaactggcacgccccgaaaggcgagggattttaaatcccttgcgtctaccgattccgccactcgggcttcgataattaattttattttaagctttaaaatggtgcccgaggccagacttgaactggcacgccccgaaaggcgagggattttaaatcccttgcgtctaccgattccgccactcgggcacaaccgttttaaatcttaaaatggagcgggaaacgaggctcgaactcgcgaccccgaccttggcaaggtcgtgctctaccaactgagctattcccgcataatttaaattttgtcattctaaaatggtgcccgaggccagacttgaactggcacgccccgaaaggcgagggattttaaatcccttgcgtctaccgattccgccactcgggctcatcttaaaatggagcgggaaacgaggctcgaactcgcgaccccgaccttggcaaggtcgtgctctaccaactgagctattcccgcaataaaaacgctacgttattgcgtagcgatttatgtgccgtattttagggatttttgaaaagttgtcaaacacaaatttcaaaaaaagtttcgttaggcgaaaaatcaatccatttgacgattttttgctataaatccgtttattattccaaaaagcaataaagaaaacagaatagttattggaatcccaacttcaattttcataataatgattacactttatatttgtacgaggatcttatgttaatttctggtctattttgtggtttcctacttggtttcgtaatgcaacgtggacgtttctgtattaccggtgcatttagagatctctatgtcactaaaagcaaaaagatgtttattgcattattaattgcaatcagcgttcagtccattggcttttttatccttcaagaagtcggttttattaatttccaaccggctgagaatttctcaccggttgcggttataagcggagcttttctctttggtatcggcattattctggcaggcggttgtgcaaccggtacttggtaccgtgccggtgaaggattagtcggtagttggattgcgttagctacctatatgctatttagtgcaatactgagaaccggcccgttaggttcatttaacaatgaattacgtagtataactatcgaacataaaactatttatgaaagttttggtatttctccttggattttagtcattctgattgttggtattactggatttgccgtctttcagcaactgcgcaagcccaaaactaaagtcgcgacactcaaaccgaaaaaaacaggcttagcccacattttatttgaaaaacgttgggatccgtttgttacagctatcatcatcggcattattgcgatttttgcttggatctttagcgtaccgacaggtcgtgaattcggtttaggtattaccagcccttctgcaaatttattacaatttttagttaccggagaaagcaaatttattaactggggcgtattactggtgttaggtattttaattggttcttttattgcggcgaaaggtgcaaatgaattcagagtaagggtaccggacagtaaaactgtgatttatagcgcaactggtggggtattgatgggaatcggcgctacacttgccggaggctgctcgatcggtaatggcttagtcgaaacctcattcttttcttggcaaggttgggtatcgctcccaatgatgattttaggcacttgggtggccgcctactttacgattattaaaccgcgtgcaaacgcataaacactctataaggaataataaaatgcaagtaaaattagaaacatccggcttagtctgccctttcccgcttgtagaagctaaagatgcaatggcgaaactaaataaaggcgatgaacttgtcattgaatttgactgtactcaagctaccgaagctatccccaactgggcagcggaagaaggttatgacgtgacagacttcgaacaaattgatgatgcgaagtggacgattactgttgtgaaatagccaaaagcaagcggtgacattttgctaaaaatttgcaaattttcaccgcttgcccttaatgaattaaaccaatttttcaatcaaagctgaaacaaattccaatcgttccgcattgcttgcaagcggtaaattaaagcggaatttttgcgcgccttcaaatttatagacgttcttatccgattgaatcagttgtaaaaacttcatcgggtcaggttgtgcgctcggtttaaattccaaatagccaccgttaatccctgcatcaactttcttcaagccgagcggtgttgccaaatgacgaagctgagtaatttggaatagatttttcgttgcctccggtaatactccgaagcggtcgataagttcgactttcaaatctttcaatgcatcaacactttctgccgaagcgatccgtttatagaacgataaacgcatattcacatccggtacataatcgtctggtaacaatgccggtatgcgtaattcgatttctacctgattttgagtgatttcttctaaagtcggttcacgcccttcttgcaacgcttttactgcattttcaagcagatccatatagagtgagaaaccgatactttcaatctgtccgctttgttcagagccgagcaattcgcccgctccacggatttctaaatcgtgagtcgctagcacaaatccggcaccaaggttatcaatcgaactgagcgcttccaaacgctgttgagcgtctttggttaatgtttttggcggtggtgtcagcaaataggcgtaagcctgatgatgagaacgtccgacacgtccacgtaactggtgcagctgtgccaagccgaatttatccgcacgatcaataataatcgtgttagcggtcggcacgtcaattcccgtttcgataatggttgagcaaaccaacaaattaaaacgctgatgataaaaatcgctcatcacacgttccaattcacgttcacgcatttgtccatgcccaatcacaatccgagcttccggcaccaattctgctaattttgtcgcacaattttcaatcgttgccacatcattgtgcaggtaatacacttgcccaccacgcagaatttcacgcagaatagcttctctcacaaccagatcatcatgttggcgcacaaaggttttaattgttaaacgacgtgccggcggactagcgataatagaaagatctcgcataccgtttaacgccatattcagcgtacgaggaatcggtgttgcggtgagcgtaagaatatcgacattagctcgtaattgtttgatcttctctttctgacgtacaccgaagcggtgttcttcgtcaataataagtaaaccgagatcacggaattgcacgtcttcttgtagcagtttatgcgtgccgaccaaaatatccactttaccttccgccaccttttccaaaatcgctttttgctctttagcggttttaaaacgagaaagtacctcaacattaatcggatagtttgcaaaacgatctttgaaattctcgaaatgttgttgtgctaaaagcgtagtcggcacaagcacagcaacctgtttatgattttccactgctaagaaagtggcacgcattgcgacttcggttttaccgaaaccgacatcgccacagacaaggcgatccattgcttttggcaagcacatatcgctaatgaccgcattgattgcggttttctggtcttcagtttcttcaaacgggaaagtgtggctaaattgcataaaactgtctcgatcgtaggcaaacgcaaagcctttttgcgattctcgtttcgcatacacatcaagtaattccgctgcaacatcgcggattttctccgctgctttttggcgtgttttcgcccatgcttccgaaccaagtttatgtagtggcgcagtttcatccgccccaccgatataacgggaaatcagatgtaatgaagccaccggtacatagagcttcgcctcgttcgcatattgcaatacaaggtattcagctttaataccgccggcatccagcacagttagccccgcataacggccaacaccgttttctaaatgcaccaccgcttgcccaattttgagttctgcaaggttacgaatgagcgtatccgggttgactgttttacgatttttctccgaacgttttgtttgaactttttcgcccaagaaatccgtttcgcaaataattgccaaattttgaccgcttacattttcaatgataaagccttgatcaagcggtgaaataatcagtgaaatttgcgaatcaatttccgctaacgatttaacctgtttcggtttgatttttagcggtgaaagtaattcaagcaaggtttctcggcgaccttcactttctactgaaaataaaagctgcccatcgaatttactacggaatttattgaacgcatcaaacggatcttttaactgcgaattaatcgctaattccggtagcttatcaatattggcgttctgtttagctgccgattttctgactttttctgcacttagcgtcaaacgtggataagcttttaagccacgattgacttcatcaaccgagaaccataatttgtccggtggcagtagcggacgcatcggatcaacgcggcgactttcataacgctgagcggtatctttatggaactgctctgctttttctgcaatgccgtcaaaggtaataaataaggtattttccgctaaataatcaaataggctcgccatttcttcgaagaatagtggctgccaatattcaatccctgcgttcaaaatccccttactgacttgctgataaatatgctccggttcacggcggatctcaccgaattgttcacggaatttgcttctaaaatgctcgatcccattgctatcggtcgggaactcgtgtgccggcagtaaattaatttcgttgatttcggctattgtgcgttggctatccacatcaaaggtgcggatcgaatcgatttcatcatcaaaaaaatccaaacggaacggactttccgcccccataggatagaggtcaagcaatgctccacgcaccgcatattcgccgtattccaatacttgttccactgctcgataaccggcattttccaactgtaaacgtaacgactgaattgaaaagcggtcacctttcttaatcaataatacattattggcgagatagctcggcggacaaactttctgtaacagcgtattgattggcaatagaaaaatctgtttattaccttgttgcaaatgaaacaaggcggaaagacgggcggaaataatatcttgatgcggtgaaaaattatcgtaaggcaaggtttcccaatctggaaagaccgaaaccggcaattggctaaattgcattaaagccttttcaagacgtaatgcggtgcgggtatccggtgttactactacgcttaaaccattaaactgcgccgcagcttccgcaatggctaaagtatctgaatgcccaactaaattaccgagcgtttgatgatcttggaatttgcccccttcttgctgagcaattaaaggcagattaaactgaataaatgacataagcggtcgattttgttgaaaaatttgcaaatattgtagcccaaagcctcatttttacaaaaccgattaatagataaaaggggactacaagagtcccctttgttaatgaatgtatattaaattaagcgtagaagcttacttgctcttgttgtacttgtactggagtgtatgaaacacaaatatcacaagaaccatcagtgttataaactacgtcaactgttgcactaccgtctttgaaatcgaattgctcaattgagtttgcgccgtcatttaagtagttaactacttcgataaagttaccttcatccgtagtatctgtaataaataagttactacctttaaggctgaatgttacttcctctgaatttaaatcagtgaatcgaattaaatcaaaatcacttttcgcacctttgtctgcaacaacatcgtgaccgaaatcaccgctgaagatataagtatcactacctacaccaccagaaagatagtcgccagcaccaagaccgcctactaagatatcgtggccttcgccaccgaataaattatcgtgaccgccgaaaccgtataaagtatcgttaccagcaccgccatcaatcagatctttcaactctgtaccgcaaagcacattatcacactcatcgccaaaaatttcattatcagcttcccatggtggggttggagcatcatcttccggacaaccacagattggatcttgtggaacaggttcttgaggaacaggctcttgaggaactggctcttgtggaacaggttcttgaggaactggctcttgaggaacaggttcttgtggaactggctcttgaggaacaggttcttgaggaacaggttcttgtggaacaggttcttgaggaactggttcttgaggaattggctcttgtggaattggttgttgtggatcaaacggacgttgaggatcaattggtttttgaccgaaatcaggatcatcaaattgaattggtttttgaccgaaatccggttgttgaacttctattggtttttgttcaaaaattggttgttgaccaaaagacggtttaaaaataaatcttccataagaatggaaaaaagtattaataaatccgctaacactaatgctatgtgtgattcgtgctacatacatataaatttctcctagtataaattaactaatgcaaatttaattaaatttgcagcgaaattatatactagactttatgccatattttttacccacggtaaatttatataaaaataaatttacaaaataaagaaaataatttaaaccaaattcaatatgaataaaatttgaaacaaaaaattaaataacttatcttaaatatcattaatcaaattagattaatattaatttgattatcaaatgaatttttataatcaaccaagatagctacttgataatcaataaaagtaaactgttcaatataattttcttgattcgttacataatcaacaatctcaacataatttccttctcgagtcatgtcagtaagcaataaatttgtaccattcaagttaaaactaacttcatcaagcttcaaatctttaaatagtaatatgtctttatccgcaatatttccaaaatcagcaataacatcatagccaaacaccccgctaaaaatataagtatcgtgacctaaattaccggaaaggtaatcatcatcagcttcaccatttaaaatatcatttccttctgcaccaaataaattgtcatgcgaggttccgccataaagttcatcgtcaccaataccgccatctaacatatcctctcctgctccgccatataagctatcttttcctgtttgcccatagatttcatcattatcctcattaccataagcaatatcatcgccttcatccaagtaaacgttatcattacctatacctgcatatacatggtcactacctgtttctccataaacaaaatcatcacccgctccagccgttaccatatcatctccgctaccggcatatagctcgtcatgcccattgccactgactaaaatatcatttcctgccttagcaaaaatacgagcatcttcattatccgaatgtaaggtatcatttacagccgtaccatagatataaaaagaaccgctgatatttgtaatacttttattatcaataaaataaggtgctagctcgctaatcgctttatcatcaaatacaagttctaatgattgtgcttcatctaacgcattaaaataggcatcaatcattacctgatcggtttcattatcaaaagcgctaattactaaatcattagatactcgctcaaatttcacatttttcgcttttcccccctgaaaatgtaaaaccgaactttcttctaaaatattgccgtcaaataccgtatcttggccatcgcctttattaaatatataggtgtctttcccatatccgcctcttaggatgtcatttccttgcaatccaaccaaactatccataaaaggcgttccattgataatttcattattttctgtgccaataatctttccactatccgttaaagaaacttgattggtatttatttttttatcttggtaagttaaagaaaggattgtataagaagagaaatcttggatttctatttgatcagaactatccggataaggtttaatagtgaggatattattagagaggtaataacgaacttggctagaaattgcatcaggaaaagtaatgttttttatgactcctttatcctttatcacatccattcctccgcctctagtaaaaacataatcgctataaagtccagaaagataatcattgccagctgttccataaacagtttcgccatatttcgcctcaataacatttgtatattcgctcataacttactcctaataacacaatttagataaaacatatctacttgaatatataccaataataaaacaagaagaaatactaaattttcattacagatttcgtttaccatctcttttaactttaaccgttcagtaaaatcaactagcgtttcttttatgcaggaaaagcatatagaaatagattgaagataagcggtgagattctttggaaaatttgcaagcttttagtagaatatatgcgcatttcttcggtgagtacaccctgccaaataaattaaggaaaacatcatgcaacctaaagcaaaatatagaaaagattatcgagcaccagattttacaattacagatatctctcttgattttcaacttgatccagacagaacctttgttacttcaactttatccgtagaacgtaaaacagcaggagcctctcacctacgcttagatggacatagttttgatttcctttccctcaagctgaatggcgcttcttactctaatttcgaaaaagatgatgaatctctaactattgatgttagtcatatcactgaagataaattcgagttacaaattgaaaccggtttaaatcctgcgcaaaacacttctctacaaggcttataccaatctggtgacggtatctgtacccaatgtgaagcggaaggattccgtcaaattacctatatgttggatcgtccggacgtacttgcaaaatatcgtacaaaaattaccgcttctaaagcgaaatatccgttcttactttctaacggtaatcgcattgcacaaggcgatttggaagacggccgccattgggtcgaatgggaagacccgttctttaaaccaagctatttatttgcattggttgccggtgattttgatctgttacaagataaatttactactaaaagcggtcgtgaagtggcattagagatctatgtcgatcgtggcaatttagatcgtgccggttgggcgatggaaagtttaaaacgctcaatgaaatgggatgaagatcgcttcggtttagaatacgatttggatatctatatgattgtagcggttgatttcttcaatatgggcgcaatggaaaacaaaggcttaaatgttttcaactctaaatttgtactggcaaaaccggaaactgcgaccgataccgactatctagatattgaaagcgtgattgcacacgaatatttccataattggaccggtaaccgcattacttgccgagattggttccaattaagccttaaagaaggcctaaccgttttccgtgatcaagaatttacctcggatttatggtctcgtccggcaaaacgtattgaagacgtacgtttattgcgtgcagtacaatttgccgaagatgctagcccgatggcacacccgattcgtccggaaaaagtgattgaaatgaataacttctatactgttaccctctatgaaaaaggcgcggaagtgattcgtatgattcatactttattgggcgaagaaaaattccaaaaagggatgcaattatatgttgcagaaaatgacggttctgcggcaacttgcgaggatttcgtatcagcaatggaacgtgcttctggtgttgatttaacccagttccgccgttggtatagccaatccggtacgcctgagcttagcgtgagtgatgaatatgatgaaatgcaccatgtctatcgtttgcacgtgtcacagcatacgccggcaactgcggatcaattagaaaaagtaaacttgcatattccattaaaaattgagttgtatggcgaacaaagcggagaaccaattgcacttcaatttgaaggtacagaacagcataacgtcttgaatgtattgcaagagcatcaaacatttgaattccataatgtgatgcacaagccggtgccagcattgctatgtgatttctctgcgccggtacgtttagattataactataccaatgagcaattaattacattacttaaattcgcacaaaacgattttgtacgttgggatgcagcacaaaccttattcaataacgagcttcgtgctaatttgtctcgctatcaatccggtgaagcattagcattttctgaggagttaactgaggcacttatctatgtacttgataatgcagataaagatgtagagctaaccgcattaatgctgacgttaccgaaagaaaccgagtttgccgaattatttaaagtcattgatccgaacggtatcactatcgtacgagaatttatgctaaaaacgattgcggaaatattacgtaatcgtttacatgaaatttatgttcgccataaatgcggtacttaccaagttgtagcggaggatatgtctaaacgcgcattacgtaacgtatgtttatcttacttagcctttacggatttaggtaactcacttacttataatcactataaacaagcggataatatgactgatacgctcgctgcactttccgctgcaaccaaggcacaattgccgtgcagagatcaattgttagcagattttgaagagaaatggcaccatgatggcttagtaatggataaatggtttatgctccaagcaactcgtcctgatgacaatgtacttgagatcgtgcaaagcttattaaatcaccgtagttttaacttcaataacccaaatagactgcgttcattggtcggagcattttgtggtcagaccccgaaagcattccatgcaattgatggttctggctatcgtttccttgtcgatattttaattaaattaaatgaaaccaacccacaagttgctgcacgtttaattgagcctttgattaaattatcacgttacgacaatcaacgccaaaccttgatgagacgtggcttagagcgattaaaaggactagataatttagcgagagatctgtttgaaaaaattgaaaaggcactacattaatattattaattgcatgctatataattagattaaaatttataatgaaggtggttgtatgcttattatttactaaaaagaaagactatatttgtgctaagggtattttcaaattctttttttgggatataatggccttactttaaaaaaaatgaacatgcgttcataaatgttcgaagcttgagttaattgatgcaggaagcggaagttgatttaagtgtttttaaagtaaccttacatacatacaatacttctaataaaagcttaattcgaccgaattaagcttttttatttgtagagaataacgaactaaaaatgatctgccctcccaaaaagtcagactgtttattcacttaaatactggactcagtattatgccgagctcgccccttgtaaatccaacttaatcattttttagttgtaatacaccaaatattcttcaatttctgctgttgttcttgacagtcgagttcctccagcttttttaagtaagcaatctccgctcgagtaagtgtaagctcacgttgtaactttttaaatgcttgaggcgaaaggtcggtaggctcaggtacatcaatcccttgctttttcgcttttcagcagttgaagtggcgaacaaggtgattttcccccttctaaacccctttcacgaaaggcttttagctaattaatcacaagtgaatggaaaatctgatgaagtttagctatttcacggataccaaagccctgttcgatgatgagtttgataatttctaaacgaaattgataagaataagacataatctgcacctcaagttaaatgtccaagttttggggtgcagatcaacaagcggtcaaatttgaccgcttttttgcaattcgctacataaaccaaccggttggcgttaccgatttgttatcaaataattttaccgcaccgtagataacgcggaaaatataccaaatcccaatcgcccaaatcaccaacacgccaatgccgattagcgacaggacaatccctaaaatagtaccgactagcgttccccagaaagtacgaatcaagaagcacatatgatcgtaataagctgtgccttgcatatctgcacgcttgatatacgccaagattacacctgcaatcgccggtaagccgccgaaaataacgcctaagccgaataaaccgtatgtgatatacatcacggtacgtaatgaatcattagacggttgaagagaaaattgttcgttcatttatatctcctaaaaaagtaacggttagactgaagcatttgcaaaaaattcctcaaatctaaccgcttgtgattattggtgattatcttcgtataaccacttcgccaccgttttagcgaaataggttaagataccatccgctcccgcacgtttgaagcaaagcaaaccttccattacacactcacgttcttttagccaaccattctgaatcgccgccatatgcattgcgtattcaccagacacttggtaagcaaaagttggtacgccaaagttttcttttacacgccataccatatccaaataaggcatccccggttttaccatcaccatatccgccccttcttgaatatccattgctacttcgtgtaaaccttcgttcgcattcgccggatcaacttgataagtaaatttattaccgccctttaaattgccagccgaaccgaccgcatcacggaacgggccgtaataatttgaggcatatttagccgaatacgccataatttgcgtattgattaagcctttcgcttcaagtgcttcacgaattttaccgatacgaccgtccatcatatcgcttggtgcaacaatatccgcccccgcttctgcgtgagaaagcgcttgttttactaatacttcggttgtgatgtcattcagcacatagccttcttcatcaataatgccgtcttgaccgtgtgtcgtgaacggatctaacgctacatcggtcatcacgcctaattcaggataagccgcttttaatgcacgcacagcacgttgtgccaaaccttccggattgtatgcttcttccgccatcaatgattttttcgcatcacccactaccggaaatagagcaattagcggcacaccatatttcactaactcacctgcttcaattaaaagctgatcaatcgtcaagcgttccacgcccggcattgatggcacttttactcgctgattttcaccttcaatcacaaataccggatagattaaatcgctggcagtcaattgactttccgccactaaacggcgactgaaatcgtgtttacgtaagcgacgcatacgacgagtgggaaacgaagtgttaagatattgagccataatttcttcctaattttgcaaaatttaataaaaaataacccgcttgtgagcgggtttagattaattagcgatagtttcctcttgctcatctctcggtctatagaacttcgagaaaaacagcccgacttcaaatagcaaacacatagggatagctaaaagtgtctgagagaaaatatccggtggtgttaacagcataccgatcacaaatgccgccacaataatgtaagggcgcttttcacgtagttcattggcagaagttaccccagaccaacaaagtaaaataattgcgaccggtacctcaaaacaaataccgaatgctaagaaaatagtaagtacgaaatctaaatagctactgatatcggttgccatttgcaccccttccggagcggtactggttaagaaaccgaataccaatgggaacacgacatagtaagcaaatgcgacacctaaatagaataataatgtacttgaaaccaataacgggtaaattaatcgtttctcatgcttatataatgcaggagcaacaaatgcccaaatttggtaaagaataaagggaaccgataaaaataccgctacaacaccagtcaacttaatcggggtaaaaaacggtgtagcaacattggttgcaatcatggtcgccccagccggtaaattttccgttaacggtgtggcaagcaaagtataaatatcatttgcccaataaactaaagcacaaaaaaccacaagcacacaaataaagctacggagcaagcggtttcttaattcaacaaggtgactaatcagaggttgagattgttcaactgacattctgtttatcctgttgttgtgatactgatgaacttggcgttgccagatcatcgtcaggcggataatatgcggtgaattgcgattcatccaattcagcttgctctgcgatctctgccggagataactccgccgtttctgtcacagattcatcctcaacaagcggttgattttccggattttcttgcgattccgacacggcaatttgctgttcttcttgctcaatttttgcttgaatttcagcgacttgctcatcggttaatttggtaatttccccttttgctgaagcgagatcagcctgcatttgttgcgcagattgttttaaatcttccaccgttttgctcaattcgggcgaaagcgaacttaaatttaacgcttctgcttttttaatactttcttgcagctcttgtaatttgagttcttgcgctaattcattctgcacgtttgcggctaatccacgaattgtacgaacccagcccatcacagtacgaatagcaacgggtaaacgttgcgggcccagaacaaccagccccacaacgaaaataagtactaattcagaaaaacctatatcaaacacaatctatgcctgctctttttcttttgctttttgttcggtagctgcagcttcttttgcttctactttctcaaaactcgcatcttgtggtttttcatctgccattgcttttttaaagccttttacagattcacctaaatccgtacctaacgtacgtaatttttttgtaccaaataataaaacgataattgctacaataataagtaattgccaaatgctgataccacccataaaggttcctctttttgttttaagtttaagaaaaaattgtttgtattatatgttacttttgttttcgtttccaaacaaaagtaacgaaagcaaatgagccctattttctttgcaagaacaaggataacagagccacagataataaaccgaggcttacccataacggtaagttatcaaatcgccataacacgccgataataatcaaaccgttaataatgctttgtacattacgcgatttttgctgcccctgcgcttgcaaggttttatttagctcatctaaacggaaattaatctgcttctgttgctgtaaggcgttgaataccgcttccggaaattcggcaaaatgttctctaaattgcggcgcacgttgttttaaatcacgtaaaatcgctttcacacccacttgttcattcagccaattttgtaaaaacggttttgcggtttgccataaatccagctgcggataaacctgtctgcctaatccctcaatatagagtaaagttttttgcaataacaccaattgcggctgtacttccatattaaattcacgagccacgttaaataaattcagtaacacgtgcccaaaagaaatttctgataacggtttggcaaaaatcggctcgcacacctcttggaaagcctgctcaaacgcatcaatatcggtatccgccggcgtccagcccgattccacgtgcattaacgccacacggcgataatcccgattaaaaaaagcgacaaaactttccgctaaatagcgtttatcattttgattcagtgtaccgacaataccgcaatcgatgccgatatattgcggattttccggatgattcggattaacaaaaatattaccggcgtgcatatctgcgtggaaaaagctgtcacgaaacacttgagtaaagaacacttgtacaccacgttccgctaataatttcatatccgtgccgttggctttgagtgtttcaacatctgataccggaataccataaatacgttccatcacaatcacgtttttatgaccaaaactttgatacatttccggcacatacaacatttcgctattttcaaagttattgcgcaagcgaatcgcatttgccatttctcgagtcaaatccagctcatcgagtagcgttttttcgtattcacgcaccactttggtcgctcgtaaacgcctcgcatcattcgaaagacgaggaatccaacttgccagacgatacatcaacgcaatatccgctttgataagcggtgcaatatccggacgaatcactttaatcacgacatctttgccggcaagcggttgattttgattaaattttgccgtgtgaacctgtgcaatcgaagcggaggcaagcgcttgctcatcaaattcgtcaaaccaagtttcaaggcttccgcctaaagcttgttcaataatttgacgggctaatttaccctcaaaaggttcaaccgaatcctgcaataaagcaagctgatccgctaattccggctcaaataaatctcggcgagttgaaagcatttgcccgagtttaatccacacaggccctaactcttgcaaggctaaacgtaaacgcacgccgaacggctgatctttgtgttgatttctcacccaaaacagagccttacgccctaaacgagcatggcgagtgagcggaatctcgggaataatttcatcaatgccgtaacgcagaaatgtagtaataatttgataaaggcggcgagtattgttaaacgtcatgatttattctcaaattttgcaaattttcgctcaaattcgaccgcttgttgctcaagttctgcaacctgatcgtaaaaattaaccgcttgtaagcgatgtaccactaccggacgctcgttcattaaattctctgcgaaatgctgatgattctgctcaatttgcccttttagtttgttaaataattttttggcaaaatcggttgaagtctgtgccagcacatcaccaacaaaaggcgacaacaattcagcgggatctttttccagttcatctaacactgcggtgaaaagttgtaacacctgaatatcgccgttcaacaccaatgacttgttattaatcagctcggttaatttggctttatcggcaagtttcggtaaggcttcaaacgaaagttgcacatggcaatccgcttcaccttcgtaaaccgataaccattccgcacgggtttcgctaaagatcagataaaaattgatcgccggcgagcttaattcaatatgtaagcatttaccctctaacttacgtaatgccggtaatacgtgcggcgaacgctgtagcaacgcattaaatgcggtttctatcgcaccgaaagcaaactgtggcaacataagctgctgtttaagttgagataacatcgcgtattccttggattctagaccaaaaataaattaaaacttatatcctcgatgtaacgctacaataccggcacttaagttgtaataatttacgctttcaaagccggcattttccatcatcgcttttaattcgtcttgtttcgggtgcatacgaattgattcggcaagataacgatagctatccgcatcgttgactaccacttcgcccactttcggcaaaatattaaaagaataaaaattatataattggctaatcggatcaataatcggttttgagaattccaacacaagtaaacggccacccggcttcaacacacgaaacatcgaacgtagcgctttgtctttgtccgtcacattacgtaaaccgaaactgatcaccacacaatcgaaggtattatctgcaaacggcagacactccgcattagcttgtacataactgacattgccgactacgcctaaattacgcaatttttcacggccgacttccaacatcgagctattaatatcagctaataccacttcgccactttcaccaacaatacgcgaaaattttgccgaaaaatcgcctgtaccaccggcaagatccaacactttttgccctttacgcacgccactgcaatcaatcgtaaaacgcttccaaacacgatggataccaaacgaaagcaaatcattcattaagtcgtatttaccggcaacgctgtggaatacattagcaaccaattgctgtttttcctctttggcaacggttttaaaaccaaaatgcgttgtttcgttttcagtcgtttctgtcgtgtgttgtaaatcagtcattgtcaaattctcatcgattatttcggaatgctaacgatagcaaaaaagcggtcgtttttccttaaaattttgcaaaatcaagcaagtaaatgaccgcttgcttgactagaaaccggttagtctgtaccatttgcacactatttttatttgaggattacaattttggacagtcacagtcgatacttatcagatttctaacctacttgtccaaaccctcaggttaccgacaagtcggtaactctcgcctagtatcttttttgttcctttttgttcattacctcctaaccattggagaataaaatgatccgtgcatttgcattagataacgcacgccttgtcagcgttgacgaaaccgctaccgatttaaacgatgcaatttggattgatttaatcgatccgagcgatgacgaacgtagcgtactacagcgtggtttagaccaaacgcttgcggaagaacacgaattggaagacttagaggcttctgctcgcttcttcgaagacgaagacggcttacaccttcactcttttttctattgtttagatgacgacgattacgcagatattgccaccgtagcatttaccattcgcgacggacgtttatttactctgcgtgaacgtgatttaccggcgttccgtttatatcgaatgcgttctcgccgtgaaaaattaattgatagcaatgcgtacgaattactgctcgacttattcgaaacaaaaatcgagcagcttgcggacgtgatcgaaacaatttatgcggatttagaaaccttaagccgtgtgatcttgaacggtaagcaagaaagtgaaaattttgacgatgcgctttccgatttaaccgaattggaagatgccagctcaaaagtgcgcttatgtctgatggatacgcaacgtgcgttaagtttcttattgcgtaaaacccgtttaccaaacaatcagcttgaacaagctcgtgacattatgcgagatattgaatcactccaaccgcataatgaatcgttgttccaaaaagtgaacttcttgatgcaagcggcaatgggttatatcaatattgagcagaataaaattatgaagtttttctcggtcgtatcggtgatgttcctaccggcaactctcgttgcctcgacttacggaatgaactttgaatttatgccggaattacattttaaatacggctatccgatggcaatcggcttaatgatttgcgccgccgccaccccgtatatctactttaaacgcaaaggttggttataaaaatacaaaagcacagaatataagttctgtgcttttttattagctgtaagcggccaaatctatccggaaatttgcaaaattttgccaagaaaaaaccgcttgtaatttgcattacaagcggctctaaatagatggcggaggaagtgagattcgaactcacggagggcgtaaaccctcgccggttttcaagaccggtgccttcaaccactcgaccattcctccggattgaaaacatattctaaattgtattctctttgagagaaaaaacttgctgatttattaaatcaacaagctataaatttgatggcggaggaagtgagattcgaactcacggagggcgtaaaccctcgccggttttcaagaccggtgccttcaaccactcgaccattcctccgttgaaaacgagcggaataatataagttttatcaaaatcggtcaagcgaaaaatcgttaaaaatcatcaagtgatttatttttcagcataaccgactatttatgcttatttcctaatcagccatacgccactttctacgtgatgagtataagggaactgatcaaaaagtgccgcacgctcaatacgatgcgtttgggttaattgcactaaattatctgctagcgtatgtggattgcacgaaatatataaaattcgctcgtaagcttgcaccatatttaaggtatcttgatccaaacctgctcgtggcgggtcaacaaaaatcgtattgcaatcatacgcttttaaatcaattccttttaaacgattaaattcacgcacgccgttcatcgctagagtgaactcttccgccgacattcgaataatctgcaaattatcgatcctgttctgttcgatattatattgtgcagaatgaactgaagattttgaaatctctgtagctaacacttggcggaagttctcggctaatgcaattgagaaattcccgttaccgcaataaagctctaataaatcaccggtactatttttggtacagcttctcgcccattccaacattttaatattcattttagcattcggctgggtaaagctattttctacttggcgataaattaaattacgcccgtccaccggtaatacttcttcaacataatcacgatctaaagcgatcttctgtttagttgctcgcccgataatttgcacgttaaaaccgtgattttctaagcgtttttttaatgcagctgcttccgcttgccattcttcgtttagctttttgtgataaagcattgataccgcaatttcaccgcttaacgtgctgagataatccacttggaataatttacgagtgagtaattcattgcccttaatttcggttaatagcgtactcatcatattattgattaagtgattagcaatcgggaattgatcaactcgataacgttgcttagtttcctgatcgaacataatgtgatacagctcattttctccggcttcgttagtatcatgccatactcggaattcggcacgcatacggaaatggctggtttcagactcaaacacttcaagtgcaggcggattaaaaggcgcaagtaaagcggtcaaattttctgctttttttgcaagaagatcagaatattgctcaataggaaggttcataatttatcactattcattgtccccaaccgtataagagactggctgagaaaagtaaaattaatataaaaaaagaaaccacaaaataccctgactaacactttcgtgttttcagcgtattccgtggcacacttaaaattgcaaatacttagaaatgcctattattcagcagcgctgaaatcatcaccggcatcgttacccgcattacctgaaagcgtatagatacgttttgttttgctggttaaagtgcggtactttaaccatgatttttcaataatgctttcagcaatttcatcacctttcattacagcaacaaagcgctcttcttctgccgtcactgggctacgttcgccagtttctaatgctaaacacgcttgaccgaattgctctaaagtctgagattcacgaatggtgtaatcgccgtgacgagcaaaaccgcgtggataatttttatcatcaaagtaacgacgtgttacgctaaaactctctgccataatatgcctcttataatttactgctgaatttgaaaagaaaaaaatcgacctaccattaaatcaacaattcaaaataagtcaagaaaaaacgcataaagcgagcgattttcttaccggaaatcgctctcaatcgcctagaaaaaaaccacttgcaagacaatcttacaagcggtcttttttcacaaaagttttaccaattaatcaatcggtggcacgtaagtaccgtttacaatcgaatctttaatacgctccgcttccgctaatacttgtgctaataacgctttcacgttttccaaggttgcaatcgggcttaacgtagtcatcttaagcgattgtttgtcgctcactttggttacaccgatatttgcttcgccacgtgcgaaaagctcgtccgctacgttttggtttaagatatcgataaattctgccggatagccttgcggtaccacacggaataacaccgaagcgaattggcttggcactaacatttctaagccgtcagtcgcgttaatatagccttccacttctttagttaatttcacaccgtggtcaatcactgaagcatataaatcttcacccaacgcttctaccgtgaaccataattttaatgcgtcaaaacgacgagtggtttgtaatgatttcgccactaagttcggtacaccgtgtgcttcatcatattctgaattgaggtaatccgctttataatcgataaaacgatagttcgcttgatcttttaataagaacgcaccacacgaaatactttggaagaagtgtttgtggaaatctaacgtgattgagtcggtttcttcaataccatctaagaaatgacggaaatctttagaaagcaataacgcaccgccccaagccgcatctacgtgtaaccatgcaccgaatttattagtgattgcacgaatttcttttaacggatcgattgcaccggcgtctgtcgtaccggctgttgccaccacacaagcgataatcttgccttgtgcggttaaatccgccaatgttttttctaatgctacaacgtccatttgagcgttttcattgcacggcactgttaccacagattggaagcccatacccatcattgccatgtttttttgcactgagaagtgagcattttccgagcaaactactttcacatttttcattgcgtccgcaggaatgccgtcacattgtaccgaccattccgagccgtcttcgtttttccagtttttcgcaatcgcccaatcacgagcaagtaatacgcccatgagatttgattgtgtaccgcctgaagtaaacacgcctgaagtaccggcaccatagccaactttttgacgtaaccaatcaattaagtgttcttccataatcgaacctgcagggctttgatcccaagagtccattgattggttagttgcattaattaacacttccgcaatttgactagttaccattgtcgggcaatgtaaatgcgcaagcgaatgtgggtgatgtactttaagacttggttttaagaaaatttccactaagtgatcaagtgatttttgtacgcctacgccttcttttgacggattaaaaccgtcaatcaaagcacgcatttgcttgattgaaccaccggtgtacattttgtcgttttttaaccaagcacttactgcttgcaccgcattattcatcgcattttcataatcagcgatcgattgcggatcattacagaaaagtgattgtctgtgttttgaaatatctgccattttttctctcgcacctagcacgaaccgtgctaggttaattaagctcagccccgttggggttagaatataaaaagagccacagcgtggctcagataaagcaaccctacacggctcgtgtagggttagaattagccacgtactgctttgattgcatccgccacagattgtttgaaacgtttgataaactcttcacattccgcttggttgatgtttactgcacaaagcacacgtactacgttaccgccacgaccaccacgctctaacaataatttattgttgaaacacgctttttgaattgcgaccgctaattcgccgtcttgtggataagcaccggttgcatcttgtggcttacgctcatcaacgatatcaatacccatcattaagccgcgaccacgtacattaccgatacatgggaattctttgcttaattcatgcaatgcgttggttaagtattcgccacgttcttgtgcattttgcgctaaattttcttcacgcatgatttttaatgaagcataaccggttgccattgctaattggttaccacggaaagtaccggtgtgacctgctggttgccatgcatcgaattctttacgaattgctaataccgctaatggtaatgaaccaccaaccgcttttgacattaccacgatatccggctcaatgcctgcgtgttcgaaagcgaacattttaccactgcggcagaaaccagcttgaacttcgtccacgatcattaagataccgtgttttttggtgacttcacgcactttttgtaagaagctgattggcgccggtacaacaccgccttcaccttgaatcgcttctaaaattaccgctgccggttttactacaccactttcaacatcttcgatgaagttttcgaaatagcgttcaaccgcttttgcacctgcttcgccaccgataccgaacgggcaacgatattcatgcggatacggcataaattgcacaccagccattaagttttgtaccgcatttttcgcacctaggttaccggttaatgataacgcaccgtgtgtcataccgtggaaaccaccagagaatgcgatcacattgccgcgaccagtataagtttttgctaatttgattgctgcttcgttagcatccgcacctgatgggccagtaaattgaaggatgtattgatctttcgggaagaatgaaagtaattcttctgtgaatgcatcttttaacggagtggttaagtcaagtgtatgtaacggtaaaccgctttctaatacatctttgattgattgcattaataccgggtggttatgacctaatgcaagtgttcctgcgcccgctaagaagtcaaggtattcgttaccctcaacgtctgttacccagcaaccttgtgcttttgcatacgcaaaaggtaatttacgaggataactacgaacatttgattccatttgatcttggcgatctaagaaatgtttgtttgatgcgagaactgcttttacaggagtggtaattgtcatttgaaatgagtttcctattgataggtgaaaaaaataagtcgggtgccttgcgggaagcctaagctttctgtttctgaaaaaacagatgccatggggcatttgactcgctacttattaaaaaaagcgtttcagcttttttgtttttaccctgcccctagatttaacaaaagaaaggcggtgcaggttggaaacaggcttaaatgcgggttacatttaaggacgcataatagtacatttttttggcaaaaaataaagtaatttttattaactaaccttatattagcttactcaaatgtctaaaatgcaaacggttgccaaattggcgtaaaaaaacccagctgaaaagctgggctcttgaaacattgaatcaaattatttgattttagcttctttataaacaacgtgtttacgcacaactggatcaaattttttgatttccattttttctggcatattacgtttgtttttagttgttgtgtagaagtgaccagtttcagcagttgaaactaatttgattttctcacgattacctttagctgccattggttagctccttagattttttcgccacgagcacggatttcagctaatactgcatcgatgccttttttgtcgataatacgcatacctttcgctgttaagcgtaaagttacgaaacggttttcactctcaacccagaaacggtgagtgtgtaagttaggtaaaaaacgacgacgagtcgcgtttaatgcgtgtgagcggttgttaccaactgctggacgcttgccggttacttggcaaactcttgacattttaattctccaattacttaagtaatgtttaaatggttcgggcgattaggacttatatcagtttatctaattgcctcgtcaggctcagcccgaccaaagtcatatttaaagaccacggattatactcgctttgatagcgttattcaagtctcaatttatgaattatttcggcgaaacttctcttcttcgaaggaaaaataatcaccttttccgacgacaatatgatcaacaaagcgaatttcaaccaaatcacacgccatttcaatcttcttagtgagcatcctatccgattccgaaggcgtacaaagacctgacggatgattatgagcgacaataattgccgccgcattgcattttaatgcttctttgattatttctctagggtaaaccgttgcttgattaatcgtgccgtaaaacattttttcttttttaattaagcgattctgattatcgagaaacatcaccataaacacctctcgttcttccgattccagttccgtctgaaaacacatcacggctaaataaggttccgtaatgttttctcgcacctgcatttgttgcgctaaataacgcttagtcatttcttttgaagcttgtaattgaataaattgcgtttgccctaatcctttcatctgacaaaatgcttttacatccgcactaagtaaccctcttaacgaaccaaattgtttgagtaccgtttcagataattgcatcaccggcaaccccttaatgccggtacgcaaaaaaatcgccaataattcttgatcagttaaggactccgctccataagctaataatttttctcgtggcattaattctgcattacacattattttttactcagttagaccaaataggaaaaaatcataaagaagctaattatttgaatcaaaaggaaagttttattttttcgacgcagatcgcaaaaatcactttattgtgagtgagtacttattaaggtagaattaattaatatctttttctttgcttatgctcagaaaatgcataaatatttttttaaataggaattgctatgctcagtaacaagcgcattttagtcggcattaccggtggcattgccgcttataaaacgattgaattaattcgtcatttcaaaaaagccaatgcagacgttcgtgtcgtattaacaccggcggcagaagcttttgtgaccccgcttaccctacaagcgatttcggcaaatgcggtctccaattccttattagatccgcaagcggaactcgcaatgggtcatattgaattggcaaaatgggcggatttagtcgttattgcaccggcgtctgccgattttatcgctcgtttacgtgccggtatggcaaatgatttgctctctaccctctgtttagcaactgccagcccaattttactcgcaccggcaatgaaccaacaaatgttcaaacaagcggttacgcaagaaaatttagccgtattggcaaatcgcggcatacaaatgatcggtccgaatagcggcttccaagcttgtggtgatgtcggtgccggcagaatgtccgagccaagtgagatcttccaaacagtatgcgatcactttaaccgctcacaagatctgaaagatattagcgtgacaattaccgccggcccaacccgtgaagcgatcgatccggtgcgttatatcagcaatcacagttccggcaaaatgggctttgcgattgctgaagcatttgccaaacgtggtgcacaagtgaatctgattgccggtccggtcaatcttgccacaccggcaaatgtcgttcgaatcgatgtggaatcggcggtagaaatggaacaacaagcggtcaaatttgcacaaaaatctgcaatttttatcggttgtgctgccgttgccgattatcgaatggctgaagtcgcgccacaaaaaatcaagaaaaccactggtaatgacgaactgattcttaaattagttaaaaacccggatattatcgccaatgtggcaaatttaactgaaaatcgcccgtttaccgtgggttttgcagcggaaacgcaagatgtagcgaactacgctaaagataaactcaaacgtaagaatttagatttaatttgcgccaatgatgtgtccggcggacaagtgttcgggcaagatcaaaatgccctacaactcttttggcaaaacggtgaaaaaatgctaccgcttgcagataaaggcaaactggcggaagccttagttcacgagattattgagcaatttaaacacgacaaataggaacataaatgaaacaaatcgatttaaaaattttagacggccgtatcggcaacgaatttccattaccggcctatgcaaccgaagggtcggcgggtttagatttacgtgccttaactgaaagcgctttaatcgtagaacccggtcaaaccgtactgattccaaccggtatttcaatttatatcgctgatccgaatttagcggcggtgattttgcctcgttcaggtttagggcataaaaacggtatcgtgttaggcaatttagtcggtttaatcgatagcgactatcaaggtccgttaatggtgtcattgtggaaccgcagcgataaaccttttaccgttgaagtcggcgaccgtattgctcagttagttttcgtaccggtggtacaagcaagcttcaatatcgtaaacgattttgaacaaaccgaacgtggcgaaggcggtttcggtcattcgggtacacagtaattagatacccaaacaagcggtcgaatttgtaaaaaattttgcaaaaatgaccgcttgtggcttcttgtaatgatgagcagattactaaaacaagagaaatttatgacacaaccaacagttaagatgcctaaaaaatcggtaaaagaacgccaacagcaagtccttgaagtgctgattggcttattaaattccgaagacggtatgcaacgtgtaaccaccgagcgtttagccaaagcggtcggcgtttcggaaggtgcgctttaccgttattttccaagcaaaacgaagatgtttgaggcattaattgagcgtatcgaacagaccttaaccggttatattaacgccagtaaacgcaaagaaaataccacggcatccaccgttaaagcgattctctacaccgtgatcgaattcgcccgcaaaaatccgggagtaactcgcattctaaccggtcatgcgctgatgtttgaagacgatcaattaaaagcacgtgttgccaaattttttgacggcttagaatttcagttcgccaatattttacagatgagtaaattgcgtgaaggtaaaacgttcgaggacgaacgtgcattggcaggctatttagtgaatttttgcgaaggtcaattcttacgtttagtacgttctaacttcagttataaccaacatcaacactttgaaaaacaatgggcattaattaagccgttatttgagtaagttttatgattattccatggcaagaacttgaacccgcaacattaaataatgtattggattcatttattttacgagaaggcaccgattacggcgaaagagaactttctttagaggaaaaacgtgagcgcttattagctcaattaaaagcggataaagttgtgattgtctggtcggagctgcatcaaagccttgatattaaagacaaaaaatcttttttaggttaattgagcgtctcgtgatacaattttagcatttaggatgtcaaataattataaatgatttatagaggtttttatgcagatgcaagatatttcaatttctacgcctcagattgacggagaaatctcagcaccaccatcaatccatgaccctgctgtggagtggtttctgactcactgtcatattcatcgttacccgtcaaaatacacgctaattcacgccggtgaagatgctgaatctttattctatattgtgagcggttcggttgcggtatttattaaagacgatgaaggtaaagaaatgattctttctcaccttggacaaggcgagtttgttggtgaaatcagtttatttgaagaatctgttcaaccacgtaccgcttgggtcaaaacgaaaggtgcttgcgaaattgcagaaatctcgtataaaaaattcaaacagcttgtgcatttaaatccggatattttaatgtatctttctgcgcaaatggctcgccgcttacgccaaacttcacgccaagtaagtaatcttgctttcttagacgtaaccggtcgtattgcacaaactttaatgaatctggcgaaaatgccggatgcgatgacccaccctgaaggaatgcaaattaaaatcacccgccaagaaattggtcaaatggtcggttgttcacgtgaaacggtcggcagaatcttaaaaatgttagaagatgaaggcttaatttctgcgcacggtaaaaccattgtggtttacggtactcgctaaattttaatgaaatcagaccgcttgttaatgctaacaagcggtctttttttattcgtcttttacataacgtttaataaattttgcttggtgcttttcaatcacttcttcaatcgaaatatcgtatttgtccgccaaaataaatagattatccagcacatcgcccagttcttcgatcaaacacgcctttttctcttgataagacgcttccgtttcatccggacgatctcgaccaatttcaatcgctcgtaccgcacgtgccacttcaccgacttcttcacttaaaaagttcactcgaataaacggattgtaacgataccagccctgtgtctgataaaactctctgacccaattttgataatcttgaatctgcatacgacttccttaaattgcaaaaagcggtagcaatgctaccgcttgtattctagctctcttcccaacttgcgaattcaacatactccgctaattcaggaaattgttttagccatttattccattgcactaaatccacttccacttcaaccaatctgtcaccaaactgattaaagctttcgcttttaatacaatgctgtaggtgaaattgcgtataaatttgccctgcagttgccggtaataatactttctcacacactagctcattgcgtaaacactctcggatcgcttcatacaacaaatcaatgccttgattggcttgtgcagaaagataaaccgctactggtttgccatcgtcattacgctcgatatgcggcattacgccctcaagtttatcgactttgttatataccaataacgttggaatgtctaacgcaccgatttcatctaaaacttgattaactgcatcaatattttcatttttacgatcatccgccgcatcaatcacgtgtaacagtaagctcgcttcggtggtttcttgtaaagtcgatttaaaggcggaaaccaaatcatgtggtaagaaacgaataaaacctaccgtatccgctaagattgtggtgccaacatcttgaatttgcattcggcgtaaagtcggatcaagcgttgcgaataactgatctgccgcataaacaccggcattggtaatcgcattaaataaagtcgatttccccgcattggtataacccaccaacgatacggtcggaatatccgctttctgacgtgttttccgattttggctgcgctgcttattcactttctccaagcgattttgcagttgttgaattcgtaccttaatcaaacggcgatcggtttccagctgagtttcgcccggcccacgtaaaccgactgccccacccttttgctgatcttgattgcccaaacggcgtaccaaacgtgttgccaaatgtttaagttgagccagctcgacttgtaatttaccttcgtgcgatctggcacgttgggcaaaaatatctaaaatcagaccggttctatccaccactcgacattcacataacgcttgtaaattacgggtttgtgaaggactcaattcgtgattgactaaaaccacggttgcaccgagctcttcaaccgcctgagcgatttcatcggctttgccttgtccgacaaaatatttgatatgcggtgcagaacgagaagtggttagtgtggcaagaatttcaacacctgctgattcagcaagcgtttgaaattccataagattctcaatatctttagtttgagaaagaaagagatggactaagactgctttatcttgcgtatgagaaaagtcttttgtttgtttctcagataaagcaaagccaaatacagcattttcatctgtatttggcatctgttcggtcaaaaaagcttgcgtagtaatagcttaattattccgctttgtctgcaggtgcttcaactgcttgagcttgttgagcgtgtgaagaaccgctgttgttgtgagaaactgaacgagcaggaaccaccgttgagatagcgtgtttataaaccatttggctcacggtattttttaataaaattacgaattgatcgaaagattcaatttggccttgtaatttaatgccgttaactaaataaattgaaacgggaatacgctcacgacgaagtgcattcaaatatggatcttgtagagattgaccttttgccattttcttttcctttttatttttgtgttaaatatcgtcttattgctgccaaaggcagtagagatattatcatagattacgccatttttgctcgatcttttcaaccattttccgcttcgaactggtcggatctaagctatctagccattcaatttcacttccccaaccacgcaaccaagtaatttggcgctttgcaagctgtcgggtggcacaaatgcctttatacacagcttcatcaagcgaaatatctccgtcaatgtgttcccacatttggcgatatcccacgcaacgaatagaaggcaagtccttatgtaaatcccctcttgcgtgtagtttttcgacttcttgttgaaagccaagttccatcattttatgaaaacgctgttcaatccgatgatgtaatacctgtctatcttgcggcgcaatcgcaaactgcaacacatcataaggtaatgcctcccccgattgtgcggttagctccgtcatggtcttaccagtaagataaaaaacttctaaggcacgattaatacgctggctgtcgttcgggttaattcgcataccggcagtcgggtcgattcttaataactccgtatgtaatccgctccaaccaatttgtgctgcttttgcctcaatttcagcccgaatatccggatcggcagacggcaacggcgaaagcccttccaacaatgctttgtagtacaacattgttccgccgaccaataacggaatacgtccgcttgcggtaatctcagccatttcacgtaatgcatcttcacggaaattcattgcagaataactttctagcgggtctaaaatatcaattaaacgatgaggtgcgagcgctaactcagccttactcggctttgccgttccaatatccatacctttataaattagtgccgaatccacactaatcacttccaccggaagcttttggcgcaaagctatcgccaaatccgttttgcccgaagctgttgggcccattaaaaaaattgcaaaaggttttttattcattttgttctatctaaagttataagcggtcgaattttagcggaaatttaccaaaagcccaaatcgcagcgctcataaaaacaaaaacgaccgcaaatatcgtaatttacggtcgttatcatactaaagattaatgactaccgcagccacaaccttttttcatatcaattaccattcgaccttgaattttaccatctcgcatttcttggaaaatatcattagcctcatccaaacggcgtaattggactaacggtacgactaatccttccgcaccgaattgaaatgcctcggcaagatcttggcgagtaccgactaacgagccgacaatttcaatgccgtctaacacaatacgaggaatagaaagatccatcgtttccggtggaagaccgatagcaaccacacgtccaccggcacgtacacaatctaccgctgcattaaatgccactttagatactgctgtcacgaccgcggcgtgtgcgccccccactttttcttgaataactttcgcactgtcttcttttaacggattaatggttaaatccgcaccgacttctttggcaaacgctaatttgtcatcattaatatcaattgcaatcacatgcgcaccgaatactttcttcgcatattgcaccgccaagttgcctaaaccaccggcaccataaattgcaatccattgacctgcacgcacaccggatactttaatccctttgtaagttgttacacccgcacaagtaatactgcttgcttgcgccggatccaaaccgtccggtactttaaccgcataattggcggttacaacacagtgagtcgccataccgccatccacggtataaccggcatttttcacactacggcacagcgtttctcgtccggtagtacaatattcacaagcaccgcagctttcaaacatccatgcaatactcacacgatcacccacttttaaattggtaacatccggtgcaatcgatttaacaataccgatgccctcatggcctaatacacgtcccggttttttaccataatcaccggcggcaacatgtaaatcggtatgacatacaccacagtattcaacttcaacaagggcttcgccatttttgatttcaggaatgtctcgttcaacaatttcaactgttccatcacattgtggggcaaccacagcagcacgcattttcatcatgatttctcctatgaagtaatgataacggttatgtcttgattctctgttcaaaattcaaacaaagaacaaattcagtatgccttagtaccttttttatgcaatgagatttttctatttttttgaccaacttcacaaaaatttaacaatcggctaagaatgatgaaaaatctatagtaacttttagcttttctaattctgatttagccgattgctccgtttcagccaaccaattgaccgcctctgctaaactgtaagcggtcggaatcggcgcaaattttgcaaaaaattgagctaaatcgaccgcttgtgaatctaataaacctaataagatttgttgtaaattctgttcccgtaataatcttggcacttgggcaaccgaaagacgaatttgcccttgccacgctttctcactgattgtgaaacctaattctgccaatggggctttgagtgtttgccaacgctgtgcttgtgcctcatctatgcttaaatttagcggaatcaataacgcttggctttcgcctttcgcaagttgtgtttgaaaacgcaaacgcgctaatttttctaatgaaagcaaataaaattgttgctccccttttaataacaaagcttgattttgcacaatagctaacggctgccaatgacttgctgtcgccggtaaagatggtgttggtttatgttctgcttcatctatctcttgagcaaaaatcaccggtgcaaaattagtttgcggttcaattagctcctgtatgttatctgattgagtttgtggctgactgactaattccccataccatttttgcgctgatttggaggtagttgttgtgcgaggcgaataacttggcgtacgagaagcggtcggttttgcaaaattttctgtaaattcaaccgcttgttgcggcgccaaaaagctattaccgccggctgccatacgattagtatcacgttgataactcggcaagggctcattcacttgatcggttaaaccaatttccgattgcccttgtaaggcggtttgtacgccttgcaaaataaaatcatgtaccaagcgcccctgatgaaaacgcacttcgtgttttgccggatgcacgttcacatctacttggctcgggtcaatatctaaaaagaccacaaacgcaggataattgcctgccggcatattagtcgcttcataggcttggcgaatggcgtgattaatggttttatcacgcatcattcgcccgttcacatagctgtaacacaaatcattttgtaatcgggaaatattcggtaaaccaatccacccgtgtaagtgtaagtcaccgtgttgccagtcgatatgaatcgcattttggataaattcatcaccacaaattgccgccactcggcgttgctgctgttcgactgaattatcttgcaccttgcggtattggcgtaccgttttaccgttatgcgttagggtaaaaccgatattcggttttgctagcgcaatacggcgcactacctcatcaatatgcgcaaattcggttttatcggtacgcaaaaatttacgacgtgccggcgtattaaaaaataaatttgcgacttcaattgttgtgccgaccggatgtgaagccggttgaatttccaccgccatttcacgcccttgcgcataggcttgccatgcttccgcctgcccgtccggacgagaagtgagtgttaagcgagaaacggaactgatacttgccagcgcctcaccacgaaagccaaggcttaaaatcatctccaaatcttcaaggctagaaattttgctggtcgcgtgacgagccaacgccaacgctaaatcttgtttactgattccacagccgttatctcgaatgcgaataagctgcgcaccgcctttctcaatatcaatttgaatctgatttgcgccggcatctagactattttcaaccaactctttcacaacagaggctggacgctccaccacttcaccggcggcgatttggttagcaagctgaggaggaaggatatgaataaggtgttgagtcataacattggtatcgttaatcaagaaatgatttattctacccaaaatctataaaattgagtagaaaaagtaccattcaccacctgcaaatcgagttacgaattattattatttgtattgaaattgtaattaaccgctgataaaatccatcccgtaaattacttaaatttacaaaaaacaaccaaatcatgtcactaccaaagcgtaatttgacgaggtctggataccatttttatacaaatctaaaggaatacaaataatgaataaaaacttacgcttaagtttaattgctgttgcttgttcactcgctatcacagcttgctcatccgacaataaaggggcaacacgttatgaaaatttagtaaacagtaaagcggaagaaacagctaaaaaagctgaagaagcagcgaaacgtgcgcaagaatcagcaacagcgaaaaaactcgctgatttagaacagaaacaaaaagaattagaagctgaattagcgaaaaaaaacggcaatgcggcagtgccaagtgttggtagtaatgttccaagtaatctaattaatccatcaacaccagctaaagccaaagataccgaagaaaaagcgacagagaaaaaagaaccggaagttaaagcgccatctacaacagtaaatgcgaatgtaaaagtattgactgctgaagaagctaagaaagctttagaagaagcatttaaagataatgggatagatggaagtaatattaaattaagcggtagtatcttgaccgtaacagactcaacatatactgttaaaaatattaatcctgaatcaaatcaaaatctaaacgagcttattgttgatggacacacaattaccctatattcagctgatgatctaaaaaatgatttaggtgatatgaaatcaaaaacattagctgatgcttctggaaaagttagcgctcttccgccatcaaaactaaaaagtaattttgaacaagtacgctatggctatacaactaaagatggtaaaacagcattatttattcaaggttacctaacaccaacatctaaagataaagtatcttcaccttttaattattggtatgaagcaaaaggacaaaaatcaactcaagtattaggagaaatgcctactggtgatgtttatgaatatcgtggtacggcattctatgggaaagataataaatataatgaattaacagcaaaaggatacgcagattttggtgagaaaaaagttaaagttgacttattagacggtaaccaaactaaattaacattaggtggtaacattactaataatacttttgaagggaactaccaaggagtaatcactaaaggtgcgttttttggaaataaagctattgatatggcaggtatgttttatcaaactaatgaaggatctgaaaaagggatgaatggcgtatttggagcaacccaacaaaactgcagttacactagctgctcaccagttacaaataaaaatctaaaagatttcaatctagataagcagtaataggataaaaaatgaaaaaactccccctaacactacttacagttgcttgttcatttgcattaaccgcttgttattcaagcggtggtggcggtggttcggttcaaccaccgaaagtcgctgataaagcaacagatgtgactaattcatcactaactaatggtaattcaaattcgaatagccattcatatgatgctaatagcaaattctttactgcagtaaacgctggttttgagaaaaaaccaagcacagaaatttccggcaccattttgactgttgcacaaaatggtgagttaaccgcgaaaaaaccggaaacattagaagatttggattcgattatggtggacggagtaaaaattactcttttcagcgtaacggacaaactttctaatgttgctgtcggtaagttaaaacaatctaatgagaacggcggtaagctctatgtaggtagtatggcggacagttatggtgcttatggtagttatcaagatccgaatagctttaaagcaatgcgttacggtgcatatactttaaacgggcaaactcatttgtttgtacaaggtttcttaacgcctgaacaaggtaccattaacgtacttggcgataccttctactcaatgccaaaagacagtacttataagtacactggctttgcgttatacggtaaagataaccaatatgcgcaacttaactccgaagtcattgctgactttagcaataagaagcttaaagttgagttaaaggaagcgggtgctgcgactgcaaaagctacttttgggggagacattaccggaaatacgtttagcggaaccagagacggaatcgagactaaaggcgcattctacggttctttagctcgtgacgtagccggtctgtttaatgacacaaaaacgggtaacaacggcgtattcggtgcctctgataaacgagcaataagttcttcattagaagcattctaataatagatatcctctcaagcggtgtaatttgtaaaattttttgcaaattacaccgcttttttaagctttataaccacagaatacacagagcacactgaaaagctttgtatgttctaaggtttgtttaattgcatcgcgatcaataacacctcttctcataccatttccttggtccataaaaaaacacggattacagtaatactgtgtaatccgtgttttctatagtttattaaaacgtgtatatcaaactagaaacgaatttctactgcagctgaataattacgtcccggtgcaacaaagcgctctaaaccgcgtaattctttatcaactgtattagttgtgcctaagcggttgatgcctcgtaatgcatcccatgtatgatatttacgattgaaaatattgtataagcctgcacgtaaagtcacatttttatgtactttccagaaaccgtacacatcaaataaagttgccgaaccgtttaaatatgggaacggcgtagtaactcgtttggttcgagagtcatcgtaagtcacaatggttgcatctttggcgtgttttgcgcctaaataagtccaacgagaatggataccccaaatatcattcggatcttcatagcttaagcccaaaatcacttttaccggttgtaccgaaagtaagcttgcttccgtaccgtataatttacttttcgaataccccacgctgcctaagaatttaaaacctttcggaatatatgcggtaacttggtctaaatttaccttgctcgtcacttccaaaccggaaattcgtgctttatccacattaatcgcttggttgaaaatggtcggattaattgcgttatagccgtaatattgacaatgcgcatcacattccatttgagttaacccgttagtttcttgttcgaacaagaaatctttatagcgaatgtggtatagattcacatttaaatgcccgagttggttttcgccccgaatgctgatcgaattatttacgctacgctccgctttcaaatacggatttgccaaccagttacccgaagggtgtttatacgagaagaacatctccgaagcggacggtacgcgatagccggttgaaacgtaataacctagattccataccggcgtcacttgtgcattcaagcctaatgagccggttaaatttttaaatgtcgttgctttaccacgggtatcgcagttataacatttagcattcagctcttgcggtgcaagttgttcttggtcataacgtagccctgccgtaccggagaacatttcattccactgaatttgatcttgtgcggcaatataaaatgcacgagtgcgaatcgggtgttgaatcgcataagtcgaactcttcgcgccactatttaacaaataagtatcggtattttcatttttaaaatcacgttgtgatactgctgtgcgtaatgtgacttggtgtgtgccgtaatctgtttcaaacggaatagaatctaagcgtaaaccgatacgatgaaattcattgttcatattacgatcgtaaatttcatctaacgactgcttaatatgcaatttttggaaatcgctactccctttataattaatcgcgcgcacatcggttttttgataatcatattcagtttttaaataagacagataaccactggtcggaaaatactcataagcgacatttacattatgacgttcgccctcatcatcagtatcacgccatgatgaatcataaaagttataagaacgttcatcggtaaatgctttcgtaagctgattactataagaagcacttacacgatgtttttcattaaataagtagccgaactttaccaagttactgtggttacgatggaatgacggatccggtgcaccgctggtgttgttccaagccactctaccgttacctaaacttttttgctcatgaccataacgagtggaatataaatagaccgcatccagcttctcatctttataggctgcgccggcagtgtgtacccactcactatttttgctggcatagctattttttaataacacgccgactttattaccgggtaacacaatatccgcagcatctaaagtacgataattcacgccgccgccaagcgagccgctaccggtggtaaatgaatccgaaccacgtacaatatcaattccagtcactaactcaggatcaatggttaaacgtgaggtattaaagttaccgtaacgtgcataaagcgagttttcctccgaatccggcaagtttaccccgtcaatactaatccctacgcggttgccttccaccccacgcatcgcaaaaccttttaaatgacgaccgctatcggcaatccccacatcggtagtataacggacgagatctttggtatcggcaattaactcttcttgaatagctcggcgatttttcttaatttcgccaatttttttagattgctcttgttcagccgtgacagtaacttcctctagttctgccgttgtttcttgtgcttgtgtagtactcaccacaccaaaaacaccaaataatgttgccattgatattttttgataggccttcattggattcccttcttatttttattgcaattgacttttattttcgttaaagacaaataattacaattataaacataaattgcagtttcaatctatataaatgagaattatttttcttaccaattaacctaaaatttctactttaatccagataaatagctatgatagactgttgaacattccaactatttagagataccactatgcaaatgattaccctcgctcaacaagctaaaatcgccagtgttgaattggctcaattcggaaacgttcaaaaaaatcaagcgctacttaccattgcacaacagcttgaacagcgctcggctgaaatccttgccgctaatgccaaagatattgaatttgcaaaaaatcagggaatttcgaccgctatcatcgaccgtttgttattaaatgaaagccgtttgcaaggtattgctaacgatgtacgtaatgtggcgaaattagccgatccggttgggcaggtgattgatggcggtgtgttagattcagggctgaaaattgagcgtcagcgtgtgccgctcggggtgattctcaccatttatgaagcacgcccaaacgtaacgattgatgtcgcttcgctgtgcttgaaaaccggcaatgcagtgattttgcgtggtggcaaagaaactaaatttaccaatgcagtgttagtggaagtcgtacaacaagcgttagaaaccgccggtttaccgaaactggctgttcaggcggtcaccgatccggatcgtgctttattactcgaattattaaaactcgatcgttatattgatatggtaatccctcgtggcggtgccggtttgcatcagttctgtaaagagaactcgactattccggtaattgtcggcggtatcggtgtttgtcatatgtttgtcgaaaaaagtgccgaccaacaaaaagcgttagaattgattgcgaatgccaaaacgcaacgcccaagcacttgtaacacgcttgaaaccttattagttgaaaaagcaatagcggtcgaatttttaccgaaacttgcaaatcgtatgaaagcattaggcgtgacattacataccgatgatttgcaaaaaactgagggaattgaaccgcttgatcaagcaagaatgcgtcaagaatggctttcgttagatttaaatgtggtggtggtcgagaacttagccaaggcggtggaacatattcgtgaatacggttcgcaacattcggaagccattctgacttccgattaccaactggcgcgccagtttgtcgcccaagtcgatgcggcggcagtctatatcaatgccagcacccgttttactgacggcggtgaattcggtttaggggcagaagtggcagtgagtacccaaaaactccacgcacgaggtccaatgggcttagaggctctcaccacctacaaatgggtctgcgaagggaattatttgatcagaaaataaatccccctatctacccttttcttgcttacgaatgctgaatttgagtgttcgtaagcggttaaatttcatcaaatttttaccatgaatactcttacgctattttgcaaaatattctttaaacgctggcagcaaaataaaatcgccatttcggcgggctatctgacatacagcacaatgttagcgatagtccccttgattatggtcgtattttcggtctttacttttttcccaatctttcacgaagccaccgaattacttaaagattttatctatgataacttcgcaccaaatgcgggacatctggttgaagaatatattgagttgttcgtcagcaattcgaaaaaaatgggattaatcagcattgtcggcttatttgtcgtcgcagtgatgttgatttccagtattgaccaaagcctaaatgacatctggcataatacacgcaagcggtcgatttttatctcttttttgctctacactttaattctgatttttgcgccgatttttgccggaatgagtattgcaattagtacttatgtgatgtctttcgaaatttttagtgaaagtggaatgttgtcctttagccactacttactcaaatatgtaccgttcggcttaatttggttattatttactttcgtgtataaaatcgtgccaaataccaaggtaaaatgtaagcatgccgcaatcggtgcattatttgccgcaatattttttactttgggtaagcaagcgtttatttggtatgtcacgactttcccgtcttatcaagccatttatggcgcacttgccgtgttaccgatcatgattgtttggattcacttaagctggcaagtcgtgttactcggcggacaatttgcttcggtattaaaagatttagaaatgataaaaaatggagaattagaactaaaatgattggcttaatccaacgtgtaaaatgggcaaaagtagaagttgaagatcaaacggtcggtgaaattgcgcatggtttattggtattacttggcgtagaacaaggtgacgaccaagccaaagcggataaattgctggaaaaagtgcttaactatcgggtattttccgatgaacaaggcaaaatgaacttaaacgtacagcaagccggtggaagtttattagtggtatcacaatttactttagcagccgataccaacaaaggtttacgcccaagtttttcgcgtggtgcagcccctcaggaggcgaatgcgttatacgaatatttccatcagcaagccgcacagaaaatctatacccaaaccgggcaattcgcagcagatatgcaagtcagcttacaaaatgatgggccggtgactttttggttacaggtttaaaacgaaaaaaggtgcaactgcaccttttttacttaatagaaaaattgctgtcctcggctgccgtcacattgataaatcgccagtttatttcctcgtttaccaatatccagacatttaccgctcatagcgctacggatttgttgcccgtctctaaaccactgctgattctcaccaccatgacaacgataagtaatcacttttgcgccgttatattggtgttcaccgccaacatctaaacactgcccattcaccctaatttgtgaattcacaaattcaaaacgctggttcgctttaccgtggcagtgataagcaatgattccgcgataatcggagccgctttgatctaaacatttacccgatgccgttttaattaatccgctatgcggtaaatgtggataaccctgctgactattcggttgatggtttggaataacaataacattcggtgtgttcatcggataaccgcctcccatttcggctgatggaacaacataaacacacgccgacaacgctaacgttgtaagtaacacaactttttgcataacatctcctttatcgtttttatgatttttttgagcttaataagaagcatattttcgctaaaagttcccaaatcaccaaaagtaaaataccccaaccaaacaaaggatgaggcattttattggtaaaaaattgagaaaatttaaccgcttacgaggctgtttgcacagcttttgctttcgattttgtcgtcactttcaataagaaataaccgataaccgccgaaacgaaagttcccattaaaatacctaaacgagcaagcgccaataggctctcgtccgcatgttcttcgccgaaagcaagccctgcaataaacatcgacatggtaaagccgataccacacagtacagcaatcgcaaaaatttgtttaaagttaatgcctttcggtaacttcgcaatgcgtaataaaaccgctaaataactgaataagaacacaccgagcggtttaccgataatcaaacctaatgccacacctaaaggtaaaggtgatgtaatttgctctagactcatacccgttagtgaaacaccggcattggagaaggcaaataacggtaaaatcacaaatgaacaccacggcgcaagagtatgttcaaggtgatgcaatggtgcttcgccgtttttaccgcgcaatggaatacagaaaccgataatcacccccgctaatgtggcgtgtacaccggatttcaacaccgatgcccataaaatcgtaccaataatcgcatagttcatcaacccgactactttatagcgattcataccgattagaatcaaaatcgcaatgctggcaataatcagcgcttgaatactcatctcatgtgagaagaacaaggcaatcactacaatcgcgccaaggtcatcaataatcgctaaagcaagtaaaaacaccttgagtgccggtggcacttgtttacagagtaaagccacaatacctaacgcaaatgcaatatcggttgccatcggaattgcccaaccatcttggtaagccgggaaatctcggttaatcatccaataaattaacgccggaattaccattccgccgatagcggcaaaagccggaaacgcggctttttggtaactggataacgaaccttcaaacaattctcgttttacttccaagccgactaaaataaaaaagaccgccataaagccgtcattcacccacatgagtaacggcttatcaatgctgaaggcaccaaacttaattgctacctcggtttgcaaaaaactaaaataaagttgctttaaatccgtattcgcaaaaatcattgcgagtaaggcggaaaccaacaataaaatcccacttgctgcttctagcttcagaaatttctgaatctgtttgatcataaaaatctcctatcgttaaatgaggttattatgtttaaacttcattttacctcttttctgacattaacatttttttaacctaatacaaaagtagaattcgctgtaattttgttaaaataagggataaatttcatctatttgcttatttttaaatcaaaagaggtatcactatgtcaaatgaatggctttattgggcgctcgcctccgcattattcgcttcacttactgcaatttttgctaaagtcggcttacagggtattgattcggatttcgctacctttatccgaacggtggtcattctgatcgcactcgccgcctttctgacttatagcggtaaatggcagccgttcggttctctaaccggtaaaaactggacatttttaatcttatcgggactagccaccggtgtttcgtggcttgcttatttcaaagcgttacaaatgggaaatgcctcgcaagttgccccgattgataaatttagtattgttttagttaccgtatttgccgtaatctttttaggcgaaagaccgagcggtcaagattggatcggtattgcgcttgtcgccgcgggtgttttaacccttgcaataaagcggtagaatatcattaattttttgcaaaatttcgattaaatttaaccgcttgtaagaccctatttatggcaaactcattcccaattattgaagtggtatttgctcattatgatgagccgataccacttccttttttaccgccggccgagctttccgaacgccaattaaaacgttggaaaagtcgcagaaccgcccattttctattgactcaactgtttgaaaaatatcaattaccactaaatttattggacgatattcaacgtacgcaaagcggcagaccttttgtacaacatgagaacatcgattttaatatcagccattccggcgagtgggtggcggtaatcttttgttatcataaaagtaaattacaagtggggattgatattgaacatccgcaaaaaatcagacgctatgccgatctgttacgtcattatgcgaatgcggaagaaatcgaaggattacttgagcgaaatcacacaccatttaccgaattagccgatcggttttatttgagctggtgtttgcatgaagcggtactgaaatcacaaggtgtggggattgtgaaattatctgaagtgcaacatcttccactacagcgcattgtccgttcggcatactgcccggcaggcacattacatttttatcatcagctgccgttttacttatgctatttttatcaagatttagcgaactcgcttgccattattagtgaatggaaagacggtaaattgcaaaaaatttctgattttcaaccgcttgtttatcaagttaatccaaggaacctaaatgcctaaactcacattagcagaaaaacactctcgctttggaaaaattgtttccgagtttttccagtggacgctcaatatttcgttattagtggcgggggtattactctcttattcgctcttttccgaagcctattctttatttgaattattggcaaaccatagtgaaaaattccaaatcgttgagaaaattgtgattttcttcctttatttcgaatttttagccctaatcgtgcaatattttaaatataattatcacttccctctgcgctacttcctgtatatcgggattactgccatggtacgcttaattattgtcgatcattccaatgcaatacatacactgctatttgcactatctattttagtaatgattatcgcattatttattgttcatacagaccgcttacgtaaaagctaaggaatttatatggctgagattcttcaattctcacaacatgacttacatatgctcaaagaagaaaccgtctataaagggcattttgaactgaaaaaaatgcactttcgccataaattattttccggcgaaatgagtggagaaatcgtacgtgaattattaattaaaggcgcggcatctgcactaattgcctatgatccggttcgtgatagcgtagtgctagttgaacaggttcgtatcggcgcttatgatcctcgttcggataaatcgccttggctattggaactggttgccggtatggtggataaaggaaatgaagatccggcggaagtggcaattcgagaagcacaagaagaagccggtttatacgttgaaaaggtggaacacgccctgagtatttgggatagcccaggcggacaattggagcgtttacatttattccttggtttaatcgatagctctgcggttcaatcaggtgcagtacatggattagaagaagaaggtgaagatattttggtacacgttatcagccgtgaacaagcctatcagtgggtttgcgaagggaaaattgacaatgtgattgccgttgtcggcttacaatggctgcaacttaattatcaaaaataccaaaagtaagaaacaatttattcaattgactaaaagttttcgccctcttttagagggcgtctttgttgataaatacgcaaaaaaacgtaaatttctgtgaaaaatgaggtatagcgctcatttttaatcatcagtagctgataaacttaaataacatagtaaagtatttatctacgagagaacgaaagtagtcgcttaagaaggagaaaaataatgaacggcttttattcgctaggtaaaaaggaacctgttgtgcgattacttcaaataaccgatccacacctattttccgctaagcatgaaaaattactcggcgtaaacacaaccgatagttttcaagcagtacttgatcaaatccaacaaacctcatttgactatgatttagtgcttgccaccggtgatcttatccaagatcacaatcccgaagcttatcaccgttttgcccaaatggtgaaaccgcttgcgaagccgattttttggctggaaggaaatcatgatagacagccgcaaatgagtctctatttagccaagcacccgcatattcaatcagaaaaacaaattttagcaggtttgcactggcaaatacttttacttaacagccaagtagcaaacgcacctagcggcaatttatctttcggacaacttgcgtggctaaatagcaaattggcggaatatcccgaacgctatactttagttgtgctacaccataatattttgccgacaaattctgcatggctcgatcaacactgtttaaaaaatagtgaggcattagctgaagtgttaagccgttatccaaacgttaaagccattttacacggacatattcaccaagaagtcgatgccgagtggaaaggttatcgagtgttagcaaccccttcgacttgtattcaatttaaaccgaattgcgatgagtttacccttgatctcttacctcaaggctggcgagaactcagtttatttgcagacggcagaattgaaactgaagtgaagcggttaaattcgaatgcttttttaccggactttcagtcaaaaggttattaattaaaacccccgtgcagaaataaaaatggctaggtataaaacccagcccattttgatacataatgaataaaatttttaactgtccgaatcaagtccgtacatatagatagacgcatcaaccgccgaatagttcatgcaaatgattcttttttcgtggagatccgaccatgaatctatttcgtaactaaaaccatctaatatttgtttagatggttatattttgacctcacgcaaacgattaagttccgacaagggccatattcgaaagaatttttctttcgattcgaaaatttttgcaaataatgctgtttatctatttcaaattttctcaaattcttgtatctttttgctttcgcaaattcctgtgaaaatcaacccgcttgaaggaacttccacaatgtctgtaaaaagagtatttgatttaattaaagataacgatatcaaattcgtaatgttaaaatttaccgatatcaaaggtaaagaacacggtgtttcactcccggtaagtttaatcggtgacgatttagaagacttattcgaagaaggtaaaatgttcgacggttcgtctgttgaaggttggaaagctatcaataaagccgatatgcttttaatgccaatcgctgaaactgctgttgttgaccctttcgctcgaatccctactcttactatccgctgtagcatctacgacccaaacacaatgcaatcttatgaccgtgacccacgttcaattgctattcgtgcggaaaattacttaaaatcaaccggtattgctgatagcgtaatgtttggtccggaaccggaattcttcttatttgatgatgtacgttataacgttggtatgaacaacgtgtcgtacaaaattgatgatattgaagcggcttggaacacaaatcgtaaatatgaagacggcaatacaggctatcgtccgctcaaaaaaggcggttactgtgccgttgcgccaatcgactcggcacacgatattcgttcggaaatgtgcttaattttagaagaaatgggcttagtggttgaagcacatcaccatgaggtggcaacagcaggtcaaaatgaaattgcgacgaaatttaacagccttactttaaaagcggacgaaacacagatctataaatatgtcgtgcaaaatgttgcgttagaacacggtaaaacagcttgctttatgccaaaaccgtttgctggtgataacggctcaggtatgcactgtaatatgtcattaagcaaagacggcaaaaacgtatttatgggcgacaaatatgccggtttatctgaaactgcgctttattatatcggcggtatcattaaacatgctaaagcattaaatgcgtttaccaacccaagtacaaactcatacaaacgtttagttccgggctttgaagcaccagtattattagcttattcagcaagtaaccgttcggcatcaatccgtatcccagcggtaaccagcccgaaagcaacgcgtgttgaagctcgtttcccggatccattagcaaacccatacctctgctttgcagcattgttaatggcaggtttagacggcgtaattaataaaattcacccaggcgatgcaatggataaaaacctttatgacttaccaccggaagaacttaaagaaattccggcagtggcaagctcattagaagaagcgttagattcacttgcagcggactatgagttcttaactcaaggcggcgtattctcgaaagaattcgtagatgcgtatatcggtatccgccgtaaagaggttgagcgtttaaatatgacgccacacccagtagaattcgaaatgtattacgcataattgtaaaaagatcaaaaaaggcgaccgcttggtcgccttttttattgctatttgaactaatgatcttcgtgcaaatgttgtttactacaacaacctggcactggatcttcaccaccttcactccaaggatggcaacgggcaattcgttttgtcgccagccaaccaccttttatcgcaccatgcactttaatcgcttcaaccgcataagtcgaacacgtcggataaaaacgacagcgaggcccaattaatgggctaatgcaataacgataaaaatagattggtagtaatagtaaacgagccccaattgaaggcgttacttttacacttgtggctttttcgccagacggatgtgacgagcccatagcttctccaacatcgcaaaaagagtggcattatcgagcttaccgataccgccttttgccacaaacacaaaatctgcacttggtaattcatgctgctttaaacgaaagctttcacgcacaatacgcttaatgcgattacgatcgtgagcacgttttaaatgttttttagcaacagttaaaccaagacgaggaatatcaagatgattatgacgagcgagaatagtaagttcgggagtgctagctcgaaacggttgttcgaacacagctttaaattgagtgggagctaacaagcgtagctcccgagaaaaggttagctttttcactgatgtgataaggctttgctttaactgcaaattatgcagataaagatttacgacctttagcacgacgacgtgctaaaacttgacgaccgtttttagtagccatacgagcacggaaaccgtgagtacgagcacgttttaatacagaaggttgaaatgtacgtttcattgctatctacctaaatatttaaatatgttggctggaattaaatctttgccaaacgaggaccataaaaaagagttgcgattttaccgataaattaaacaaaaatcaaggacgaaagcaaaatacccttcgattatttgcaaagtttttccgaaaaaagaccgcttgatatagattatcgcctatctctgtaattaacgcaaaaattctatttgttttcatatccgaattaacgcaaaattcagttatttcgatccatattcaaagagctttcttatgacctcaaacaaaatcggcgtactactggcgaatctcggcactcctgatgaaccgacagctccggcggtaaaacgctatcttaaacaatttttaagtgatcctcgtgtgatcgacttacctaaattcaaatggcaattgatcttaaacgggatcatcttgcctaaaagatctcctaaggttgcaaagctttatcgtgagatctggacagagcaaggctctccgctactagctatttcacgccaacaacaacaagcactacaagattactttaatcaacaaaaccaaaatgtcttggtggagcttgggatgagctatggtaatccgagtattgaaagcgcaaccgaccgcctgattaaagccggtgtgagtaaaatcattgtgttgccgctttatccgcaatacagtagtactacaaccgcctcagtgttggacgctttcgcacgcggcttaactcaacaacgaaaaattgtgccgtttgagtttattcatagctatcataacgatccactttatattcaggcactggcgaatacgattcagttagcggaagatgaaaaattattattttcgttccatggcattcctaaacgctatcaaactgaaggtgatttttatccggaacattgtcaacaaaccgcacaattagtcgcagacaaattatcgcttgctgacgaacaatggttggtaacttatcagtctcgttttggtgatgaagaatggttacaaccttatacagatgaaaccttagaaaaattaccaagccaaggcgtgaagaaaatcgccgtgatttgtgctggcttttcagcggattgtttggaaacattagaagaaattgctgaggaaaacaaagaaaacttcctcaacgccggtggacaatcttatcgctacattccggcgctcaatgccaatgccgatcacatcacggcattagctaaattaattgaagcgaagctctaatatataagggggatatagccgtggctatatccccctttttgttagcttttactcttacaacaacaatcattcagatgatcatcaactaatcccatcgattgcataaaagcgtaacaggtagtttccccgacaaatacaaaacctttctttttcaatgcttttgacatcgctgccgaaacggctgtttttgcaggtacgactgataaatccggtacatcattaatttgcggtttaccacctacaaatgcccaaataaaccggctgaaatcttctccatttgcttgcatagcaagataagccttcgcatttttaacaatcgcttccagtttagctcggtggcgaatcaaaccggcattttgcataagttgctcgagatcttcttccgtcatttgtgcaatacgttccggatcaaactggaaaaatgcctgacggtaagcctcacgctttttcaaaaccgtaatccaagaaagccccgcttgttgcccttctagacaaattttttcaaataatttgcggctatcaaattcaggcttgccccattcttgatcgtgataattgatataaatttcactttcgccaacccagccacaacgtgtaaccatttgctattttcctcacaaaaacaaccgcttatcaaataacaagcgggctaatttataaataaattttccaaccttcggcacgtttgattaatcggatttgattgtcctttgataaatatccacctttgaccgcatctaaaattgtgccttgcggtaagtttaccgaaaataattccgcttgagatttatcttcggataagacaatataaatcgccacatcacgatttgccggatcagctaaacgaatgtttgctagcttaaaaggttgtacacattctttttgcaaaaatgaatagctaaaaccggctgatgataagcaaccgtacttatcttgtgtcgtaccgacactttccttgttcatttcacacgcactgagaaagccaatgaatatgctgatgagtaataatgttcgcatggtaaaaaattgatgaaaaaagaccgcttgttcgcaatgacaagcggtcggattttaactaaaaattactatcttttcggtaaataacgtgtcgggtcaacagacttacctttgtaacgaatttcaaagtgaagtttgttactgttggtaccggtgctacccattttagcaatggtttcaccggcatttacggtatcttgctcatcaactttgatactatcgttatgtgcataagcacttaagaagtcatcgctgtgtttaatgataattaagttgccatagccttctagagcgttacctgcatacacaactttacctgctgcagccgctttcacgtcttgacctttgctaccggcaatatcaatacctttgttaccgccttcagcagaagagaaaccggatacaacacgaccggctgtcggccattgccatttaaagtttgaagccagtgcagctaccgtatttgatgtagagtaattcggtgaagttgctgttgtcgcacgcacagccggagcggttgctgcggttgccactacaccaccggatgttgcagttgcagccgtacctactgaagcttgaataccattatttgccgatggtgttacggtcggagcagttgcaccagtacttgcttttaccggaccggtaatattaccgtcagaagaataagtagttccgtttgcaccttgctgataagtcactttcggctctaccggcacggtcactttttcttctaccgttatcgtctctgttgccgatttacctgtttttagtttttgccctacggttaattgatatggttcactcatattatttaatgcggcaatttcttttacgtctttaccgataatataagcaatcaaaaacatggtatcgcctttacgtaccgtataagttgagccgtcataaaagcctttctgaatttggctatataccggcgcattattcgcatcacgagggatttcgaaattttggtttacctttttctctaccgttttagtttttttcacaactttcgttgttgtttgaggttgagccggttgctctgtgataaccggattggttaccacaggctgagaaacagtcggcacgcttgccggtgtatttcccattgttgcaggcattgatgccggctgaatatcagactgccaaccataagttgtcggtgctgtaccggataccggttgcattacaccagggcttaattccgtgctgtcttttgcacttacaaccggagccggatcatttgaactacatgcggttaaaataagtgcggctacaggcaataggagaaatgatttcttcattttgtcacgtgtccttttttataaatagggttacttagtcatcgacgccggcattggcgctgattctacttctgaagtccagctataactgccttcctctgcaccagaacctgaaacaggttgcataacacccggtgctaattccgactcatcctttgaaacagattgatttgcactacaagcagccaaaccaagcacgaatgggattaaaaacaatacttttttcatttcgctttcctaaatctataaacgaataaaacgacagtcgtcaacacgactgccgttaaataaatcataactttggcatattatcttacacgcagtacttggccgacttgtaacttcgttgtggtactgatgttatttaatgctgcaatttgtgccggtgtttgaccagttaagtaggaaataagatacatcgtatcacttttacctactgtataactgctgtcagtataacaacctttaaccatttgcgcatataccggtgtgcccatgctatcacgtactacttggcaattaccaaccgtttcagattgtgcaacagatgcggcttggggctgaactgctaccggttgtggttgttgaactggctgggaaacagaaccataagtcgcttgcggagtattttgagtcattggagcttgcccgatcgtatgagtaggcgctgaactcattgacgcaggcatatccgttgcctgaatagtttcggatgattgccaagttggaatcgcagaagtggttgatgaacctgcttcagctacacttgcttccgattcagatgaagaattacaagcggttaatcctaacgataccattaatggcaaaagtaaaagtgactttttcatataatatccttacttaaataactcataagccagataagcgacggctgccaatgcaatcgtcccccagccaattaattcgatagaacggcggattttttcagcatatttctcgccaccccatgccgaaagtttggcaactaaaataaaacgagcaaagcgagaaatggctgcagtaaccacaaacgggaaaaatgccatttgcattacacctgcacaaattgtaaatactttatacggaattggcgagaaaccggctaaaaaaacaaccgctacgccccaagtttcaaaccaaaatttcgctttgttgaagtttgcctgcattccccaatcagcaataatgccctgcacccaatcaaatgcatataaaccgataaagtaaccgattataccacctaaaaccgaagcaattgtcgtataaatcgcatatttagttgcattttgcggtttgctcatcgacatcggaatcaacatcacatccggtggaatcgggaagaaaatagcctcaataaaactcacaaagcttaaccaaaaagctgcgaaacggtgtttcgaccattccatcgttttatcataaattgtaccgaatagtttcatttagaaaacatcctctagcgcttggattgaataatgggctgtcatatccgcctgaattggcgtaattgacacatagtcgtgttctaatgcgtagaaatccgtcccttcgctggcatccactggtacaccatttgcacctagccaataaattgttgaacctcgaggatcttctcgttttacaatttccgcagccggcgaacgatgccctaaacgagtcaccatcacgccttttacttgttcgtaaggcacatccggcacattgatatttaaaatctgacgtgctggtaaaatacctttttgtactttcggtaataaatccaatacgacttgcgctgccgtttcaaaatgattattaccgaatagatgtccctgtgactttttaccgacaagcgaaatcgctaaactcggtagcggtaaatgtcgcccttccaaagcagcggcaaccgtgccggaataaaccacatcatcgcctagattcgcaccgtgattaatgcctgaaatcactaaatcaaacgccgtcggtaaaaaaccgttgagcgctaagtgtacacaatctgccggtgtacccgcaatcactgaatagttaaattcatcaatttgatgtacacgaataggctccatcaacgtaaggcaacttgatgccgcactgcgattgcgatccggcgcaatgaccgtcacagaatgtcccgcatcacgcaatgtttttgcgagtgtttgaatcccttgcgcgtgataaccatcgtcattgctgattaaaatattcattattcttgttccgttaattgaattaattcacgtactaatgccgttgcataactacctgaatctaaaaagaatttaaggcgtaaaccttcagactcaaattcccatgaaaagttttgcggtttacagaacattgcgcgacgtgcatttgacatgcgttctttcttcattaattcgactaataccgcatgacgttcaaccatcgcttgttccatttcattcgcattcgaatctaaggatttttcaccgattagtggcgcagttaataacacatcagccaaatcaagtcgttgttgagtttccgctatttcattttgttcgaccataaagaaactgttcgaaccagccaattgcacataatcaccggctaaaacggtttgggttaaacgctctgcaatacgttgcgaaaccaccaaattaaacacttcgctacgagctgccgatagatagaagctacgctttttgcgatctttaacgttaatttcgccgtttgcccaacgcagtgcttgggttaagttatgaccgtcacgcccaaagcgttgttctgtaaaataatttggaaatccgaccgcttgtaattgacttaaacgttgcttaagttcatccgattcgtttacatcacgtaataacacctcaaaatgattaccgtctaagctcccaacacgaatcttacggttatggcgagtaacctctaaaatctctacgccttcgcattcaaattgcgaaaaatccggcgtttctttaccggctaaatgtaagcaaaaccactgttcggttaccgcatggcgatctttaagccccgcataactcatattttttgccgagataccgacaaattttgctagctgttctccaacaaataacgtattcgcattggttttacggattttcaccgcaacaaattcaccttcgccgctaagcggataaccaagctcttctcgcacgataaaatctgcaaattccgcctttaatctgcccgcttgctgcggctgccctaagagataatttaattgcattacacgcccttttataaagcataaaaaaggtatccgaagatacctttcagccgtttctttcaaatatcattattctatcaggtatagctaacttttaaacctgcatattttgcttttctcacagaaaagagaaaatgtttaatccgcactaaggattattgatataaatcgtaattctttcagaaaagaatcaaattctttcgcaaaatttgatatagttcacaccgcttatattttttatattcaaactcaataggagaaataaaatggcacgtcgtccacttgtaatgggtaactggaaattaaacggtagcaaagcatttacgaaagagttaattgccggcttaaaagcggaattagcggatgttaaaggctgtgatgttgcaatcgctccaccggtaatgtacttagcggaagcggaagctgcgttagcgggtcaatcagtgattgcattaggcgcacaaaacgtagatgtaaatgtacaaggtgcatttacaggtgacatttcaacagaaatgttaaaagacttcggtgcaaaatatatcattatcggtcactctgagcgccgtacttaccacaaagaaagcgatgaatttattgcgaaaaaattcggtgcgttaaaagcagcaggcttagtaccggtattatgtatcggtgaaaccgaagcggaaaacgaagcgggtcaaactgaagcggtatgtgcaaaacaaattgatgcggtaattgatgcgttaggcgttgaagcgttcaacggtgcagtaatcgcatacgaaccaatctgggcaatcggtacaggtaaatctgcaactcctgctcaagcacaagcggttcacgcattcatccgtggtcacatcgcagctaaatcacaagcggttgcggatcaagttatcatccaatacggtggttctgtgaacgatgcaaacgctgcggaattattcactcagccggatatcgacggtgcattagtcggcggcgcgtcattaaaagcacctgcatttgcggttatcgtaaaagcggcggaaaaagcgaaagcgtaattaatttaatgctttaacaagcggtcggatttgtaaaaaattttgcaaatccgaccgctttttttatcgctattcatacgatataccgtaaataaaaaataggcacaaacctcttgtctgtacctattttattaatggaaagaaatatgtatgtaaatttagagtatattatttaattaaaaacttatacgcacccccgttgataacacattgtttttaccttttccatgctcaagttttaagtcatagtttaaataccacgcagtattaggtgtgaattcagttagcgcgccgacacctacccacgttttatttttcgccagaccaatacctttcacacggaagtctgcattttgtaaaccggtataacttgcatcgaagcttaaatcttcattattaaatgcagtttggtggtttacatatccctgtaaggttgtcttcacaccactatcaaagttgattgcttgtgacatacgtacacccgctaatccgcttgtttgttggtaagtcgctttgtctgcagttaaaccaaattggctgttggtttcactgaatgcgccacgttttaccacatcatggctcacaccaatatatggcgtgaaggtgaagttaccttgtttaaaatcgtaacctgtttctaagtaacctgagatcactttatctttatggttaattttcgcagtactgctgttatttgaatctaagataatggcacgctccacatccgaatcaacccaaccgtaacctacacgaccttgtaagtaccaaggcgcatttttatcactccagcgaccgtataatgatacacctacgcctttcgcatccgacttaccaccgtaacggttgaagctcacgtctgctgttgagtaatttactgcggtacctaaaataaagttatcgcttactaatttatcgaaaccgatttgacctgcgtaagttttcgttctaccttcgccaaaaccgttttcttttaacttaccgttaccatagatacccgatacccaaacaccggcagtattatctgcattgtttaatgtacctaacatggtgagacggttagttaaatctttattaaccgtttccgcgttttggaatgttaacgcctgtgctgatgcataaatctgaccagaaagactgtctaacaccgcggtttgaccggcagaaaccgctgcaaggctattttgtaataacgcagcatcttgtgcgaaagtggttgaattttctgcattatttgcatcaatttgacgatctaatgctgagaatgagctttctaagttgcttgcaacactttcagtcattgcatcacgagcatctgttgaagctacaaacgtttctacattttgacggcttaatgttgccgcaaccgtgttttcaccggttttgtttaccgtcgcatttaatagaccggttgtagtttcaaccacaccgaattcgcctttaatttcgctatccgatgtaattgcctcagtcgttacaccttttgcagtaacatattgcgcttgaccgtctttttctgccgttaacacaagggtagagttatttaaatccacaccacctttaaccgacaatttcgaatctaggctcgatactaaagtaccgtttgctgatgctgcataaccgttttcaatcacggtattaccgttatttaccaccacaccatcattgcttacgccatttgataatacagtgctatttgcaactaaagtaccgtttctacctacgtttaccgcagaaccgtagctcttaccgttaatcgtaatcgcaccttcatttaaggttgtgtcaccggtaaatgaacttgcgccggtaagtactaattcaccttgaccgtttttcactaagcctacgtcacctgaaatatcattctcaaatgcgtagctaccttgtggaatagtgacgtttacatcttcaccaagtgtgatacggctatcaaaacgtgccggacctttcactgctttttcaacgtcaagtaaaccccaaccgtacacatcatccacgccacgagcaccgatatcggttgcagtcgttagaattgattgtttaattaggttaccgtccatccacggatatttttgtttaacaagtgcagccgtacctgttactgccggtgctgcgaaagatgagccacttgcaatatagttgctgcctttcacattaaatacatagtcacccattgcagaaactgtccagtttttcgcaagacctgcttgtgaatatggtaataagttagaccatgagaaatcgcctaaacgaccgttatcacgcgccgctaaagctacaactgataaccaacctttttctaattgcgtttcaaaataaggaagtgccgcttgtggagaagactcacgttcaccacggttattacctgctgcccatataaataaaccgcctttatcaaccgcatccgtatagaaatctaaaagatcctgattaaattggtgaccatagtaataagcagaacgaggattatcattaaagtacgtgacctgcttaggaataccgtacgattggttgaaaatacgtgcaccacgattccataattggttataaatatctgctgtcgctaaaagaccggaagaaccgtccgaattcactcttgtaatatctgctaaaagtaaattagctctaggagccacaccatttgcagtattaccgccaaccatctctgcaacttgaataccgtgagttgcatccgctggcgcatatctaccagtattcaagattgttccgcgacgaccgaatttattttgaatatctctcgctacagtaggattattgaagccgctgtctacaacagcaaccgttacgccttcccctttaagctctacatttgctttattatttgggtcttctgggtcgtaacctctagaaatatcattccaaacaacccccgttcttggtacatttctcgcttcaatcggagaagttggacttgacggctgcgttggcttgattacaataggatacgaagggctaataggagtatcgtctgcaatcggttctactactggcttctctggctcaactactggtggttcggtggttgggccattttcatttcctgggtttgttacgtctgtaaccggctctgttactggctcagttgttggtggttcaacttctggagcatttccattttcagggtttgttacatctgtaactggttctgttactggctcagttgttggtggttcaacttctggagcatttccattttcagggtttgttacatctgtaactggttcaggttccgtttctgttgctggtggttcagctaccggtttggggtctgtcgcagggggattcatatctggaccagaaaccaccacaccatctacaatcttcgtaatcgtcgtaacaccattcaccgttttataaatcgtttgagtcgtaacaccattacgagtttcagtcaccgtacgaatagtaccttcattcgttgttctagtgtggtcagtaattcgagtacctgaattgctaaccggtctaaaccaagagattggttgataacgagaataaacacccaaatctgattttacgttatataaatcagttttaatattgctagaaaaattatcagcctgagcataacttgctgttgccgatataatggcaattgctaaggcagaatattttgttttcatagatttacacctcttattatatgaaagaactgcaaaacgatcgttcattaatcgtttgcgtggcagattttactcatccgcaaatttagatcaagtcagatgaccgacaagttttaaatttacatttgattgacaattaaaaatatgtaaccagatatttgcatagaaacgcaaataaatcagacaaaaattatgcaaaactatcgataaaaagaagcgataataattaaaattcgcataatgtgcaaaaaggagtttagggatatgtcagtcgttaaaaaaaacaaaaatttattctgttcaaaaaatcaaaaaaattcgtatgaattaaataaaaattcagcttgatacaaacccatttatttacaattatttatatagcaaataattcaataatatttttatatccattcttatttttaataaatacggcatttaatagagtatatatatgcaaaaatagttcactttttttatttattttttaccaattaatgttaattagatatttttagcattaaaaacaagcaataaaaataaaaaaattttcattatttctataatttcatttaattttttctttgaactagtgtttggcgagaataaattttctgatctaaaaggtaggatatagccaagaaaaaggctgcagtattacgacacacatcaagtaatttagttgcaaaaaatactcggaaagatgcaattgtatcagttacagtactactataagctagtaaaaaattatataaaaccacctgattgatacaataaaaaagcctctagtatcacaactagaggcttttcatcaaagaatgatcaagttattatcaatgacgcttacgtctgcttttcgctaagaatgaccaacaaatggtacaaaaaataagagcgaatacgattgcaaacataattagaataacttcaccgatatagtaaacatctaataccgggttatctaaaatatgttgtcggtattcataaaccataaatgccatagataaccaaaccgcccaggttaaagctgtcaaaaacatactttttaagcgaatcttccacccgagctgttttgttttattgatgatcattagcttttgtaattgttgtgctggcatatccttatactcctctatctgggcttgtccatactgctaatctcgatttattacggaaaatggctttaggaatgccacataacaatgtgaccgtatttaacatccaataccaccatggataccatatgcatgagaaagcgtacttcactacccctcgttcataacggttatcaatatagagactgatacttaattgagcaaaaaacgcaataaataaaattgccatactcggctttaacgagccccaattaataaaacttacattaccatctgcagcaaattgatatacgcttgcaatcattgcactaaccaatgagattgcccaaattgcggtaataatatattcggcaaacatcggccataaacggcgatttttcaggtgccaaattttaggaaaatatttcatcatcgtctctgcaccaccttgtgcccaacggaggcgttgattaaataatcctttaatcgtttccggcattaacacccaacataatgctcgaggctcataaaaaatatcgtagccggaggtctgaattttccaacttacatctatatcctcggtgatcatattggtactccaaccaccaatttcatgcataacgtctttgcggaataagcagcatacgccggatacagtaaaaattgtccccattaaacattgagcacgtttaattaacccaataatagaactgaattcagaaacttgtaaacgtcctaaaatggtgctgcgattacgtacacgagggttacctgttaccgcaccgtattcagtattagattccaatgcctgtaccatataatccaatgccatgtaatccaataccgcatcaccgtcaatacatcctacgtatttgcctttcgcaatttttaaaccattgtttaatgcactcgctttaccggaatttttctggtgtaaagcaacgatacggctatcggttttcgcccatttatcaattaactcaccggtattatcacgactgccgtcattgataaaaatcagttcataatttggatattttaaattcaataaatgtggaacggcttcgtctaaattatctgattcgttatagcaaggaatcatcaaactgactaaaggcacatcttcttttttcatctcactgaatttaggcggaacttttaatttttccttaaataggaaataagctccccctgcaacagcccaataaaacgccattacagcaggatacgcaaatacaaataaactcaatacttctagaatcatattatcacctacttccttgtgatatctctattaccagaaacataaggtttcatttcttttaagacggtttcatcaaataaatagcgattcggataatagccgaaactcatgattccattatgttctaataccttaatccaactgattaattcttttgttgaagtattttcagaagtttttggattcacaatagagaaatcaaataatactttcttacttgaaacaccggaatctttaacgatatgagcgatatcttttagccagctttttgcttcttcagcatttgttactccacctaaagaatatggtctggcatcaattaataccccatcatattctttactgaacaccaccaaatcttggataaaatccttttcgctcggattaatatttcttgataacttttgatgacgtgtaccgaaaaatagatagggctcagctgctgatttaagctctttggtaaatgcaatagaggctgcatcattactactccatttatctttaccaattttaccgtcaaagaataaaccgtctcctttagagtaaagagaaagatgtttatataacgatttcatcacatcctcattacgaatatgcattggcaagctctcaattgaagctggcatccaagcgtaaattttaacgcctgctcgtgtacgtaattgccaagcaacttggctgaagatatccgctttaaccggcaaatgtggattagggaaatacgtcccgtccataatgccgtctttatctggatccgaatatgctttcagatacaccgccgttacaccatactgtgctacacggctaatcaatgcatcataatttgctttaaacaccgcaggatctgagttatacacatagtctaaattaatatgcagctcacgttgaaccgtagattcgttctctgtatcttgtgtgcgatttagataatccgcaatcacggcaaaattagactctgcatcaattaagaagcggccaatatgtgtatcaccaacatgatttactttctctttcaatgtaaagtgataagacatacccgcttgcttcgctaattcaatcgctgcatcattaaatgcaccatatggccacaccattactcttggtgctttacctgtatgctttttaataagattaaccgacattttcatatcgtttaacagacgggacttatactgagcttccgtctcatatttaccgtttttgtactccggcgcaatcatcgcagcaagttggctaccaccaggattagctttcacgccatggtgtaaatcatgcgtatgtgaagcgatttcgactaagccactattttgcatctcatcaatttgctgccaagtcgtgaaatacttagcacgatccaatttttcattaccgtattgaatttttccgcccatcggagtgtcaatccaacttgacaccggtgcaaaaacagccggatagttatatgcttttaacaatggataaatcacgctatacatggtttcataaccatcatcaaaagaaattaagacggctttcggcggtaaagtcgtttttccttgttccgcatccattacttgctgccaactcaccacattgtaaccttgtgctttaaaccagttaaaatgtgaaatcagctgttgtgcggtaatagtttgtgaaacataaagacgtttatccttaggcgcactttcatcgacaaccgagtgataagcgagaacgctatatgtatcggcagcaaatgcctttgcaaaaaatagcgaaaaacagaccgctaatgtctgaccgagttttttcaatatcatcttgctttacccactaaaaagaatatgaaagatttacgttaccgtaattattaaattccgcatcaccatcgtagatatttttcttacgaccaatctcataagataaactcactttcttagtaatacgccaatcatgtccgtagcttaaagaccaggagcgttccgccttgtgtccttgctgcttatattgacccgcattcgctcggatatgatgtgttaaagccagaccgtaattcatcggctgccaataacttagatccgcaccgaattctatattgcgactttttaatgggttgtaataccacgcagaggcggtctctttattgcgttgataatcaaaacgcaaattattagttaaagcccaacgatctttcctgaatgtttctgtcgaagcccacgcataaaatgatttacgcagattaccgtcatcaaatttcattgcatttatacccgccccgatacggaataaatcacggtaagtataagtcgtcccaaaaccgatatctttcgtataaaccccttggttaatcgctttaatcggtgttccactaccattcaggttaccggataaatcaaaacgccaacgttgattaaactgataagaagtagctaatgagagataacctttatcgtgtaatttaatccccttaccggcttcaatattcacgttaacaggatataaattcacattcgtaccgacaccgatacgacgctgtttcaacaccgtatcttctgttggcaccttgtcttctgcgtagtgcacataagcataatgtccatccgcgcttttcggtgaattcagataatattcttgtacagtttcattacttgatttattttttggtgcagtctgatgcaatactccgaatgaagcactaaaactgcctcgacgagcatcttcataattttttaaaaccgactctgcagcttcacgctcttccgcagtatagctgtctatcagctgacgagctttacgtaaatttccctgactgagtgcaatatttgcacgctgatttttataagcgccttgatcactttcacctaaaaaatgacttgctttatcagctaaaaaatttgctcgatcatggttattacgagagctttccaaatcacttaatgccaacattgtccaaggatcacccggcacgagatgcatcaatctatcgactaacttttcaatcgctgttgttttatctccacgccagttatgcagattgacctgattgtaataagctcgctcatagtttggattacttaaacgggtcgtatgtgtgaaatcccaaatggtctcactctcacgaatttgatcttgataatcttgcgcttgttggaaataaccggcatcgcttgaagcactaatcaatttaaacaacaatgcggtactcactgcattgtgctgcactcgttcttttgcttccaactcttgataaatatctaaggctttaaatgctgagccttctcttaataacgtatccgcataagcttctttcacataatccggaatgcctttatctaattttattaatctttggtaatcttctctaaccagcgcattactattcaaacgattagcaattgctaaacggtcttgaattgcttgttgatataacggattctcttgagccgccgtattaatgacttgcgttaaacgcttatatgcggtttgcagctcggcttttctcaaactaccattcccttttacggtagaaatcacttcactatgttctagccaagctttatctttttccgtaaacaattctgggtaagtttgcacaagttgtgcttgaacgggatgaacattcaattttgccgctaaccgataaagctgtactgccaatttatgatttgacggattggctttaatttggtcttgccaacgtcctaacttagctaattcaggctccgtctgatccaatagaaaacttgatgcgtccttgtagccgtcatcagcaccaaacttttgcttatattgagcaagatgggtttgagcatcttgatatttgcctaattccgtttcaacaagcgcactgcctaacagaccattcggattttgaggataagaattgcgtagcttcgcatataactgaagggattttggaagattctggcttgtgcggtatgcctttgccaaattttctagctcactttccgagaaactatttacattacatctcgaacagacctgagtcgcctctttaaattgaccttttcgaaccatcaacgcgattaaatcgtcgcgaactttttgatcttgtgtctttttatataaagccgacatttgagtaatagcttgctcaagctggctatctccttgacgtgcaaaaataacgatttcttcacgtttaacatcaatcggcgattgatttgcaaaaaccgtatttgctgctgtagttgagaggagggcaagcacaacgtgattaaatttgatacccataagatacatccataatgtgtttaaaatttataataatgtagagattcagctcacatttgtgagctttttctctacttgggatctagcttttatctttattaaatattacattagcgtacatgtgtaagcttaaactaataaataaaggatttatatgaatcagctgtcagacttccatttcgttcatcgagtacgacaacaagcaaaaaagctacaaaactcgaccgctttacgccataaggaaaatggcacatgggtggatatttcttggcaagactttcaatcacagattgataaagtttctctcgcattactagctcatggtattggaatacaagataaaattggcatctttgctcacaatatgccgcaatggactatagcggatctaggtgcgttacagattcgtgccgtaaccgtacccatttatgcgacaaataccgccaaacaagctgaattaattattaataatgcggacatcaaactcttgttcgtaggagatcaagaacagcttgatgtggcattagaaattgctaaaaactgtccttcgctcgagaaaatcattgtcatgaaacctcatcttgagggagtgcttgacaatgcttcttcatcgtgtggttggaatgatttcttaggaaaaagttccgaaaaataccgctctgaactcatccgatgtctaagcagcatccagctcgatgatttatttaccataatttatacttcgggaacgactggtacacctaaaggtgtgatgttggacttctcaaaccttgctcaccagctacaagcacacgatttagccttacctgaggtaggacctgatgatgtatcactgtcattcttacctttttcgcatattttcgaacgggcttgggtcgcttatttattacataaaggcgcaaccgtctgctatttggaagacaccaacgaagtacgtacagcattagccgaagtcaaaccaacgttaatgtgtgccgttcctcgtttattcgaaaaaatgtatagcgctatttttgataaagtaaaacaagcgccttttcatcgccgagcattatttcgctgggcgctaaaacaaggaaaaacttttgttcatacacaaaaagccacattagcctacaaactagcaaataaattagttctaacaaaattaagagcgctattaggcggaaacatcaaaatgatgccttgcggtggggcaaaattagaaccggctatcggcgaattcttccatagcatcggtgttaatgtgaaactaggctatggtatgacggaaacaaccgctactgtttcttgctggacggatcgtaactttgctttaaattccattggaacgctaatgccgaatgccgaggtaaaaatcggtgaagataatgaaattctggtgcgtggaggaatggtgatgaaaggctattataaaaacccggaagaaactgctaaagccttcaccgaagacggcttcttgcgtaccggagatgccggcgcattggatgaacatggtaacctgtatattactgatcgtattaaagagctgatgaagacctcaaacggcaaatacattgctccgcaatatatcgaaggtaaattggctaaagataaatttattgaacaaattgcagtgattgcagacaccaaaaaatacgtctcggcactgattgtgccttcattcgaggctttggaagaatatgctaaacaattgaatatcagatatcatgaccgccttgaattaatcaagcattcggcagttattcaattatttgaaaaacgcattgaagagttacaacaagagcttgcccatttcgaacaaattaaaaagttcaccttactgccgcaagcttttagtatccatatggaagaactcaccccaacgcttaaattacgccgtaaggtcattttggaacgctatcgtccacaaattgaagcgatgtataactagctaaaaaacaagcggttgaatttgtaaaaaaatttgcaaattcaaccgcttgtatcgtcttactacttattcaactgaaccggtaacagtaaacttaacgggcgcttacggataatttcccataagcattttaaaatttcccgccagctatcaatttcggtattgcgtgaacgcagcgcaatccatagcgttagagagaaactgacaatcaagttaaccgcaccgatcattaacacaaagcagatgctttgcagtaacacttgccagcctaatgattcactcaccaccgcatagccgacattcgccgaagaaaaggcaacatggcgaatatcaagcggtaatcctaaccaataaccaatcacaccggtaataccaagcaacataccgaatcctaagttaccgataatcgaacctgcattatcatgcacatagtcagcaaatttctctcggatggataacggcaaaatcgcttttaaccacgggtgctgtcttaaacgcatacgggtatttaaatagttgctgcggttatcaaagtaaccggaaataatccccgagcagaataaccacaaaccggcaattgccgcaaaccataacgttcctttagtcgggtcaatcgaatttagctgatattgcaccatttcactgtctaatagcgcttcgccggtatgtttagcatagccataggcaatcaatgccgccacactcatcgatacaatcacattccccaataccgcaatactttgtgaacgcagtacatccaccagcaattgcgccagtttcatattcactgctctgccctgcgggttgcgctcgaccgcctcggcaaaacgtgcggcagtcatcgccggctgcttggtcgctacggtaaaatgcaacataaagataacggtaaaaccgataccgtagttcaaaccttccgcaatacctttccagactttatcgtcaatcattccgcctagatacactttaaatagcgccatcagcgcaatcagcacaccaccaccggcagcggaataaaacatactgaaatattcttttttatcacgggtaatatagtgttcgccgtgatcactggtatgttgggtaatactgcgagaaagcattttgacgctttgtttccataaatcggaaatactgtgttgctttgccgaagcttccgccaacattttggtaatttgtaacacgcgcaaacgagcaacacggttggtagaaaataattccatcaacatggataaacggtctaaggtctggcttaaacgctcaagcaaatgcgccacgccaagtgatgagccggctgttgatccttttttctgtaagcgatccaccaattcacgcgattgaccaaacatcacctgtaaatggctatcgtcatagtattgattttgacgacgagcctccaaccattgaaagacctctttttgcaatgcgacaaaaggcgaatccgcatccagcaatgttggatctaagcgaattaactccggttccaaatcctctgccgcaatccaaatcgagagcattttgatcgcaaataacccttcgtgacgaatatgttcatacagccaagttctatcctgttcgcttacgctgcgatctaaagtattgaggaaatttaaccaacttttagtcggaatggcattaacccattcctcatcatggcgatcgcaaaacagcagaataaatacatcacgtaaatcattcacgtctttaaatgacggattgagtttctcatataagcgattacgcatttcacgcccgaaaccttggcgccccaaaatgccgctactgactaaaatcggatataaacgtaactggcaaagccaacggcaaatcaatgtcgcaactgcttgagctagttccggctgttgcttaagtaaattggtaaaaaattctaatttttcgaccgcttgttccggcttgccggctctaagccactgacataaaccgttcagtaaagtaaaagcgtcgttttgttcgatttgctgggtaataaagggtaaaagtgtcgtttcattaagttttatttttggcatatttgattatatttgttcctatctttcagtaaattcaataattttgagcctattttacgagaaaaagttcaaaatagaacggtaagtttacccctaccgctcttcaccattaaactaatttaaaaatcacttcaaagctttcgccctgttgcaacttgcgatttatacgtgctgtttcgacacataacattgtttgataaccggtttcgctcatcgcacttgtcgctttatgccacgggttccacaacacaatatcgctcgcatcaatatgctcaatttgaatcgtgcgttgatttgccgcatcttcaatacgattaatagactgctccgcgctataaatgcaatccacattttcatggattttacgtggtgaaggcacttgtacaaattgtttagtcagcgaatcaaaacattcatgcggtaaacctttcacttcggtttgctgaatatccgccacattgaaatagctatgcaatgccgcctgtgcttcttgctctgcataatgagtgaaaatcaaatgacattcttggttaaacgccatttcaattttcgcttcgataatattttgttcgtcatagagcgaaaattctaaataggcatattcctcatccatttcataatggctgagtgaccactcacgaatgcgagccgtgccatgtgacggactttttaccgaaccgaaccacggataacaaatcggcacaccgccacgaatcgcattgcctttttggaacggttcaatctccgaaagccataacacatcttgtttcgccgcagccggttgccaacttaataattgtgcgccttgtaaagccactactgctgctcctaacttatgtgtaacacgaatcacatataactcatgacatttctcgaggctaataccttggctgatttgacgaataaattcggttttcatgttctactcctttaacacttccaaaagcaagcggtcaaatttacaactttttttgcaaatttgaccgcttgaacttaatcgatattttgtaattcttgttcagaaagttgctctttaccgctatcttccactttaccgtcactcactttaaattcgaggttttggaaataagcttcacggaaggtaatgtatggatcggaagactgctgtaataatgcatcttgatctaataattttgagcgactatccaccccttgtacggcaaattttgccgctgtccaaggcatggttagcatagataataccggataagctgaatccgccgctttaccaaccgcctgacgaggagtggttgcgccgtagccgggcaccataatataagtccccgccggtacatgataagtgccaagtgtatgaccaaactcacgattaccgttatccaatttgagatccggtgtttggcttgcccaatcaattaaaccgcctaaaccgaaaattgagttaatccaaaaacggttaaagtggatcatcgcttttttaccttcaccttccaacaagcggttaacaaaacttgccggttcatcaaggttattcgccacattggttaaaccggttttaatcgggcttggcacataatcacgccagcctgtcgcaaccggttttaatacataaggatcgatatattcataattcactttccacatcgcacgattaaagccttgcagtggatctttacgctcaccggttgccggatcaatcgccgatgaacatgccgttaacatcacaatccccgccactaagcctaattgttttaatttcattatctttaccttatcaaagaaatcattggcgcattttaaccaactcttcctaaaacacaaagtaaacaagcgtaaaattcaaaatagaaatctagacgtctagattgcgatatcaaatagttttgattacaataccgacaatttttatcgaagattaggaatttaactatggcagattggagtggcgaatatattagcccgtatgccgaacacggcaaaaaaagcgaacaggtcaaaaagatcaccgtctcgatcccgattaaagtattagaaattttaactaacgagcgtactcgtcgccaaatcaaaaacctacgtcacgcaacgaatagcgaattattgtgcgaggcatttttgcatgcatttaccggacagccgttacctacggatgaagatctgatgaaagagcgtagcgatgaaattccggaagaagccaaagctaaaatgcgagaattaggtattgatcctgataactggcagtattaatttttagtaagcctcattttattgaggcttttttctaacaacaaaaaggtatcttatgcattatcaacaacttgcaagagaggctcgctgggcagtttggcttgctttagtttacttattcggctggatagctttcgcttacttctcaccggcaggacgcggcattttcggttttccaatttggtttgaacttgcttgcattgcactaccacttggttttactgtgattgtgtattgggtggtcaaaaaagtttatcaaaatattgatctaaataaggaacaaagcgatgaataaagagatgttattaccgctaatcgcttatttatgcttcgtgttcggtgtcgcgttttatgcctatcgtaaacgccaaggcggcagctttttatccgaatattatgtgggcagccgctcaatgtccggttttgtattggcaatgaccactgctgcgacttatgtcggcgcaagttcgtttattgggggaccaggagctgcctataagtacggattaggttgggtattgcttgcgatgatccaagtaccggcggtgttactggcattaggggcattaggcaaaaaatttgcgttacttgctcgtaaatataacgcagtaaccatcaatgatttattattggctcgctatcaaaataaacttgtagtttggatttcaggctttgccctgttgctttcgttctttgcgatgatgacggtacagtttatcggtgcggggcgcttactggaaactacgctaggcgtgccgtatcaaacagcagtaattatttttgcggtcaccgttggagtttatacctttatcggcggcttccgtgcggtggtgttgactgatacgattcaaggcttagtaatgttaatcggtacttcattattgctaggaggagtgatttatgctgcaggcggtgttgagaatgcgatgaacactttgcaaaatatcaatcctcaattaattgagccgtacggcattgatgaacgtccgctagattttacctttatgacttcgttctgggtattggtctgcttcggtttaatcggtttaccacagttggcggtacgcagtatggcgtataaagacagcgcttcattacataaagctctcgtcatcggtactttagtggtatcgctactgatgttcggtatgcaccttgccggtgtacttggacgtgcggtcattcctgatttaaaaattccagatcaggtcattccaaccctaatgattcaagtgctaccaccactggttgccggtattttcttagccgccccgatggctgcgattatgtcatcgattgactcattattaattcaatcgtcttccaccttaatcaaagatttatatttagcggtgaagccggaagcagtcgataacgaagcgaagttaaagctcttctcaaccatgaccacactcacttttgctgtgttattggtgtttgcggcgttaaatccgccggatatgttaatttggcttaacttactttcgctcggtggcttagaagcaacgttcttgtgggtgattgtgttgggactttattggaaaaatgcgaatgcagcaggtgcaattagctcaatgttggcaggtttaacaagttatgtgattttcaccacatttaaaatcagcatttttagcttccatgcgattgtgccgtcattagttatcggtttaattgccttccttattggcaaccgttttggcaacaaagttaactaagtcattctcccctcattaaaaaagcggtcaaaatttgcaaatttttagcaaattttgaccgcttgttcttaaggtgaaccttattcggtggcaagaatcatccctgccgctaccgtgtgataggtcgcttcgtcaattaaaataaatgacccggtcgcaacattttgtgcataagtggtggcggtaatcggcttttgtaagctaagttgtaactcgccgatatcatttaatttcaaactgtccgcttcgcttgaattgctcaaggtttttacatctagtacgtgatcaacttcagtaactttagcaaacacagtttgtgtagtatgttttagtaaatatttacgagccggatttaatgctcgttggtcaaaccaacataccgtagcagttaagcgttttgtggcgataatcggcgaatgttgtgcaacaaaagtatcgccgcgtgaaatatcaatatcatctgccaaacgaatcgttacctgctcaccggcaaccgctttttgtacgataccattcgggctaataatttccgatacggtcgaggtgtagccgttcggttcaattcgaatcgtatcgcctacgctaaccgaaccggcttcgattctgccttgatagcctcgaaaatcgtccgctttatcttgatctaaacgactgactaactgcaccggaaaatgaaaatcttccactcgttccgataaattctcgttgctcggtaagttttctaaaatggtgagtaacggctctcccgcataccaaggtgtgcgttcgcttttatgcacgatattgtcgccttgcaaagcggaaaccggcacaaattgtatgtgctgaataccaagctgatcggctaacttgcggtaagcagtggtaattgcttcaaattttgcaacatcaaaatccaacaaatccattttgtttaccgccactaaaatatagggcgtatttaaatgttttaagattgccgaatggcgttttgtttgcggtaacaattccagttccgcttggttaaaatccaattgcgaagcatcaattaatactacggcagcattagcagttgaagcaccggtcaccatattacgggtatattgttcatgccccggtgtgtcggcaataataaatttgcgttttgcggtagaaaaataacgatacgccacgtcaatggtaatgccttgctcacgttctgcttctaagccgtctgtcagaatcgaaaaatcaatgacttcgcccgcatttttagatttattcaaacttaataactggtcgcttaataacgctttgctgtcataaagtaaacgcccgattaacgtacttttaccgtcatctacgctaccagcggtgatgaaacgaagtggtgcatattggtttaaattgctcatattattatccttttattcctagcacagcaaagccgtactaggttacgcatagtgttgccttactgggcaaattgagtatttagaagtaaccttgttttttacgttgttccattgccgcttcgctggctcggtcatccattcgggtggcggatcgttctgaaatttcggccactgcggtttctttaataatatctgccggtgttgcagcggtgctggcaactgggcaagtacagctaatatcacccacagtacggaaacgcacagatacgattttactttcttcattcgcttgttttggcgttagtggagtaaccggcacgagtaagccattgcgttctaccacctcacgttggtgggcataataaatcggtggtaattccaatttttcacgttcgatatattgccaaatatctaattccgtccagttagaaatcgggaacactcgcatattttcgcctttatgtaatttggcgttatagagcgaccataattccggacgttgtgcctttggatcccattgaccaaactcatcacggaacgagaaaatccgctctttagcacgggctttttcttcatctcgtcttgcgccacccattaaggcatcaaagccgttggcttcaatcgtttctaataaagtgaccgcttgtgctgcattgcgagaatctgtttctttgcgtaataccaccgtacctttagcgattgaatcttcaacgtggccgactaccaattttgcatttaattttttcacttgttcgtctcggaactgaatcacttcagggtaattatgccccgtgtcgatatgtactaatgggaacggcagcactaaatcacgtccttcaagttgaaaggctttacgcgctaaagcaagtaataccaccgagtctttaccaccggaaaacagtaatgcaggattgctacattccgccaccacttcacgaatgatgtaaatcgactccgcctcaagccaatctaaatgtccgttttcgatattattttgcgttgtcatattttcagatccttttatttatgtaatccacactctttactgtctttgttttcccaccaccaacggccagctcgaatatcttctccgactttgaccggacgggtacaaggctcgcagccgatacttgggaaaccttgtttatacagttcgttataaggaatttgatgttttaagatatatgcccaaacctctaattcggaccaatcaaaaatcgggttatatttatcaatgcccctgccactatcttgttcgtgtaaagcaagtgcggtgcgagtgaccgattgttctcggcgttgtccggttagccacgcatccgcatcttgtaaggctcgattaagcggttcgattttgcggataaaacaacaatcacgacgtaattccacgctttcataaaaagcgaatttgcctttttgccgatcatattccgccgctttttgcgtatcaggataataaagttggaaatttaaattcgggtaatttgctttcactttatcgaccagcgctaaagtttctggatttaaacgtccggtttctaaggtaaacacagtaatgtttgcttggcttttggcgattacatcggtaatcagcatatcttccaccgccaagctgctggcgaattttgcattacggtgctgttggctaatttgttgaatacgttgatataaagcggtctctttttgactaagatttgcaaaatccgcttcgctcggagtcgggatttgccataaattcggtcttaaaaaactcattgccttcctcctattacgctgcctgcttccaatgcgtttctttattttgtaatgttggtttctgccaaagtgtttcttgagtcgaaacaaattgcaccgcttctttgccgaaccaagcaaggtctttttgcaatttcaccacttcgccaatcacaatcaatgccggtgtcggggctttttcagcaagttccgctaattcactcagcacaccagtttgcacctgttgatttggcaatgtgccgttactaatgattgctaccggtgtatcggacggtttgccgtgtttttgtaactcggcggacagctcagcggctttaattgtccccatataaaccaccagcgtttgattgccttgggcaagcgtttcccatttaagtcggtttccgtccggctttaaatgaccggtaataaacattgccgtttgcgcatgatcacgatgcgtaagcggaattcctgcataagcggtcgcccctaatgcagcggtgatccccggcacaacactaaacggaatattttccgctttaagcacttccaattcttcgccgccacgcccgaatacaaacggatcaccaccttttaaacgcaccacccgtttaccttgtttggcatatttaaccaataactgattggtatcatcttgtttaacgctgtgtttgccggcacgtttaccgacaaatactttatccgcatcacggcgaaccaattctaaaattgcctcggaaaccaaggcgtcatataacaccacatccgcctgttgaatggtttgcaaaccttttagggtgagtaaaccggcatcacccggccctgcgccgactaacgaaacctcgcccaaaaccggattattgttttgtaattcagcatccactaatgcttccgcttgttcgatttgatgattttcagtcagacgctgaaaactttggtgggtaaacagtttttcccaaaaacggcggcgttgggttaattgaggaaatttggttttgaccgcataacgccaacgggtcgcaatatctgccattgcacctaaattatgtggaattaatgcttctagtttttcacgtaacaaacgaattaataccggtgctgcaccgccgcttgaaatggcaatttgcaccggagaacggtcgataatcgaagggaaaatataactacagcgaggttggtcatctactacgttcactaagcgttgttggctttccgccgtatcaaatacctgctgatttaaggcattgtcatcggtggcggcgatcactaaatagctagaggtaacttgactcgcttcaaatgctttggcaagccattcgactttaccttcatcaaccaaaacttgtagcgaggaatggagtttctccgctaccactttgactgacgctccggcttttaataaagcattaattttacgtagcgcaacgtgtccgccccctacgaccaataccggtcgtttttttaaatcaacaaaaattggtaagtaattcatattttccccactcgcttaaaacaagccacgatttgttttattaagttataagagaaattttttattctgaaaaataataacaggatatagattagagtcttttggaataaagctgatttttaaaagctttgtctgaggtcctttgatttagaacaaacaatttgtgatgttctaccctatttttattccataaagctatatcaataaagtttcagttctttgctaaagccgattatgcagttagatttttagccaatatgaggatttagcacgatgattgtaaaaaaaatcttttttctgaccgcttgtttaatgctctctgttcaagcattcgctgttgagctgttaaatgtttcttatgatccgacacgtgagttttataaagaatataaccgcttatttactgaatattggcagcaacaaagcggtgagcaaattacggtgaaaacctcacacggcggttccggaaaacaagctcgtgcggtcatcgacggtttgcaagcggatgtcgttaccttagcgctagccgctgatattgatgcgttaaataaacatcaagctctgatcgatccaaattggcaacagcgtttgagcaaacgcagtttgccgtatagttcgaccattgtatttttagtacgtaaagggaatccgaaacggatctacgactggcaggatttagtgcgtgatccaagcattgaagtgattacaccgaatccaaaaacgtccggcggagcaagatggaattttttagccgcttgggcatacgctaagcaccatttcggcacggaacagcaagcgctggaatttgtcacccagctttatcaacaagtgccggtattagataccggcgcaagaggagcgacgatgagttttatccaacgtggcttgggcgatgttttacttgcttgggaaaacgaggcttatcttgccttgcaggaagaaggtggcgaggagtttgaaattatcacgccgaaagtttcgattgtggctgaaccgccggtcgctttagtggataaggtggtagataaaaaaggcactcgtaaacaagcggaagcttatctgaattatttgtatagcgaagcggtgcaacgcctgattgccaaacatcattatcgccctgcaagcggtcaaattttggcagaatttcgccaacagtttccggatctgaaattattaacgatgcacgaagtttttggcggtggttggggcttgattcagccgaaattttttgatgacggtgcgatcttcgatcaaatgttagaaaaaatttatcaataaataggctaaggaaatgttatgcagcaaactcgaattattcctggttttaatctttcgttaggctatacactcacatttttaagccttgtggtactgattccgctcgccggattatttatcttctccgcccaaatttctgccgagcaatttctcaaattgattaccagccgacagttattattggcattaggcttgtctttcaaaagtgccttcagtgccgcattactaaatagttttatcggcttattgctagcgtgggtgttggtgcgttatcagttttggggcaaacgtttaatggatacgtttattgatatgccgtttgctttaccaaccgcagtagcaggtattgcactcacggcaatttattctcgtaacggtattatcgggcaattttttgaaaccaaaatcgcttacagttcactgggcattacattagcacttttatttgtcactttaccctttgtggttcgcacgctacaaccagtgctggaagacttaccgaaggatgtggaagaagcagcttcgattttgggagcaaatgcttttcagacttttcgttacgtgatttttccggcaattttaccagcttggattaccggttttaccctcgcttttgcacgaggcatcggcgaatacggttcggtcgtgtttatttccggtaatttgccgtttagaaccgaaatcctaccgctggtgattatgtcaaaactcgatcaatacgattatgtcggcgcggcaaccattggcgtattaatgctgattatttcgtttttactgatttttgtgatcaacctcattcagcgttacttcgctaagcggacagcaaaatagaagggaagaaatatgcaaagtttactcaaaaaacgaccgcttgttgaaagactattaatcggcttagcgattctgctatttgtgattttgctacttttaccgttattggtggtaatttcacaagggttggcaaaaggcttggattttttccttgcgtcaatcagcgaggaagatacgcttgctgcgctaaaactaaccctattagccacaacaattgccgtgccgctgaatatcattttcgggattgccgcagcttgggcggtcacgaaatatcaatttagaggcagacagcttttgcttaccttaattgatttacctttttcgatttcaccggtggtggcaggcttaatttacgtgttgttattcggtgcacaaagttggctttatccacatttacaagcggtcgattttcaaattgtttatgcgattccggggattattttagctaccctatttgtttctgtgccttttgtcgcacgagaactgattccgattatggaagcacaaggcacaacggaagaagaagcggcagcagtattgggcgcaaacggctggcaaattttctaccacgtcactttaccgaatatcaaatgggcattattacacggcgtggtactctgtaccgctcgtgcgttaggcgaattcggggcggtttcggtagtatcgggacatatacggggattaactaacaccttaccgctgcaaatcgagattttatacaacgaatacaacattgtggcggcattttcagttgcgattttattacttggtttatctttaattttattatttattcgtcagtggacagaggcgaaattagcacgatagtggggcattatggcaattagcgttaaacaaattaataagcgctttggacaattccaagcactcaataatattgattttagtattcaaaatggtgaattgaccgccttactcgggccatccggctgcggaaaaaccacgttgttacgcattattgccgggctggaaaccgcaacaagcggtcaaattttatttgatgattgcgatgtgactcagttatcggcgaaagaacgggatatcggctttgtatttcaacattatgccctatttcgccatatgacgattaccgacaatattgctttcggcttacgaatgaagccaaaacaagaacgtttatccgaagcggaaattcaaacgaaagttaaaaatctcttggagctgattcagctggaacatatcggcggacgctatcctgatcagctttctggcggtcagcgtcaacgtgttgccttggcaagagcgatcgcaaccgagccgaaagtgttgctgttagacgaaccgttcggcgctttagatgcgaaagtgcgtaaagatttgcgccgttggttgcgtgattttcatcatgaaattaacctcaccagtatttttgtgactcacgatcaagatgaagcattggaagttgcggataaaatcattctgatgaataaaggacaaatcgagcaaatcggtacaccggaacaggtttataaacaaccgagaagtgcatttgtggcaaattttttgggcgatgtgaatattttacacggttatattttagacagcgtattacatattgatacgtttaaaaagccaattgaacaatgttatgccgctgatgatgtggtggtctatgttcgtccgcacgaaattgccattagcaaaacgcataaagaaaattcgctaaaaggcgttatagctcgtgtacatactgccggacctactgtctttttagaggtgttacataaaaatcacgaaccgatagaaatatccgtcagttatgctcaattcgggcaagaacaatttgctgtgggtgatgaagtctatttccaaccgttactaatcaatttctttgtacaaaatgaattgattgaatttatgatttaatagataagaatatctttatgtcattgtaaattatgtttttttatatatcgctacgtatataatgtaaaggtagatgttctacataatttttacttaacttatatatccaaggagaattgatgaaaaagcataacattgcacttaccctattaatggttctaggtgtggctgcttgtgggagtagcagcggaagttcaagctctacaacagagaacaaaacaaccccaaccgcagttaatttgtcaacacccgcacctgctgcaaatacttcacgaactccttcagcttcagttactgatgagaaaccatcaactgattcacattctgctagcgataacgtaatggcaggaagcggttttattttacctaaacctgaaacaggaggtaatgttcaggctgtagatcttaaaggccatagtaaaggtgattttggctggattcaagtagaaggaaaaagcattgctttaattccaaatggattaaaaacaggacactttgaatctaaggctggaaatatgatccgaaatatagatatgcaaaactatactgcatggggcctagtatgggatgcaggactggaaaaacaataccttaccactcaaggcgtaaatgcaacaacagatataccaaaaaacggtatctatacttataaaggttcggcaattcaattcagtggtacaaataacactattgaactaaattctgcaacaagaatttcagatgctgaattcacggctgactttgatcataaagtgtttgcaggcattatcccacaatcggatattaataatccaattatgttagctgctgaaattactgacaatacatttgctggtgaatcaaacggtattaaaactaaaggcggtttctttggtcctcaagcaagtgaagtcattggcgattacataagtaccggagagaagcctgtcgtaggtgtcttcggcgctaagaaacaagataagcgataaataattaattatcacctagtcgtataagcggttaaatttgtgatttttttgcaaacataaccgctttttaactagccagaataaacaaaaataaagcactgtatcttttgatgcagtgctttaattatatgcgtcattctatcaattattagctaatagaatgcgttctcggtctaggttgtggttgttcaatagataaacctccttctgagtttgctcttgcacgtggagccggtgtcggtgccgcattgttattcacctgtggggtcggcttcgcaaacggctgagacgcttcacttccgaccgaatttgaacgtgctctcggcgttggacgatcactctccgtaccagcaaatgaatttgaacgcgcacgtggagccggtgtcggtgccgcattattattcacttgcggagtcagcttcgcaaacggctgagacgcttcatttccgaccgaatttgaacgtgctctcggcgttggacgatcactttccgtaccagcaaatgaatttgaacgtgcacgtggagccggtgtcggcgccgcattattattcacttgcggagtcggcttcgcaaacggctgagacgcttcattccgatcaccgtccgtacctgcaaatgaatttgaacgtgcacgtggagccggtgtcggcgccgcattattattcacttgcggagtcggcttcgcaaacggctgagacgcttcatttccgaccgaatttgaacgtgctctcggtgttgggcgatcaccgtccgtacctgcaaatgaatttgaacgtgcacgtggagccggtgtcggcgccgcattattattcacttgcggagtcggtttcgcaaacggctgagatggttcatttccaactgaatttgaacgtgctctcggtgttgggcgatcaccgcctgtacctgcaaatgaatctgagcgacctcttggtgtcggaacggcatttcctcttggtggcgtaacgttattgtttgcctgagcttgaggagagcgttgttctctaggagaagcaatacctcctgtagaatttgagcgtcctcttgaagctgtatctgcatttcctctttcaggagtgctaagagagcgattcaattgcggtcgattacttccattttccacctgtcctcttgaagcggtacgatccgaagataaattaccacttgcagaattcgaacgatttaacgttggtcgttctgcctgaggcgttggcgtactagctgagcgttctaagcgagggcgtgccgaattatctgcacttctatttgctgtttctgactcttcttttttcggttttttggtcaatgactctctctcctttttgagtttgaggacatcaaaatcaaatttaccgccttggattttatcatcacgcaatactttttctgttttatctacagaatcggtaatgttaccttcttttttaccaagatgagtaatacctgatatcgctgagccatgttcagatttatagtgtacttgatcttcttggccgccagatacgatcgcttgtgataatgaataatcgtctttaaagcctaacgttgctccacctgtataacctcctttatcatggtggtcagttaaagtcttactggtaatatcaccatttacggttaaaccaccactatttgttttatcaacgacatatccacctgatgtttctaaatcattgatttgtccggataattgatttgcagagatacctgatttttcaccaacttttgctttagattcactaccgaagcctccaccaataccagctcgaattcccggattttcaaacccatttgaatttaatgaaccagttaaactcaagttagcatcaaaagaatgatgtttttcagttttggtatcttgcaagctatttacccgagttttaccttgtacgttcaaatcaactttgtctgcgtcaacattcgccccattcaagttaaaatcaccaccagcttcaactttatgtgatttacctctgaatttagagttttgatatgttgtagatgactcatttgatgatttatagccgccacttacaccaagagaaccgtttgcaaagcaacctgcaactgtacatgcaccgcctacacttgcactaacacctgcattgcgctgtgtagaactttttgttgtctcagttttacctgcattatagttaactgaaccgcttgctttagtcgttaagtctgaattgctatccgtatctacagcagttaaatctacatcaccgtcttgagcgacaagtgttgttttaccgccaagtcgagttcggttatcgcttttcgtattactttgtgactctttatattctgaacgtactgaagcacctacagagccattcactaatggaccggtagccgctttaaaagcatcacttgcatgttgtaacgctttagatgggcttgccaatttgccattatcttgctcacgaatgcccttcactgcattagatgcagcagataaagcgcctgatccaacattaccttgtacctgaagagataatgaagatgattgactttcttcatctatttcattcttctgtttttctgaagtgattttcttcgcaactaaatggaaaccggaattatctgtttctgatttttttgcttcctcttcataaaacgattcatctttctctttaaagttctcattgatttcttgttcagtgagttttctcggtaattttggtttacctacttttttcgcagtacctccagttgcatttggatttgcagcactattctgcgaagtttgtgcagtattgtcattagcttgatcctgagcattatcttctcccggaccatttggatcggcattaatgtcaaccccaccaatattagcctcacctaacacattcaatttacctttattggctttaaaggtactattacgatgggtaagttcagtacgtttatttcgctcggttttaaaggttaatgagccttgagcttgtaaattactttgtgaactatttgtatcggtttttactgttgttccttcatcatctgaataaccagctttgaaagaatatccgccaaatccgccggaaacatcactaccaagcgatattgtcgattcaacagattcggtatggctaatatttttacctgctttggtatcatatttaccttttacaacaccggttgttttatccgattcataatcgctaccttcctggttgaagttacggtgaacagcaagatgagagtgtccggctttaaagctcgcaccttctgaagtagcttctttagtcgtcgtatttttacctccgattactcgaccacttttagcatgtagatcttcagttttgctttcagatttaaccgtatgttgatcttttaagttgagatctcgggtatgaacataactcgttttagattcggttacagaatttttaagattaatatctgcatctttatctgtaattaaagagttatgtttttctgcttcaatatgtgcatttttctcagctatttgattacccttatcatcaatataactttttgatgttgaatcaatgcctcgtttaccctctatacggttgttcttacctgaaatgctgccgccatggttaatgactttattttcagcttttatatcatttttctcacttgaagaaacttgaccggcattatagaaatcctctgaacgaactttggtattatctgccacaattgagccactgcctgaaccttgagctttttccgcatcagctattgtctgtttagataaataaacttgcggaatcaatacttcctggccattcagtttagtttttacataccagataatatcggattttaatgctgcacgttgagcatctgttaacggtttaccaatttctagccctagcttttcagcttccgctttcgcattatccattaatttgccaacagcttctttatccgtcaatttattggttcgttgatagtaattaccaatttttttctcaagtgagcgagtaatcaactgatgttggaaatagttgtctccaataacgttataatcattatgatcatccggcttaaccttatcaaagaagtgttttataccgtaatactcgtcttgattaatataacccgcacgtgtttgatataaattattgagtgtacgattgccatctgacttaggttgcgctttcggtgcatccggctgagccttcggtgtcgtatccggttgtgtttttggcatatcagcctttggtgctacatccggctgtgtttttggcgacacatctggctgtactttaggtacattaggtttaggttgtggcttcggcacaaaaatatatggattattgagcaactcttctaacgtttccgtatcaatgtcgttatcttcacgtttctcaaattccaaaggtttaaagttgccttgatcaatctcaagtttatgcttaccaatatctagctcttgtttttgatcataagtacctttatccgcattattaccattgcctaaatcttggatatttaaatcaacattccctgacaagagaagtgctttttggttaccatagaagctctgtaccggtgctttatttggattttctttaaatgctttccatctgctaactaaattatgatatgactcataagtagtacctttccagtctggaccgaatactgcggacatcattttttggaatgtaggatcatctactttagctaatgccttaaagacaccgagcggattaatatcatatatttgtttgccatctataatagaatcaaaaaactcatctaatgagctaaagtctaaaaaatgtgcataagtcaacggaactgggattccatgccattcgcggaaatgttctaaataaaatggtattccttgcttgaaatattgttgaacgctaagctgttttgatgctccatcatttaatcctttatttgcatacacggtcagattattctgtgtattaattatgccttgattaaggaagttataatcaccgtcaggtgcatttaccttagtttgggttacaatccccgccagatccgcatcttctgctaaatgacggaatttttccttcactgactcatcaatttcttttgatttccagttagtatcaaaatcttgatagaaattaaacccatggcccgctttaactcgacctaccgattgtgtttttaaatcagataaatcgaattggttaagcccttttaggaatttaaaggtataagtgtcataagttgaacctctttgacgataagtgtaatcatttagctggcggtatttttgatctaaactaaaacgcggattacctgctaataccgtacggttttggaatttatgcgaatatacatttacatcatggccagcagaaagaacgccatagttgaatacatagaacggcgcatttaaattaatatcacctttttctgaatgtacaaatccactagcttggttggtaatatgttttccggcaaataaattcacaatattttttgccccaataaaacctttattatcaatttcatcggctgcaacactaataccatcgttacttaaaatagcgccttcattagtaaaattattggtaaaaccaaacttaatcttaccgaagttttctacatcatagtttttctcaatatgtgcattgcgacctaaaacaataagattgtttttagtttgagctaatttgtgctttttagaattaaaatctttatcacggtttttaccaaattgaattttagcgttgttattacttactaaattaccttggttgtcgtataacgaatctgtcgtaatattgagttcatcttcagttgtaatattacccgtatttttgaagctatcgaaagttagggttgctttattcgcattaattacaccggctaattgagcattagtagaatctaaggttaatgtttcagaagcagaaattttactatctttctctgtttttaaattgttacctgctttaagcttaccgtgcttgctagcaattgatgtgccattgcctaatgtaatgttatctttggctgttaaggtcgcctgttcttgcgcgtttatttgcgcttttttagaaagcgtaatggaattgcctgaagaatctaaattaacatttttagcagatactgcattgccgacattgatattacctaaagtttgagcatcaaatttttcacctgctttagccggaccacctaattcaatatgacctaaacttgaaatacgaatattttctcgagaagttaatgcgcctttatgcgatacccccgcaccaaagtccgttgtaattaattcaatattgcgaccattcattgcacctaaatcactaccagaaatggcaatgtcttggcccggtttattggctaaattccctttactttggaaagtacgatttttaacgtcatacttacttccaccggcaagcaaacgaacatccgtttctttattttttgacttaacagcaccttttaattcaatcgttttagaaacgatatcaaaataggctaagccgtctgttgccacaccattgctatcaatcagaattttaccttgtccgacatctagattaagcccatttttcggatcaattacattactagtcgaaacggttaagcgattactatttatagcttgcacaccatttaatgtcacaccattagggttaataattaaaagatcggcttttccaccagaaacttctaaaccgccacgtaaggttgattgctctttacctgttacttggctaaggattgttctggcttcacctgaggttaaatttttattacgctcaatatcacctacaatttgagatttaccgtctttattaaagttattattaaataccgcactgttcggtatattaaaacgttggaaacggttatctgaaacaccatcatgttctgggttagcaatatctacaataatagttttattatctaactgcttgatttgtgttttatcttggaatgcaggatcaacaatcgcatccggtgttgcaagcgcaaaaggcgcaagtaacacttggctgaacaatgctgtgagcgctgctcgtgtaatcacaattttggttggtgaaagaacattatttaccaatatcgacagcggtgataattggcttttaagttcggaaatcgttgcagcattggctttgatttcgccatttactgatgaaggcgacttacctgctgctgatttaatattttccgacaccggaattaaacattttagcattttactaaaaatgagtttataacgatgtttattcatagttaatctcctttttcttaaaagttcacattcatattgaaatagagaactcccttacgatttttattgttaatatctaaacgatttaacggttttgaatacgcagtattcagtgaagcatttccgatttgggcttttaaacccaatgtagcaccagaaattacttcttttttatctcctaattttgaataagttcggccgatatcaaatccaacataaggagtaattgacttcacatataacttgttaatatagaaaggtatatttaaagtctgtgaaaaatagcctccattttctccagagctgactccacctttaaaacctcttacggtatattcatctccaatagtaaaatgattcagagaatcacttcttcgtgggccatattgcaatgcagttttagctgtatagttaaactgttgattacctagtgaaaaatatctattccacgtaatactagaagaaaaaactttaacgaatttctcttcattgtttttactatacgcattcttctcgcctctaaaccaaccaataccttgtagataattcagatccgaataaagttttcctccaaataaattcgtggtataggaaagtccaaatgtaagtgttgaatatcgatggtcaccgattctacgtccaattaaactgcttttacgttgcttgtattcatactggctatatcccgtaaaaatatattctttagaacgagaaaataagcgagataatttgataccgtgagtataggtttgcccatccgaatcgtagctgttaaaaataccttgaatacgtttatcataatcagaagctgagcttttaagttctaacgtatagaaacctaatggttggctgtaacttaaagaataattctttaatgaattatgttttctatccttgtataaacgataagaaccggagaagctccatgtttcgtttagtccaagtaaatcgctatatgtaagcgatgatgagatttgattgcgtccatttgcattattttctgcacctgaattattaaatcccagtgagaaactcggcaatgctgttcgggcaagtaaaacatttagatttgaataaccgtcctgttcatcggctaaaatacttattttggcgtgtttattattttgattaaggacttcgaccatttgatcgatatgatggatattaatgcgtttatctttgatacttggcaaagtcagtaacatcgccttatctttccagtaagtcggttcttccccattaactagaaacctattcccaaagccccagttaatcagtaatgaaagtttgccttggctaatatcaggatctttaatactaatagcacttgtcacatatcctttttggtaaagctcaccggttaattcgcgaataaggtcaaaaatatgaccgcttgtaagttcctgattttgatattttgtaagaatcggctcaaaattcaaatcattaggtttaccggcaaaatcaatgtcaacctgtttaataagaaaagccggcccagttgctggagctaatatatcagttgatactttctgcggttcgtcttccgaattaagaaaatgattagctttctcaagttgagaacgaatttgttgttcctgaagtctatgctgttctcttctttcttctgtaagtgatttatcttctacaagaatattttcttccattgcatatgtaatgctcggaataaaaaaagagttcactaataggcttgcaagtgtaaaatgctttatctgtttcatatgtgcaaatatccattattattcttatctaaaacttacactaactgaagattaacgtaaattaaattcaatatgtttatttgtgacacactttcagatgattaattacaccacttttgtaaattactgttatttttacaaatcaagaaaacagtaaacgtttgccaaaaaaaagcccataagttaaatcataacttatgggcttggtttaatcagttggaaccagcttaccagtgataacgataagcaagttgtactttatatggttgatctaagtatttgccattggctagggaagcctctaaaccgatacgatgattgcctaccaccgcattcgcaccgatagtgctttcaattcgacctttggtctccgctacatcaaaactatattgatttactcgcactgcattctgattggtacgagtggtaatgccgtttagttctgcataaggttcaagcttccaaccggcaaaatcaagatggtttgtgactcgcacgcctgctcttgcagttaacgcggaaatgccgtcttcatccgctttgcttgaaagtttcgtccaagcggcttgtaactgtggcgtaattgtccaacgacctaatgtatgaatacgtccgatttcgctcgaaagcgtatgcgcattgtaatggcgtttaccagtctgattagattttgccgtaatacgctcgtattttgcgacattatcccaatagaaaccattattcgccaaataggtcgcatatgcacccacggcttgtgctttcactttcgccgagccatattcaccaccaaattctagatctgaacgtgaatttccgacaaaaccaccgacacgaatattatctgttaccgcagcatccgtaccaatttgaagcgtatgaatatcttgtttaaagccggatgaatgcgcattttccgcaacctgcatagcatctaattcattacgactatttgcattacgcacccaaacattgcctttttcaccttgctttaattcacctaagcgcttatgtaaaccttctaagctattttccactaataaaagctgagcctgacgtaatgagactaacgcattcgaatattcacttagcatcacttcatggtttgctgttgtcggatttaacgctggcacaacaaccggagaaaccggcacggttggagaagcggtcgaatttgtcgaattatttacagccggcggtgtactgttacttgcagttgtgcgttctgcggcattatttgacagaagccaatgattaccgtcttttactaggcggtaacgatatgcgccggcatcaacataatcacgccctaataaagcaaatttcgccttacctgtttgggtttcaactaatgttaccttaccattcgccgattttggttcattacccgagtctttaacatttaagccaaattctccgctatcgtctccggttaccacaattttatccgcttgttgattagctaaatctgaattgagagtaaagctacctgtaccagacaaattaccaatcgtaaatgtttggaagccctctgctttaccgaggtttatcgtactgtttgttaaactcaaattactcactgagctttcataagttgttccatctatagcaacaacaggaacatcccagttagaatttgccagggtaacgttgtaagttgtgttgttatttgggataaccattgcgccaccaagagttgaatccgttgcttggagatcaatattctcaatcgctgttaaaccaaaatcatcttcactatccgccccccaagcaagtacatctgaggtcacggtcgtattatttaacgttagcttcaaactaccgtactcagtacctgctcgtccattccaccatgaaccgagcatagttccgctgctcattgtcgaattattgaccgtcaccgtgttattcgtaccggaaaatgaaatggcatcagcctctgaacctgctgtaagcttactgccttcaattgtgagagatgacttttcaacaagaaccgctgaatccccacctagtgtggtgagattactgttcgttattgaaccgctagaactatcaagactaaccgttccccctacctcagcttgagttaataaatcactattggaaatatttattacagatttgtttctagcttgaataacatgctgtccataatcattcgatgccgtgaccgataaagtactgttattaacgttaacggttgaattgtctgtatagagaatggttgaaaaagtaggagaatcgaattcggaagcaggtgatactgagcgaccgagcgtactatcgctaatggttaatgtagagtttgtcacaatgggtgtatagccgcttaaatccatcttacattgatttaaaaccgcattagattgacctgtaatagaatctagttccgtcttacattccatcgccatcgcactgtctgtataaacgaatagcccacctgcaaataatgctgaatacacagctgataattttaatcttttcattcctaatatccttttatgttattaaaaccgctaacaagcggtcattttttcctaattttttgcaaaagcaaaaagacaaaaagcccacttcttacgaagtaggctctttataatatttaattaaccttgcgatgaaatacgtttcatatctgtcatataaccacgtaactcttgaccgattaattcaaccggatggttacggattgcatcgttgatatcacgtaagtaaacgttgtcgatttcagcagccggtgtcggttcacctaagtcacctttttgtaacatcgggattaatttctctgcaagaattggcgttgcaacatgagagaataagtagttaccgtattctgccgtatccgaaattaccacgttcatttcgtataaacgtttacgagcgatcgtatttgcgattaacggtaattcgtgtaatgactcatagtatgcagattcttcgtagataccacttgcaaccattgcatcgaatgccatttctacacccgctttcaccattgcaaccattacaacaccgttatcaaagtattcttgttcagaaattttgatgccgtctgcttttggtgaattttcgaatgcggttttaccggtttcttcacgccatttgaataagtttgcgtcaccgtttgcccagtcagccatcatggttgatgagaattcaccgctgatgatgtcatccatatgttttaagtaaaggtcatttaattgaactttgatttcttcacttaattcaaaagcacggatcttcgcagcgtttgataaacggtccatcattaaggtgataccgccttgttttaacgcttcggtaatcgtttcccaaccatattggattaatttgcttgcgtatgccggatctttaccgtctgccactaatttgtcgtaacatacgattgaacctgcttgtaacataccgcaaaggattgtttgctcgcccattaagtcagatttaacttctgctacgaatgaagattctaatacgcctgcacggtcaccaccggttgctgatgcccacgctttcgcaattgccataccttcgcctttcgggtcattttcagggtgaactgcgataagtgtcggtacaccgaaaccacgtttatattcttcacgtacttccgtacccggacattttggcgctgtcattacaaccgtaatgtctttacgaatttgctcaccttcttcaacaatgttgaaaccgtgtgagtaaccgaatgcagaaccttgtttcattaacggaacaacatctgcaaccacttttgagtgttgtttatccggcgttaagttgatcactaagtcagcggttggaattaattcttggtatgtgccgactttgaaaccgttttcggttgcacgagtaaatgacgcacgtttttcagcaatcgcttctgcacgtaacgcatagctaatgtctaaaccagaatcacgcatatttaaaccttggtttaaaccttgcgcaccacaacctacgataacgatttttttgccttttaagaaattgcagccgtctgcgaattcgctacgatccataaaacggcaacgaccgagttggtctaatttttgacgtaagtttaatgtgttgaaatagttagccattttgtgcttccttatttatatgtatgatgttgagtgtgttgttttatgatgttgtgtttacacattgttatgttttatgcaatcgattatacggactttttatattgcgtaaattgatattattgcgacattaaattgcaaaaattgcaacgtaatttattgataaaaaatgaccgcttgcaatacaggtcataaagtagaaaatagcactcctaaaaaataggaaaatagatgaaaataaataagataactttacagcaatgcccggaatgtgaaacggtggtagaagtgccgcaagatctgccgtttcaaatatccgtttgtcccaattgccacgacgtactacgcccggcgaatagttggagcttacgccgttgttcaattatcgccttagcgattttaattttattaccctttgcactcacttttccgttaatgagtatcgacttactcggtgtgccgattcacgcaaccgtatggggcggggtttggaaaatggcgactgaaggctatccttacactgcatttatggtcttgctctgttctgtcgtgtttccgatttcgtttgcaatgttagtgctgacaatcaggctccaaaaattactgggacatcgccctcgttacaccttgattttgctatctcgcattcaagaatgggtaatgttagacgtttatctggtcgcattagccgtagcggcgtttaaaattcgtgattatgcggatctcagctttagtattcatcttagtgcttttgtgatcgtgacgattttaaccaccttgctgtttattaaaatcgatccgaaagaagcttgggcatatttctatcccgaataccacctgcttccgaaaggctatccaactcatccttcgttatgcccaacgtgcgaatatacgttcgatgaaaagattgtcgatttaaaaggtcgccagcgttgccctcgctgcgaaagcaacttagccattccggatagcataaaattacaacgagtgtgggcgtgtttattagcgggtgtagtgatgatgattccggcaaatacgttgccaatttccgcaaccggattagccggttcggtttctgccgataccttattttcaggggtactcacctttatcagtatgggcagctacagtgtggcggcgatcgtatttattgcaagtattgccgtgccattcagtaaagtggcgataattttatatctgctgttagcgattcattacaaatggaaacacccgattcactggcaaatgaaagcgctacattacgtgcattttgtcggacgttggtcaatgctggatttatttgtattggcgttaatgatgtccctcttggaacgaggacaaattctcagcttttcggtcggtgatgcggcatttttctttggggcggcagtattcctcactatgattgcctcaagtaatctggacgccagaatgctatggcgaatccactattccaacgagaaaaaacgctaaagacaagcggttaaatttggcgaaaaatttgcaaatttcagccaaaatttgaccgcttatttttatttgtacgctttcctatttatacgttttgatctattatgcacccgtctcattcatcctgagtgaaatataacaagtttgtttattttaaggatctctcatgaaaaaactgctattagccaccttgctggcaagttcgactgcattcgctgaccaagtcccaagttataacaccaccactcatacttacgaatttaatcaaagttacgatcttgttgtgccgcaaggttcaaaaggcgaaactaatttatgggtgccgttaccgttcagtaatgattaccaagatgtcaaatcgattgaatttgaaggcaactacaataaagcctatatcacggaaaacaaccaatatggtgcgaaaacactattcgcaaattgggatgaaaaagcgcaaaaacgtttgttaaaagtaaaacttgtggtgcaaaccaaagatcgtgaaccaatggcaaccggtgcattaaacagttatcaaccgccggaaaaaatcatttattcggtggatgtacaagagtatctcaaaccgactacgcatatcaaaacagacggaattgtgaagcaatatgcggacaaaattgtcggcaaagaaaccaacccgctgaaaaaagctgagctgattcataaatggattgtggaaaatatggaacgtgataattccgtattaggctgcggtgacggtgatgtggaaaaaatgctgactaccggtgtgttaaaaggcaaatgtaccgatattaactcggtgttcgttgctttagcacgagcgtctgatattccggcacgtgaagtattcggcatccgtttaggctcggcaccgaaaatgtcgaaattctctaaaaccgccttcggtagcgcaaaagacggtatcgctaatgaaaatagcggacaacattgccgtgccgaattttatttagccggtttcggttgggtgccggttgattcagcggacgtggcgaaaatgcgtttaaccgagaaaaaagcggtcaatgatgcggatacacaagccgtttcgaaatacttatttggtaactgggaagcaaactggatgggctttaaccacgcacgtgatttcgacttatacccgcaaccggaattaaccccgattaacaatttcggttatccgtatgctgaggttggcggcgatccgcttaattcatttgatgcaaaagagtttggttatgagcttatctcaaaagaactcaaataagcacttttttgcctcacttaccgcagctctagtggcggcggtaagctcaacggtatgctgtattgcacctttggtttatctggtgttcggtatttcttcaccgtggctggttagtctcagcgagtatgaatatttacaactaccgttattattcgtttcgcttggtgcattcggttacggcttttggttactgatgttttctaacaaaattatttgtaccaaatattgttcacaccgcaccttgataattttatattggattgcttttgcgattattctatttttcttgagctatccgtttgttttaccttggttattagcatgaaaaaattactgtttattttgcttttttctgtcggagtttcaccgcttgtttatgccaatgaagctatgccaaacggcaatgtagcagctgaacaacaagcacaaaaagaagtgaatttttatattaaagaaatgaactgccaattatgcgtctatttggttaataaagaattgcgtgtgattaatggggtgatttcaaccaaagcgaatatgaaagaacgtaaagtcaaaattatcgcgaacgaaaatgtttcgctagaacagatggtcaaggcgattgaaaagctcggttatactgccgaacaaatctaaaaaaacaagcggtcaaatttcctcaattttttgcaaaaaatctaagaaattcgaccgcttttccatgtttttctatttcatacaatacttctttgcctacttatcccaagtagataaagaatcatttaaatgcgtttaatcacgctttttccatgactcatttcatagaaactgtgtgcgccgtgatacccccccataccgctatcacccacaccgccaaaaggcaagccggcgtgtgttacatgcataaaggtatcattaatacagccgccaccgaatgacacttcatttaatacttgctcttccgttgctttgtcttgcgtgaataaatacagcgccaacggtttagcatttgctttcacttgagcaatcgcttcattcatcgttttaaaagtcaacatcgggaaaatagaaccgaagatttcttcttgcattaccgggctttgccaattcacttcatcgatcaaagtaaacgccagtttgctggtttcatcgttatattctccgccgactaacactcgtccgtcatttaaaaacgcttttaaacgttgataatgacgaggggtaactactttaacatgatccgctatctcggtcggatttttaccctgatagatcgcattgatacgctgtctgatctcctcaactaaacgatcttttacgttctcttgcaccaataaatagtccggcgcaatacaagtttgtccgctattaaacaccttgccgaataaaatacgttccgctgctaatttcagatctgctgtttcatccacgatacaagggcttttcccgcctaattccagcgttaccggcgttaaatgttttgccgccgccgccatcacgattttcccaaccggcacactaccggtaaagaaaatatagtcgaatttctcggtcaatagctgttggtttaccgcaacatcgccttccactacggtgaagtaattcggttcgaagtattccgcaactaatttagccaaaagtgctgaagaatgtacggtaaattccgaaggttttaggataatcgtattacctgccgccatcgcaccgataatcggcgaaatcgaaagctgtattgggtaattccacggtgaaatatttaaaaacacaccatacggctcataaataatttgtgcgtccacttttgcgcccatcaccatttcagtaatttctgactgccctgccgattttggtttcgccaactcatccaagttttctaacataaaatcgatctcatgcacgagcatatcgatttcggttaaacgggcttccgattccggtttatttaggtcgttaaaaagcgccgttaaaattgcctgatcattttcaattaacatcgcttttaagcgctgtaattgcgctttgcgaaacgctaacggcttggttgcgttactattaaaaaaatctcgttgcgcttgcacgagatttgcaatttgttgttgattcatttttattccctccctattggttacggatggctacattatagaaatctgctaattttagtgttagcataaaccaccaaagtttttgcacaattctataaaaatgaaattactcgaaaaagttaaaccattaattgaccctcaaaaatttcatcatacttttgaaacattgctgcctgattttcatatttttcacaccaataaaaccggcggagatgtaattcaaattgaaaaatccggcttctcagtcgtattgcaaggttcaaaagaagtgcaaatcggtgaatatcattaccaatatcgggcaggtgattttgcttgctatgcggtagatatgcctattctcgcgcattatcaggcaacaccagaacagccttatattgatttacgcttttacctgccgccggagcaacttcagcaattaaccgaagctttacttagccaagattatgcttttccttctttttcgggcaaaaaaccgctcagtcagctctctcctgctttggaagacgctttatgccgtttaattgatttacacaattcaccaaatgacataccgattctctatccgttattacaacaagaaatcatctatcgtttactgtgtagtgaacagggaggattattacgaaaaattgcgacccaaggctcaaatacccagcgagtagcaagtgcggttgaatggctgaatcagcattataaccagccgtttaatgtagaagaattaagtacgagcatcggtatgtccagttccggtttttatgcacattttcgccagcttacgggtatgagcccgttgcaatatcaaaagaatctgcgcttagcacaagcacatcgcttactgaaaaccggtacgaagaccatttctgaaattgcctatcaggtaggttatgacagcctaccgcaattcagccgtgaatataaacgagcattcggcaaaaccgcgagagaaagccttaaggcaggctaatacaagcggtcgaatttactgatttttttgcaaatcgctaaaagaaaacccggccaaagccgggttttctgattagagacgttagaaactataattcaaacttgccgatacctcacggttacgctcattaccgaaacgtttcttaaagtctgtttgtagagagacatttggtatcatctgccattgtaaacgagtatgactttccgcatgcggttgacttaaagcagtgaacgcagtctcattgatgttcaacttcgctttttccgtaggcttataataatcgacactggtactaaaggtgacattatttgtccctacactcaacgtgataccggtccctacctcttgagaaagccctgttgaagacaactgatttccgtgcatatcacgatgagcagccatacgattactctctaagttatacataacttttggcattaaccctaattcaaagtcttgtttatcccacataataaaacgatagcccaaagcggtatttaccgaaatacctttactatgatagtcgtctcggaatccctcacttttcacttggtgcttatcccaatgataaacggcactactactaaattgaacgccttcatcttgagcatattgtgcaaaaaacccagcatttaatacggtagattttccggtcgatttataaacggtataagttgggtcaaccgataacgtttgtttctctgcccctaataacacaccggtacgccaatttcgcgcagtaaatagattcgcaccgatattaatacctgttgaattagatttcacctcaagttgttgacttgcttcaacattggattttgcttgttcaccgaaagcactcaaccaaacactttgaccgttattattctccataaactcgttcagtttatgtttaggatctagttgtgctaagtatgcgccaacttcggaacgtaaaatacgttgtgtcggctccggctgcataaccggcaattctgccgtagctttttccgctacagtcacgctatcccctttagcttgggtagccggtgttgcagctgtcggtttatctgctgtaacactcgtacctttcgactgaataaccggagtggtggcagtctgcttatccgctgtgacacttgtgcctttcgactgaacgattggcattgctgtttgatctgccgttacgctcaaaccttttgattgaatagcggctgaagctgtcgccgttggtttaagcactgtaactcccgaacctttagactgaacaaccggtgttgccgctatcggtttatctactgtaactcctgtgcctttcgactgaataaccggtgtcgctgctgtcggtttatctgctgtaacccctgtgcctttcgactgaataaccggtgttgcagctgtcgatttatccgccgtaacacctgtgcctttcgactgaataaccggtgttgccgctgtcggcttatctgctgtaacccctgtgcctttcgactgaacaatcggtgttgccgctgtcggtttatctgctgtaacccctgtgcctttcgactgaagaagcggagttgctgccattggtttatttgctattacacctgcgccgttctgtttagggatcacgctggttaacaaccaattagcctcgctgccttgcatttgttttaataaaacatactcaaatgcaccggcggtataacgctgatctaaattaaactgcgcctcagactgacctttaatattaattaagttgatcccaactggcgtcaaagcccctttcccgttgaaattacgtactgagagagttgattgccccttagcatcaccgttaatcattaatttatcagtcgccgaattgtcgtcatataatgtggtatcaaacactagacggctacctcgttcgcccacatagttaccaccaacacgtaatctatcttcaacagacgtacccgtttggctattcaaataaaccaagcctttatttacaagatttccagcaatttcgaccgcttgttgtgccatataaaacacgccttgcggattcacttgtaatgttccggcaagattcttggttgcaagcgagcctgtatcaatcgtcgttaaaccggtgtatgacatatcttgcttaaatgtcgcagccgccgaacctgtttttaataggtttccggcgccaatcaaattaaaattaacttgctcagtactattgaaatctaattgtaatgtggcgtctttttgtgccgaaatcgattttgcatttgcaactgtcgctgtattcgctaatgctaatgtgccgttctccactcgataatcaccgctgaaggtattattcgtattagcaaaacgtaatactcctgcaccggctttcacgaatgtacctgctccgctacgtttcgggtcaagcgtgatttgttcatcttttgcaagatcaaaaataaattcgcccgcttgtgcattcaattccgaagccagtacaggcattgcttgagcgccacgtaatgtcagcttaccgcttgccgatgtttggttaattgaaccagtaaaatctctgttgtcaccggcaagaatcaatgatttattttgcgaatgcacaaagccatgatttctcgcattggtattttgagtaaagccggcattcactatttgtccgtctacgccatcaatttcaagtaacttatgcgctaagctaaatttgccgtagaacttactgatatctccggttaatgcaattggaatatgccccgcaatttgcgtcaccgcatttttctcaccggcaagattgccgctgaaagtcaccttcgtaccaaagccaccgttgctattacgtaaactgctgttgccaatgaaagtaatattgttattgaaattacttgctccgccaccaccgttccatgcccagtgagatacgccgattgagctattatttaaaatcacctctttcttcgccgtaccttttgcatttgaataatcacgcaaatccaatactgaaccattggttaattcaagtgtaccttgagcatcaaagaagccggctgcttgactatttgccgaggcacttgctgcatttaatactaatttacccgcggttttactactatcaacgactttgctatttaagactaaatccgcattttgtaacgtaagcgtgttgccgttaaagtcaaaatttttcacatagaacgagcgttcttttttcgctgcgcttgcagtttttgcaacatcattgaaatcaattaactgattgtttttagctaacgttaagctatttaatgttgcaatccccttaacagttgaaagcaatgacgtacgagagccattcgtattcaatacgacattacccgcagattgagcaccggtatttaagatcgcatcattattaaccgtaatctgagtatcagctccaaccgcttgtgcgtgctcaaggcttaacattccttggttaatatccacattcgttaaatccgatccatttgtcgctaggcgtaaattgccctctccggctttaactaaatgaagcttaccgctcagtgccgccgaaagcgttttagtaagatgttcaaacgaaccgaatggtgcgactttttcaccagatgtagtcgtaagttctagcttacgaacagtatctgtcgtatttttaatcgccgcagaagcatcattctgccctaactcaacgctagtgtttgcatttaacttaagcaaaccgtttcttaacagatttaatgtattgcctgtacctaatgctgcatcatgagtgatatttaaagtgatatcgcctatcgctttatcacgatgaccttgaacggtaatattgcctttaaaatcatttgcttgcgttaaagtaatttcaccgccccaatagccttgcccatcaacagtcagattctgattgccactgagctttgtatctaacactaactcaccttcaccgccaaagcgataaccgcttttagttgcatccagcttcgtgagggtaactttctctccttctttaacaccaatagctacacgctcataattggctaaaggagttaaatcactcttctgattaactaacaataccccttcggtttcattaccttggctgatatttttcatcaggttcgcatttgccattgcggcatagcctaatgaaatacgtgcgcgacctaatgaatcttcgaattgcgtatctaactcaacattaccgaccgttaccgtaccgttaaaatctgggttgtgcgaagcaataaccactttacctgtttgttttgcattaccaatcgccaatgatgcatcttgtttcagattacctaaaaccgttaccgtaccctttgcaccacctaagcgaagctgatcattgttgagcgttttattagtttcaccgagttcaagagtggttgttgagcctaaatataaattcggtttcgcattaaaggcactaatgtaatcggctaacttacccgaaaatgccaatacaccccgcgtatcgttagcaatcacatttaaaatctcactgaccttattagtattgcccattgcatttagcacaccagcttccgacattggccaaacacctgcagtgttacctaaacttttaatatcggcaacatctgcttgcccttcttcaatacgtgcttgattaaagctatttttgccgtttaatgccgctgtacctttgccatatttagtaaaagtacctccagtaacatcagcgttaattgtggtggtaaagtctttctctacttctgacgtcagttgagcgccttgagctagagttactgtaccgtttagtaccgcaccttcttgtaaaccttgttgtggctgtttaggatctaaactgccaactacggtatctaccgctaaaatggcattgttttgtacattgaatgcagcttccgctttcgctttgcgcgcaacggtaaatttcgtgccatccgctatctcaactttaccagctttaaagctagccgattgaaagtccgtatcatcaacataatttgctgcgtgcggtgtatagtaatttccaagcacaatttgaccacttgttagattaaaattgcccttaatctccgaattaccttttaaacgccattccgaattttttgttttcggtgcgtacgtcacatttagcgtaccaccatttttatcgttaaacgcacctaagaaagtacgcgtgccgttgtgcggcgcaaagctgaaggtgcttgctttattcgcattattattggtaatggtcgcaccggtatccaaatggtaaatatcattccattccggagaagtcccgtttaaatctaaaataccaccacgtgtaccaaaggcaaatccaaccgtattcgtttgatctttatcttgcgtaatttttaactggttcttatcttttaacaccaccgttccacgtccggaagctaaacgaatatgacttgccgcataaccgttttggcgctcaagataagtagtaccgtcaccgatatttaattccgcttcattattgctactgccttgtacacggaacgtaccttcaccgatttttcgccacgtatcaccggcttgaccagtcaacgtactggtgagagttgcacctttatttacaatataaccggcactgtttaagcgcccgttaccgccaaggataaagttttgattaaaggttagcgagccggcacccatattaatatcagcaccgtcagtcacattgatcgtaccgccttggccgccaaaaataagatctttactttttgcccaaatcgcttgtgtttccgcatcggtcgctttttccggtactgttgctaaactgtgataagtcacttctttaccatcaacggttaatttaccctcgcccgttgtcgtatcttgcttttgccaagtaatagatgaagttgtgcttgtggtgttaatcggtgcatcaatgtaacttgcaatgcgtttttccgtccattccggtgccgagcgcagataagaatcttttgcgtaaccctcaccaccgccaccggcttggtttgcagcgatcagccaccatttttgctttgcttcatcccaccaataaacaggactaccactgtctccacctttagtaccaatatctaatgctgttttagcagcattagtgatcgccaaggtataagtcattcgttcgccataaattgaatgccaaagaatttggtttaaaccgcctgaaagccagccgtaacagccgtccgcttcaccacaaccggcagctgcggtagagccgtcaacggctttaacttgcaccccaccaccggcacgagccaatagcgcaccacgtcctaatgcttttccaagtaatgctttagtttcactgcttgacaacatttctgtcggggcaacttccgtcaccacagaacgataacgggtaaatttatagtcgaaccccggcgtctcgttatccactgcacgttttgtcgtttcacctaacttatagtaattttcgtttttatcggagccattaaataaagtaccgtcattatgaatataaaaacggcgagcccaagtcagattatccgtataaggaacgtgagcaacagagatcccgtagcttggattgaaaacggtagaataaccgccgttataggaagtcattttgccggtatcgctatcattggttgcactaaaatcgggcatatgtgccaccgtaccggaaagggttccgtccgttttatatacaggaacattagttgcccccggttggaacacaccacggttttccgcaaaatcacgataagtttgcacatcaatatcatggcgcattacgccggcatttatgccttgagaggcaagtgtagataagaccaaaatggaaatttttgatttcctaaatttagattgaataagttgcattagacttctcttgtaattgtaattgatgaacaatttcagtacgtttttcatacacaaattgttagcaaattgtaatatttctaatatatgaaagctattcacctgtttagcaagtcaacaaaaaaagcactcataaaactgagttttacaacaaaatctactttatttataaagagttacatcatccttaaagccaacataaagtactgtaaataaaatgttattttcagataaaacaacaagcggtcaaaattcgcaaaatttttacgaaatttgaccgcttgttaaatggacgtatatataaaattagtatttaagcgtttcgccttcagttggcactgcaacttgttttaagccttttgctttcacaaattcacgcatatctttagtgcttaccgttgcatggtttacagcgtccatatgcacagtgatgatgtctgcttttggtgcaactttacgcattttcgctacatcttcggtactcataataatcccaccttttggctcgatcatacgagcatcgcctgtgttcatcacgatcacttcaggtttgaaatctgcaattgcattgtccacagattgattccaaatcgtgtcgcccacaacataagtagttttctcgccttttgcttccatcacaaagcccatcgcatcacctaacatttccgctaacattgggtttgcgtacattgcgtctgtaccgtgctgaccgcctttaacacgtgttaatttcacgccgttaaattcagtgtggttgcccactacacgcacatctttaaaaccttgaccacgaatgatttttgcatcgtccgcattttgtacgaaaatcggtaaatcttttggtaatttctcttgtgccgctttatcccagtgatcatcgtgagtatgagtaacgattaccgcttgcacacctttaatcacatcttccgctgattgtttcatatcaatcaatggattacgtttttcaaagttcactgtgccagcaaaaccttcataagcacctttcgttgctaaatatggatcaactaagaatgttgtgcctgcgtaattgattttcgctgttgcgttacgaacgtgttgatattccattgctgatgctgagtttgctactaataaacctaatgttaatgctgataaagttgctttaagtttcatattgtatcctttgtaaaatttttccgaaaaacgaccgcttgttgcggtgtggggatattatgcagatttccccaaaacaaaaacattgacttatttgccacaaaacaaaagattcgggtcaagtttaattgggggataaaatggctaaaatccaccgcacttttgatttcatttataaatgaaacttttggcaatttcttaaaaagtttaaagtataattgaaaccttttaaaattatcactatagtatcaattataaattaagggagagttatgaaaaaagatttagtctatcgtaaaaaatatctagaaaaagttcgtccatttatcggtaaaagcttaattaaagtcttcaccgggcaacgccgtgttggcaaaagctacttactgtttcagattatgcaagagatccaagctgaggatagaaacgcccacatcatttatatcaataaagaagatctcgcttttagccacatcacaaatgccgaaacgctaaattcatttgttcaggaacagaaaaagtgcggtcagaaaaattatatttttattgatgaaatccaagaaatcacagattttgaccaagcattacgttcactcctgcttgatgacgaactagatttatattgcacaggtagtaatgctcacttgctgtcacgagatattgcaggggcattaagcggacgggcgatagaaattaacgtacatccgctttcttattttgaatttttagaatttatgcagttagaagacagcgataaagccatgtcgctttttttaaaatatggcggtttgccttatttgaaagatttgccgttgcaagacaacatcgtgtttgaatacttacgaaacatttattccaccatcgcaattcgagatattgtaaatcgttattcattacgcaatgtgcaatttttggaacaactgacgcaatttttagccagtaatatcggtaacttgttttccgcaaaaaaaatctcggacttcttaaaatcacaaaaaattaccacttccaccacacaggtgcaaaactacgccgaataccttgccaatgcctttttaatccacaaagtgccacgctatgacattgaaggaaaacgtatttttgagattggtgaaaaatactattttgaagatttggggcttcgtaatgcgctgattggttaccgagtgcaagaccgaggaaagttactggaaaacaccattttcaatcatctcaaaatcgcaggctatgacgtaaaaatcggcggattaaacagccaagaaattgattttgtcgcagaaaaaaatggtgaacgcatttacgtacaagctacactcacaatcaacgaagaaaaaacactggaacgagaatttggtaacttgctgaaaatccaagacaactatccgaaatatgtggttacaatggatgaatttgagggaaatacgtttgagggggtacagtgtttgagtttgaggaagtttttgaagggtgttttcgtaaaaaattaaaaagtgaacactgcttatgtattacttttcaatcagtctaattattagctaaggaatttaatatgtctattcgcatgactaaatttaatcaagaaattctttctttgtgggaagaaatagaagaatcggtgggtgaaattaatgccgctggattatcaacagaagatagagatgaaattgctcgcttcaaaaaagtagttacttatatttctgagatgttaaaagcagttgatcctgattttgttcctatgtctgtattgaataaaacaaagacgcctatctcaaccattaaatctaacttaactcgttatttaaaaacaaataatattacttatataaagagcattaatgacgatcctttagatactatactaagggatttgatgccttttatattttataaaggagaagcagcagcggcactacagaatgcattaaatcaatactcagaaacaattttagaacatgctcaatcatatttagctaatgctaaatcttcagctcaagaagccgaaatcctatcccaagatgttagaacaattgtcagtgatttatctaaaaaacgagagcaattttctgaatatagtgaacaactctttgaaaaagatggagtgaaatcaaaaatatcttcattagttaattattttgaagagaaaaactctcaactaacaaaatttcatcaagagatttttgatcctaaagatggtattaaagaacaaattaagaattacctttcagatggaaaatctcagaatacagaattacattcgctaaaatcaaattcttcgcatattttagatgagcttagcgaattttatattcaaattttcggcaagaaaaatgaagatggagattttgaggggggactaaaaaatgaattagaaataagaaaaaacgaactagatgagttcaaacgccaacaacaagaacgttatcaagaacttaatactcaaatagaaaaccttttacctggcgcaacgtctgctggtttatctagtgcttatcatgaaatgtatgaaaaattcaataacgaagtaaaggattatggaaaatggttctattgggctttagggattctttttatagttattattgcagtaacttgtatacataataaatcaaatgagattaatatacttaatcaagttactacttcctttacaactcaaaataatgaaagtaatgagcccaaagatagttctgaaactagcaataaaacaaaaactgaattagcacataatgaaagtaaagtagataataatcagacttctaatgttaaagaagtttccttatctaatagaataatggcaattttagatagtttaatttataaactgccttttgttcttcctgcactttggttagttctatttgtttcaagaagacgaaatgaagcacagcgcttagcgcaggagtatgcacataaagaagcattagctaagtcatacgatagctataaacagcaaatagaaaaattatctgaagaaaatagaaatgagcttttaccaaaacttatggataatatgctaaaagctattgctctaaatcctgcagaaactttagacaaaaatcataaagaaccaactccaattgaagaagttcttaaaaagaaagagttctgggattttattgaaaaagtaaaaaatttgatgccgactaaaaaagaatagtgctaaaaatgccgtcagaaaccttatttcaggcggcattcctactttacaagcggtcaaattcccctaaaaacttgcaaaaatccaactgcacttcaaatcttatccatgaaactccgctaattttcccctaccaatcccccttcccttcaaactcttccaccaaaaaatccacaaagctgcggacggtttgggggagttggcggcgggaaggatagacggcgtatacttgataagttggcatttgccaatcgggtagcacaatttgtagttgattgtttttgagctgttgttcaataaaatacttcggcaacattgcgatgccaccgtctgctaaagtgaaattaagtaatgcgcctgtgtcgttgatggtgagttggctggttagttccagcacggtttcttgcccatctttgataaatgtccactcttttcggtttacatttgcgtgtgctaaatagcgatgattagctaattcttgcggtgagtgaatggtgccgtgctgagctaaataggcaggcgttgccactaataaagaatggcaagtgaataatgggcgagccacaacatttggatcgggattgttagtaaaacggacggcaagatcgatcccctcttcaactaaatttactgtgttatccgccaaaatcagttgaatattcagcttcggatgtttggctaaaaaagtgcgaatcgcattgagcaaatgggtgctaccaaatgctgcattcgaggcaattttcaacgagcctcgtaattcaccttgtttagctaaaaaatcttgttcaatagctgaggttaattccgtcatttttttgcaatattcgaccgcttgttcgcctgcatcggtcagtgaaacgtggcgagtggtgcgttgcaaaagccgagcgttaaaccattcttccataagggcgactgcacgggtaactttcggacgtgaaagatccaatcgttctgccgttgcagtaaaactgccggtttccgccaccattaaaaacacttgaattgcggtaattctatccattttttaccctttattgtttcaatttttaaaacaattatattcagaaaccagtctttttcccattttttatttcaatataatggcaacaggttatttgaaactcttcaagcaaaggaaaatcaatatgaaaaaattacttaaaactgcagtaatttcaaccgcacttttagccacaacagcggcaatggcacacaccacaccggagcaaaataagaaaaacgctcttgaattttatgaattagtgttcaacaaacacaaagtacaagaaggcacagacaaatacatcggcaaagaatatttacagcacaacccgaccgtagcggacggtggcaaagcctttgtggacgcatttgcgccgttcttaaaagaacatccgcaatctcgtgctgaaatcaaacgtgtggtggcggaaggtgatttagtgatgttgcacgttcatagcaccttaaatccgcaagataaaggcgaagcggtggtggatattttccgctttgatgaaaacggcaaaatcgtagagcactgggacgtaattcaagccgtaccagaaaaaacggcaagcggtcgttcaatgttctaacacaaatttcaattcacaagcggtcgaaaaaccaaaagttttgcgaccgttttttattgtaaaatatgcagataatacgaaagtgccttagaaacgaacaaaattcaccgcttgatgaaatgttccgctttgaaaaagagatgaaaacaccgtgaaaactgtcgcccttatcctttacccaaatttcagcttatttcattttgccgtgccgcaaatggtattctccgcaacaggattggcaaatgagccgttatttgacttgaaaattgtggcggaacaacctgaaatctcgctttcaggcggctcattagtgcaagccgacagcgatttaagtttgcttgaaaccgctgatattatcattgtccctgcttggaatgattttgctgaaatgccaacagcggcattgcaaacggcgctgcaacaagccaatgctcgtggcgcaatgcttgtcgggttgtgtttaggcgcttatgttttagcctattcgggtttattagatggtaagaaagcggcgacgcattgggcggcagagagcgattttagtcagcgttttccgcaagtgcggttagatttgaatgcgctttatgtgcaagatggcaatgtgatgacatcggcaggcacagcagcagggctggattgttgcttggcgattgtgcgggaaatttatggtgtaaaaacggctaatcatttagctcggctttttgttacaccaccacaccgagaaggtggtcaggcacaatttatcgaacagcccgttccacgcaaaacacctgatgaaaacatcaacgaactgctagacgacattcgcaaaaatctgcaagcggtctattttattgatgaaattgcaaatcgcttgtcaatgagccgcagcacctttactcgtcatttccgcaaagccacggggcaatccttcgcccaatggttgattgacagccgcttgcaaaaagctcgggatttactagaaagcaccactctatctatcgaacaaattgcagaacaaatcggcttccaaagtgcggttagtttccgccaacatttcaaacaacgcttccacgtcagcccaaatgaatggcggaaaatttttggggagtgggggtgaaacagcgtacatattgcctaataagcgacaagaatttctcaacaacaaaaccgttcattactatcgaacactttcgttcattagtaatggacggttttgtgttttaggcataaaatagtgttcattactatcaaacactttcgttcaatagtaatgaacagtttataaggagagtgaaaatgctattaaaaacagaaatagagcaaaccattcaaagtcaaaaaaatcgattactagaacagaaaacttatccacgccaaatgttggataaaataaaaatattacctaattttgctttggttgtttcgggtattcgccgcagcggaaaaagtacgctgctaactcaactgattgaaaaacaaagtgaagatagttatctgtttcttaattttgacacaccacaactattcaattttgaatttaatgactttgcattgttagatgagattatcactgaaaatccacatatccaaacgctatattttgatgaaattcagattatcgaaggttgggaagtctatgtgcgaggcaaacttgatcagggctatcaagttgttgttacaggctcaaatgcatcattactcagccatgaacttggtacaaaattgactggacgacatatcagtaaagagcttttccccttctcatttgtagagttttgcgaatttcttgaaaaagaaaaaaatgccgaagctgtctctgatttcttaactctgggtggatttccacaatacttacaatttaatgaagatgaaattttaaatgctttgattaacgatattttgtatcgagacattgtagtacgctttggcattcgagatgaacgagcaatgaaacgcttacttatgtttttagcaggaaatgttggcaatttaattacggctggaaagctcaaacaaagtcttgaagttaaaagcactgctaccgtgcaagaatatctttcacatttagaacaagcgtatgttattagtttattgccgaagttctcctactcctacaaaacgcaacttgccaaccctcgcaaagcttattttatagataatggtttacagcgagtgattagtccatctttcaatcaagatctcggcagaaagctagaaaatgcgatattttgggaactcagacgccaattttcagaattgtattactacaatgaaaataataaagaatgtgattttgttgtatgcaaaaatagccagcctgtacaactgattcaagtctgctggcaactgaattcagaaaatatcgcacgtgaacgagacggcttactcgatgcaatgaatttctttcattttgataaagggttaattatgacttttgaccaagaagataaactcattgtagaaaataaagtcattgagattttaccgttttggaaggtgtttggaggtgatttatggcattaaaatagtaatatgcatttgtcagttatatagtgacgttcaaatcgtccacatcatctgccccagcgtttgtaaaatttttatcaaatctaaccatgactatcaaatatttctcggatcaaaatacataatataggagataatctatgcctaataatgaaatgagaatatacactccaaattttggtagtgataatattgattttttaatttcctatgtaaaattaaaggcgtatttcaaagaagctatccaaataagtttggataattgtactattcaacgtatggaacgtttaaccgaacaagctacattatataatgtaaaagatgttggtttatatccgttatatagattgcttaatgaatgccctaatatagctatagctgcattaggattgaatgaaatgccaagctgttatatccctaatgctcgaaaagcatataatttattttgtaaaaaattctggaaaggacaccaagatgatccattagcaacaaataaaaaaattatttaaaatgaagaaaaatttatcttttcaaatctcaagttagatgaaaagaaagcattaggttctttttatttaccttatttacttatccaacaaatttataaatcagatcctgatatatcaggaattaaaaaatttgaaaagtatttatatggtatttcctattatctagatatgatttccggatttgaaatggaaatcgctaaatatgctttttgggatatagaagaaaaagaaattcataatttaccagaagaaatacgtaatcgcagaaaacgaattaagaataatttttgcaaagaaaaaaacactttggaatcgatacaaacatcagctatgaatgcagcaatggatacatattggattcgatgtataggttttggtacagagaaaaaagaaaaattacctaatggatatactatttcagaacattggctagcaacaaatgatgacaagctttatgttattgctaatgacatcaagcctataaaaacaccgcaaggttttggctatttgcttgaaacagttagagagcctgaattattaaatttttcttattggaatgaagttgatagattggctaaccatttattagaaacgagaaaatttcaacaaaaccattttaacttaaaaatagaaaatattgaaaaatctattttggaaatagaaactgaaataagaaaataccttaatagttaaaatatgccatctgacataccttctcagatggcatattttacaagcaatctattaattaaaatcgactcaactccaattcccctgctgttttttcattcgctttgagataagcagggtgggtttcgatttgttcgaggtaacgggcgatatttggataatccgctttgttcacatagtttaagccccattgtagagggaagcttaatgcaaaatctgcgccagtaagttgttcgccgacaatccattttttgccttctaacgatttttctacgtgattgaaatataaaccaacttgtgcattagtgtattgggcgaagttgcctaaatcgcctttcttcgagactaacgctaacaaattcgctgagaacattgaggctgaaatcgctaaccagtaaacatagttagaataagcatcggttttgtgtgctggggtgaagcggttttcagaatcataacgatcaagtaagtgttggataatcgcattaccttccgctaacactaaatcaccgtcttgtaacactggtgctttgccgagtgggtgttgtgcttttagttctgccggtgcgaagccggtgccttctaagcggtcataaatttttagttcgtagtccaaacctaaggcttcaagtagccatacgatacggtgtgaacaagattgttttagatagtgtaaagtgatcatattttttcctttttatattacaaactttgaatttgtttgattaagcgttctgcgtgttcatcggcttttgcttgcacttgggctaaatcgtcttctgaacttacacctggaatataaagcattccgctgctatgcacaggatcttgccatactaaacctgagaattttgccgtgtcttttaatggggcgagtaagtcatctaaacggtggaacaattcgccattgtaagcctcttctccgccaccaaccgtatatgagaaaatcacttttttaccgtgtaatttgtcgccattggtgccgtaagcaaaaccgtaggcaaacacatcatcaaaatagcgtttgagaatcgctggaatgctgtaccagtgcataggatattggaacaccactacatccgcttgcactaacgccgcttgttcagctgcaacgtcaatatcctgattgccgtaaagccctgctaaatcacgcacttgtacagtggcaatttcattttctaagcgtttgagaatacgtgcattcgctgttgaatgagataagttgctatgacctgaaatcactaatacatttttcatcgttgtgtcctctctgttaatagataaagtgcggttagatttgcaaagtttttagaaaatctcaccgcttattgaacgaaatactatctaaatgctctgtttcggacgctatttacatcactcattcagcattctatgaatagcatctgttcgccccgctttataagcctcagtttgtgggctggtcgggttcatcagttcaaaggcatgatatacgcctgagataacttgtaaatctgttttcacaccagcttgtacaaggcggttggcataatcaagatcttcatttacgaataaatccatatcgccaaccatcatataagtgcgtggtaatccagccagatttttagccgtagcggcagaatagtatggtatttgttgctcgctaatggtttgttcgccttttaatgtttgccagccaatgcggttaaactccgcagtccaaacaaactcgcctgtgttcgggcttttatacaaagaattctctgagcctgtgcggtaatccaacattgggtaaatcagcacttgtcctttcagtttaaattcgcctttatctcgcactttcaaacctaaacgtgccgccaaaccaccacctgcactttcgcccataataatggctttatttgggtcaatattgaatttgtctgcattattcaacacataagataaaccgtgataagcatcatcaatatccgctgggaatggggcttgcgtagctaaacggtattcaagactaaccaccgctacattgttcaaatttgccagttcaagtaatgaggcattattttggcgggcattgccgattaaataaccgccaccgtgaataaaataaaccacaggtagtttggcatttttgccgttatctggacgataaacatataaatctaccgctggctgtttgccttgtgcgggtgcagtaaatttcgcatcaggctgaactttatcttcatttgccgcttttaaaaatgctgcattgatttgatctaaaccttctttgctatgcatcattttaggatcgatttttaccgctgaaagtgccgttaagtcttgatattccgctgcaagcaaatgggcggtacgtggttgctcggctgctgttgcagctattgataataccaatgcaaaggcagtcgcaagatatttaactttcattttttctccataagttttgctatcaatgtgtagggggctatttctctaatttccaaactattcatggaataccacggtttcgctcagtggtgcacgtggttgaatatagctgttggcagtagaattcggttttggtctgccgaaagaaatacctagcactaatttataattatcaggcacattaaattcttggcgaaccacatcaggactataagttaatgcaatttgcggcacgctaccgaaaccgtgcgcggtgagagatagcatgaaattctgtgccaacataccaacatccaatgcagtaaatacgttgtcagtaaaatcaggcataaagaaaaatgcagcgtgcggtgcgccataaaaacgggcattttcttcggcaaaacttttacgtcctgctttgtcttcacgcaaaatattgaatgcgtcatacaaacgtttgtacgaatcacgcatacgatcttcataaacacccgtcaaggcgtgttggtcaaaaataaaatcaggggcgagattaccggtacggaatccgtccaccaacttatcagacaaacgttttaaggcttcaccagatacgatatgcaccacccaaggctgagcatttacctcagaaggcgcacgcattgcatcttttaaaaccgcatccatttcttctttggtgagtggttctggtagatattcacgaatagatttacgagtttgtgtggtagttgaaaaatctaacattctgttgtcctctgcttaaatgaaaagtgcggtcggagttcactcatttctttagcgccgttggcaaagccaatattcaaacatcagcatttatgcaaaatgttgaggaaatttaaccgcttgttgccattatcatatgtaggctaaggaataatcggtatcgcatttctctaaattttatgcctgattctacaaatatttatttcacggtcagatcatagctccaatccagcaactttttcatttcatcaaaatcaaagccctgatcaagcacaatactcagccaatgttttttgttcatatggtaagccggtaaaacatttttatcttgttgcagaatactcaccatctcaggatcgcattttagcgtaacgatatcggagacttcttcacccgctaaacctaaacttttattgggaacagtcatcaacaaagcaaaccacttttgtttggcattttggtggcgtaataccgcaatcgcataagaaggatatttatcgacaaaaagaaattcaggctctacgccgtattgtgttttagcataatgcaaaatcgcttgtcgttgatgcataccaaactccttacgatactattgttcgagatgaaaaaaatgccgcctaaaatttcaggcggcatcttgttaattacaagtcaaaagtttgcatcacattcacgtgtaaacgtacatcgacattgccacgtgttgcgtttgaatatgggcaagttgagtgtgctttttcaattaaagtttttgcttcttctaagctgattccttccacggtaatcgtgatgtcaatttcaaagctgaatgcaccgtccggtttttgaccgatacccacaccaacagttgttgagtgtttagtcggtttaatgcccagtgttggagcaacgtggataatcgcattatcaaagcacgctgcataacccattgcgaaaagttgttcagggttagcaccctctttgccactttcgttttggaaaccaactaaatctaaaccgagtgaaccgtcatctactcgtgtatgaccgtcacgaccgcctactgctgttgctgatgttttgtaaaaaattttcatcacatttctccgtttgttttaagtaaggttgttgctttaaagtgcggtcattttagcgatgattttgcggtaggaggtagctcatttctgcaaaattcttgcctatttctccaatagtagcgaaatacagccgctacatcattgaaacagattaatctcgattaaggggattctgtattttgatactaggctcgctctcgtctgaagccttgcgtaaacagcattttcaataaaatccaccacgcgctgtattgcggtttactcgctttaccttgactgattaacgccatttgatacatataccaccccatttcgatcattgaaccaagtagatcatcaatttttttcacgcctgtgcggattggctttagatctaacgtttgataattgcctgcaaaaatgcgattcggcagattgggcaaaatagcaaatggtttggcaataccaattagatccacttcattactttcaatcgctttttccattacgctttgtgagcggaaaccgcccgtaatgaccagtggcacggtgcagatatggcggacttttttggcgtagtccaaaaagtaggcttctcgctgttgcgtgctttctttcactccttctaacattgttgggctttcgtagttaccgcctgaaatttccactaaatcaatgccttccgcgaccaacttttctaccacttgcactgattcttcctcgctaaacccgcctttttggaaatctgccgagttgagtttgacggcaatgatgaaatcaggtgatgttttggtgcgcattgcacggtagatttctagcaaaaaccgcatacggtttgccaaactgcccccccattggtcttggcgttggttatgcacaggtgaaaggaactgactgatcagatagccgtgggcggcgtgaatttgtacgcccgaaaacccagcttgccccgccacactcgctacaagggcaaaacgttggataagatctaaaatttcgctttcggttaaggctcgtggtgggttaaaaaacttgccaagattacctgataagccaatggcacttggtgcaacaggctccggcgataaatctttgggcgactgtttgccggggtggttgatttgcattagtaaggttgtgccgttttgcgtgccagccctagcccaacgtttgagcattgccaaatcgctgtcgtcttcaatcacgacatcttttgccgaaccgagagccgttttatctatcatcacattaccagtaactaatacgccagctcctccttttgcccaagtctcgtagagttggacgtaatcttcagttgggcgaagtgtaggggtaagttgctcgctcattgcccctttgaacaggcggtttttcagtgttttaccgtttttgagttgaataggtgtatttaaaatggtcattatttttcctttataaaataagttgataggtttaaaaatataaacccaacaatgctaaataaagacggcaatgccgtctgaaattaacgctgttggctcgggcaatagagggcaaatgctgccgatagctgttgcagtttttgcgtagcctctgccattgcaatggcataaaatcgttccttaccaacttgctccaccgacacagcccctgccgctaacatcagttttaaatggtgcgacaccgcagggcgagacaaatgcaatttttcggtaatcgcatttacgttcatcttaccttgctcaagtaacagccgtagaatttggtggcggttttcatctgccaacacactgaaaatcggaatgcactcacgcattaaattcatcgtttcatcagtagtcatcataaatttatgttcataagtttaaaaatttgaacgcattttaaagcaaattgctgatgatcgcaagcggtcaggttttgcaaaaattttgtaaattcgaccacttgcggttaatcatatagacaaaatgccgcctaaaatatcacttcaagacgttttttatcttttatataatatcgattttctatttgtttgtatcaaggaataccaatgaagaaaattaccactttattattgggcttattattgaacacgggctgtttcgcaacccctgtcgttttgcctgtttcaacgtctgttaatcacgaagcgaaactttcttcatctattttattgtggatgcgtactgataaaccacgccaagtgagtatggacagatgggctggaccacacgccaaaattattagtgccaatccaagtttagctgaatatcgtcaattacattttaacgaagtaaatacgggattgtggcctgcgatagaaggcgtgcaaacccagattcctgcggacagaaaaatagacggtgttgccgatgttactttaaaaagctatgaagctattgctcttggcgaaaaatacagccaaatggcacaagccgatgaaatcaatttattttcacgcactctgctatatgctgcttcgcctgataactcaaaatggtaccagcttgatgcacaaccgacacaagcacacgtaatggtatttcttcgtaagcgtgatgaagtcagcgaatcacttttccaacaattcatcaaccaagaacttgccccaagccttgcgaatttaaatgctaacggtttaaccgaacttcgtagccacgtttatggcaaatacaatcaagcccaatgggattcccccaatgtggcacacgacaacccgccagaagcacaatttcaagctgcgttgattttaggttttaaaaaccaccaagcactgaccgccttttttgaaagtgaaaatcttaaaccaatttcgcaacgcctcgctcaattcagtcgtgcagttcacgcttatcagctggaaaaaacgctgctgtttatcagcaatgaaaagcaaactgattgattttttgtggaagaagttggtgggaaggattggtaggacatcagaaaaatgaaatgcgtgggcggtttagcccacgcaagctgcctatttctctaatgttgccttaaagctcgccacagtgctatctgctgcactcgcaaggaaagccgtatctgcaccgagagcgaagaatgatacgccaagatccgcatagtgttttgcttgctctggagtagcggcgattgtgcccacaggtacgcctaattcacgaatacgcttgattgcatattccatttttgccaccacatcagggtgaagaatatttggacctaatcccatatccaccgctaaatccgcagggcctaagaaaatcgcgcctacgcctttagtgcttacgatagcatctaaattttccataccttttagactttcaatttgcaacataatcattgattcatcatcaatgcgttgttggtaatcagggatacgcccaaagcgagatgctcgcactacacctgcgcccatgccacgtttaccttcagccggatatttcgcccaacgaatgatttgtgccgcttcttcgctactttccaccattggcacgatgatattttgaatccctgaatccattaactgcttgaatgtaccagcggttgcttcgccaacacgtaccacaggtgtcatttcataaggagcgatcgctctagctacgtttaaaatggtctgaatgttatgcggaccatgttccgcatcaatgaaaagccagtcataatccgtggtcgcaagcacttccgccacatcggctgaggtggtttctaacgccacgccatactgcattttgcccgcttcgatgttatgttttaggttgttatataaaaaatcttttaccattgccattgtttgctccttatagcatttttgctaaataaacttgttttccgaccgcttggattaagtcgatttgcgacttcgtccagtttaaatcttcttcctcatctttataatattctttgataaggtcgtaagaggtaatatctaaataacccgcatttaaaacgtcttcaatgattggtaagccgtctagtgaggcttttaaatcgtatgctaagaagtcttcaatatcgttgaatatttggcgagcgggaatttcgtcttggcgaatttcgccgtctaaatctaaaatgcgattatggaattgagcaataaaatccaattcggatgtaccgtgttccgcatatttttctgcaagcttggtaaatccttggctagcaaatacacgtgacataatttgatgattaagcgcatttgcagtaagttgtgtagagatatgttgtaaaatttcaatcgttttttgtacgtctttcattttgtttctccttgatcacacgataaattcattgcgtttgaaactgtgattatcttatgatagcttttgttttacaggtatattatttctccaaacaacttgcctaattctacaaatatgcaaattattgataaattattaccgcttgtaccgaaaaaccaagtttggcaaacaccgattgaaggacttgtgattcagcacgccgaccgccctacaccggtggcaaacacaattcttgaacctcgcatttgtattgtgttgcaaggcgagcgaaaaatttgtatcggtgatcaatgtacgctattcagcaatcaacattttatgttctgtccggtaaacgtgccattgtcggtggaagtggtagaagcaagccctgaaaagccctacttgatgatgacgatgaaaatcgatctaaaaatggtggcaagtatcgtgccgcatattccaaaaaccattgcaaaaaatcagccaaaatcgaccgctttcttacaatggcaaatggaagaaaatctattggctcagttcgagcgcctgattgatttgctcaaaacgccggaagatattgattttcttgcgccgcttattcaacaacaaatttactatgttctgctaaaaagcgatcaagggcaaaaattacgagaattggtacaagtaggtagccacacaaatcgaattgctcaaaccgcactttggatcgagcaacatttgtctgagccgttacgagtggacgatttagtaaaacaggcgggaatgtcggtttcaggttttcattcgcattttaaaaaaatgaccaatatgtcaccgttacaatatcaaaaatcgcatcgcctactgaccgcacaaaagcttattcaaaccaagcaaagcaatatcgccaatattgctttccaagtcggttacgaaagtccaagccagtttagccgagaatataaaagacattttggggtaagcccgaaaggggatgcgagctagtgtagctttgttattcagtaacaaacaacaagcggtggtaaaattttaggaatttaccaccgcttgtataacctgattagcgagacttattttacccactcaacgacatcagccattggctggcgagcttttgggaatggctccataccacgataaccaaaagctgccattacactcactttgaataggtttggatcaaacaaaccagcgtccgccagcatcttattcatttcctctacatggaaaccttcgatcggcgtactgtcgataccaatcattgcagcagaagtcatcatatttgctaatgcaatataactttggcgacaagcccaatcgtaaaagcgagtaggattattcgcaatcgcaatatgttcctctgtgaaatctttgtagaaagtattacgtaaatccaccacttcttttggtaaatgatatacatcattcataatatattgggtgtaatcgctaccttgtttcagcgtattttcttggcgaacaaggaacacgacaaaatggctacaatccgttgctttatccgctgcgccccaagcattgtcacgaatcagttcacgaattttacggttttcaatgaccaaaaatttccaaggttcaaaaccaaatgaacttggtgataaacgccctgtttctaaaataaattcaaaatcttccgtactaatttttttagtcggatcatattgtttacatgcgtgacggaaatgaaatgcatctaaaatttcttgtttagaaattgccattaaacttctccttaaaataattcgactacgttaatatcaagtggttggctaagtaaatccgcaaatttttcaaccgcttgcgtaaagtgaacttgttgtgtgtgagtttctaaatccgccattgactgccactgctcaacaaaagcaaaagtattctccttgccggcaacagtaccaacttggtaactcacacaacctttatcttggcgagaagcctcaaccaatgaattaaccaatgttttaaatgtatcaatatgttccggtttaactaccgcaaccgcataaactgcaatcatcctattctccgagcaatgtaaatgaattaaggttggctagtttaatgtttttatatattgaacagaataatctataataggaatttatcttccaaaaatggaagggtgttaatagaggatgatatggatttaaatgcaattagaatgtttatttgtgcggtacaaatgggcagtttgtcaaaagcagctgaaaaattacaactgcctctttctactctaagtcgtaacatcagtgaattagaaaagaacttacgaattcagcttcttgagcgagctaaaaccggcgttacgcccactgttgccggtcaaaaattttacgagcaaacctatctcaatatggaagcaattttagaagcggaacgtaatctacaccatgatgaacaacaactcagcggcctgctaaggattaccacgccgccctcctattttcctgcatggaaaatcatccgagatttccaacaacgttatccaaatgttcagatacaatgtaccgccagcgaacgtattaccgacttttttgctgacggtgttgatgtcgcttttcggttttatcgagaatcgggcgaccgagtaatcgcaaaaaaattaacggaagttgggcaaatattggtagccacccctgcatttttagccaagttcgggacacctaattccttggaagaattacaacatttccctctcgcaggttatggagaaaatggaagattacgactcgaaaaaatgtttttacaacaaaatattgagcttcctacttattttgttagtaatgattttcaagcgattttggaatatgcactgcatgattgtgctatcggctttttgccaccttattgtgtagaacaatatcttacattagggcaattagttgaaattctgcctaacgagcctaaataccagcatcaaatgtacttggtttacccctctcataaacatccttccactgtgctaaaagcatttgttgaatttgttttacaagcttaaataatgtgggaaattaagataacaagcggtctaatttccctaattttttgcaaatacgttcgtcaattattgtttcgtcaaactctccaccaacaaatttctgatccattgataagctggatcttggtgggtgcgttcgtgccacgccatttggattgcaaagccctgtacttcaagcggaagctctttgcaaatcaatccgctaaggttatgggataaacgtgatggcaccaatgccactacgtctgtgctacgtaagatattcggtagcaaagaaaagtgattaaccgatactgatacacggcgagttttaccgagtttcgccaatgcctcatcacaaacaccgtaaaattgtccgccgtcataggacatcattgcaaaatccaattcacaaaagttgtctaaattgagcgattgatttgccattgggtgatctgctcgcatcacacaaacataatgttctgtcagcaacggcttgctgtgtaaatccgccggaatatgttgggtggaaaccaaggcaatatcaattcttgcctgttcaaattgggctaacaaatccacgtcttgtgccggtaaaaatgccactcgaattttcggtgcaagttgttttaaatgggctaaaaaaggtgtgccaatcgcttccaaaccataatcggtagaagcgatcttaatcgtcatttcagccgtttgcggatcaaattccaccgggcgcaacattcgattcacttccgccaaaatggttttaaccgaaggcattaatgccaaggctctggcagtcggttcaatcccgtgttgtacacgcacaaataacgggtcaccaaagctatcacgcaagcgatttagcattgcactcattgccggctgagtcacggataaacgttgtgccgctttggttacgttacgttcttgcaagagtgcatcaaacgctttcaataagtttaaatcaacggttctaatatcacgcatatttatatttagtataaagaatagtgattagattttatatcttcagccgattaaaatccattcgttttttagacataaaggattagacccatggcaaaatttagatatttacaaacacctttcaaactcaaaaatcttgaacttaaaaatcgtatcgtgatgccaccaatgtgccaatattcagcaacagacggtgtgccgaacgactggcattttgtgcattacaccgctcgtgcgattggtggtgtcggtttaatcattgtagaaatgactaacgttgcaccaaacggtcgtatcaccccaagttgcttaggattatggaatgatgaacaacgtgatgcgtttaaaccgattgttaattccgtgcataaatacggcagtaaaattgcggtgcaaatcggtcacgccggtcgtaaagcacaagattgcgatgatgtagttgccccttcggcaattcattacggtgaattggattatgccggtcagaatttaaaaactcctcgtgaattaagcaaagcggaaattcaggaagtgattcaatcttaccaagatgcggtaaaacgtgcagtggaagttggtttcgatgcgattgaaattcacggtgcacacggttatctaattcaccaattctcatcaccgaaatcaaataaacgtactgatgaatatggtcaagatcgtttcttatttggtgagcaagtgattaaagcggctaaagcggtcatgccggcagatatgccgttaatcgttcgtatctctgcacaagaattcggtgcggacggttttgatgcggattacggtgtggaaatggcaaaacgttttgcagcagcaggtgcggattgtatgcacgtaagtgccggcggtgacggtgtgttagcagaaggtaaacatcctccatttaacgcaggctatcaagtatatctagctcgtgcggtaaaacaagcgaccggtttacctactattgctgtcggtatgttggacgatgcgaatgtggttgatcatgtgttagcaatcggcgatgcggatctagtgggcgttggccgtgcattattacgtgacccacaatggttattgaatgtacaatacgcacaaaatgcgtcaaataacagcggtattgaatttgtgcctgcacaatatcaacgcggttatttctaattaacgtctatacaagcggtgtaaaaacaagcatttttacaccgttttcttatttatcacactcggatttatcacattatgcaactttctattttaaatctcgtcccggtgcgtgaaggacaagactacgcacaagcaatgcaatctatggtgaaactggcacaactggcggaagaactggatttggctcgctattggattgccgaacaccataatatgaaaaacctagccagctcggcgaccactctgctgattcaacacgcgttagccaatactaaaaaaattgcggtcggctctggcggcgtgatgttaccgaaccacagcccttatattgtggcggaacaatacggtacacttgcaaccctttatccaaatcgtgtccaacttggcttaggcagagcgcccggcaccgatatgcgtaccgctaatgcgttacgccgaggggcaaaacatctcgaatttccggatgaaattgccgaactgcgtggttatttccaaaataccaatccggtttccgcttaccctgccgccggtttagatattccgttctatattttaggttccagcaccgaaagcgcttatttagcggcagaactcggcttaccttatgcgtttgccgctcactttgccccacgtatgatgatggaagcggtcgaaatttatcgccgttatttcaagccgtccgcctatttggcaaaaccttatgtgattatgggcgtgaatgcgattgtggcggacagcgatgcggaagcacaaagtctggtgaccacccaaacccaattctttattaatgtcgtgaccaatgcacaacagaatttacaaccgccaatggcaaatgatgcggaagtgtggcaaaactttaaccgtacggaaaacgagctacacttcggaccggtcgatttacgtgaaatgcagatttaccaccaagaaaaagcggtggtggaacaaatgaccgcttgcacgctagtcggctcgccagcaacggttaaaacccaattgacacaattagctaaacgagcggaaattgatgaaattatggcggtaacttatatctacgatgaacaaaaacaagcgaaatcttaccgcttgttgaaggaaattattgatcagttctagcctagtcaactaacggcttgcttaaaagtaaagctcctcccctaagagagaataagcggttagatttgtgcaaaattttgcaaaaagttttgtcaatctaaccgattgtcttttttctagtagcaaaaaatggctatttatgttaaaaattacgacaaattttctctcacattcccattcacattaaaggaacacaacaatgtctttacaagcaattattgaagcggcatttgagcgtcgtgctgaaatcacaccaaaaactgttgatgcagaaactcgtgctgcaatcgaagaagttatcgaaggtttagatagcggtaaatatcgtgtagcggaaaaaattgacggtgagtgggtaactcatcagtggttaaaaaaagcggttttactttcattccgtatcaatgacaaccaaatcattgatggcgcagaaaccaaatactacgacaaagtaggtttaaaatttgccgattacactgaagaacgttttgcacaagaaggtttccgtgtagtgccgtctgcaacagtacgtaaaggcgcatatatttctaaaaactgcgtattaatgccatcttatgtaaacatcggtgcatacgtgggcgaaggtacgatggttgacacttgggcaaccgtaggctcatgcgcacaaattggtaaaaacgttcacttatctggtggtgtaggtatcggtggtgtattagaaccattacaagcaaacccaactattatcggagataactgctttatcggcgcacgttcagaagtggttgaaggcgtaatcgtagaagacggttgtgtaatttcaatgggcgtatttatcggccaatcaacccgtatttatgaccgtgaaaccggcgaaatccactatggtcgagtaccggcaggttcggtggttgtttctggtagccttccgtcaaaatgcggtaaatacagcttatattgcgcagttatcgtgaaaaaagttgatgcgaaaacattaggtaaagtgggtatcaacgaattacttcgtactattgaagagtaattaaatctttccgcccccttcttgcaaaagagggggatttttttaccgcttgtaaggaatcgatatgaaaaaaattcttctcctcaatggtccgaatttaaatatgttaggtaaacgtgaaccgcatatttacggttcacaaaccctcgcagatattgaacaacacttacaacaatcggcacaggcacaaggctacgaattagattacttccaagcaaacggtgaagagccgctgattaatcgtattcatcaagcctttcaaaataccgatttcattattattaatccgggtgcatttacccacactagtgttgcgattcgtgatgcgttattggctgtgtctattccgtttgttgaagtccatctttcgaatgttcacgcccgtgaacctttccgccatcattcttatctaagtgatgttgcaaaaggcgtgatttgcggtttaggtgcaaaaggttatgattatgcgctcgacttcgcaatttcagaattacaaaaaatacaattaggagaaatgatgaatggctaatccggtgaaatatgaatcgctgattgtcgtctgtaacggtttagaacgcttattcggcaatattgttaaagtattaagctacccgtttcatgccgttttgcctaaacttcgttttaccattccggaatatagtccggcaaaaattaagtcgaagcaaactacccgaatcacgaaaaccatttggcaaaccaattattcaaacaaagtaacgttaccggtatatgcgaattatctgtttaaccgcttaatgtcgctaagttacgattatcgctatgtcagtactgaagatcgtgaggcttatattaaggcgaatgctgatgaacgcacatttaatgcttatagcaagctaaccgacggtgcggcgcaagcagatttttggcgtgtgtttacattattgcaagaaggcggaatctatattgatattgacgggcatttggtcttcccaatctcacaaattattcgggaaaatgatcaggaagtcttaattaaacgtcgtgacaaatataccaatttctttttagcttgcgagaaaggtcatcctatcttaaaagatacgctcgaaattattgtcagcaatattgaaaatcgccgaattgaaggcggtgtcttcgtgatgacggggccggatacactgaatgccgcaattggtagcaaacaagtcaatactcgccgagacaaagtgacttgcgcacaaggtactttcaccaacgagtattttcagtatattgacaaacctcgtagtaaatggaactacaaaaagaacgaagatttattaaaataagttcgctttgtaactgctacgatgagttataaaattgcgtgaatatcgccaattttacgagattttattcgcaaaattggcgaaattcaggtaatctagacaagatttttactctgcacagtattgtgcagagtttctctttttaattgactataaaaacggaatctcactatggatattcgcaaaatcaaaaaacttatcgaattagttgaagaatcaggcatcactgaattagaagtgtctgaagaagaaggtacagtacgtattagtcgtgctcaaccggccgcatcagcggcagtgcaatatgttgcggcacctcaagcggcagcggttgcgccagcagcggctcctgttgcacaagcggcacctgcagctgcagcgccggctgcatcagcagaagtaagcggtcacgcagtgctttcaccaatggtaggtactttctaccgcagcccaagcccagatgcaaaaccatttattgaagtaggtcaaacagtaaacgttggtgatgcattatgtatcgttgaagcaatgaaaatgatgaaccgtatcgaatcagacaaagccggtgtggttaaagcgattttagtaaacgacggcgaagcggttgaattcgaccaaaaacttatcatcatcgaataatttattcaccacggaaataacggaatacacggaattctacaagctgacaagcggtctattttctctcaaattttgcaaaaaaatcagtaaaattgaccgcttacagcttcttctgagtgttccgttctcttccttggtaaaaggggaaaactccaatgttagaaaaagttgtcattgcaaaccgtggtgaaatcgcattacgtattttacgtgcgtgtaaagagcttggtatcaaaacggttgcggttcactcaacggctgaccgtgaattaaaacacgtgcttttagcggacgaaacaatttgtatcggtccagcaccttcagtaaaaagttacttaaatattccaatgatcattgccgctgcagaagtgactaacgcagacgcaatccacccaggctacggtttcttatctgaaaatgcggactttgccgaacaagtagaaaactcaggctttacctttatcggcccgactgccgacgtgattcgtttaatgggcgataaagtatcggcaatcaatgcaatgaaaaaagcgggcgtgccttgcgtaccgggttctgacggcccagtgggtaacgatccggtaaaaaacaaagaaattgcaaaacgtatcggttatccggttattattaaggcgtctggcggcggcggcggtcgtggtatgcgtgtggtatacaacgagaaagatctcgaagaatctatcgcaatgaccaaagcggaagcgaaagcagcatttaataacgatatggtgtacatggaaaaatatttagaaaatccacgccatattgaaatccaagttttagcggatacacacggtaatgcggtttatttagcggaacgtgactgttcaatgcaacgccgtcaccaaaaagtggtggaagaagcaccggcaccgggtattacccctgaattacgtaaattcatcggtgaacgttgtgcgaatgcgtgtcgtgaaatcggctatcgtggtgcgggtacatttgaattcttattcgaaaacggtgaattctatttcatcgaaatgaatacccgtttacaagtagaacatccggtaacagaaatgatcaccggcgtggacttagtaaaagagcaattacgtgtggcggcaggtcttccgatttcaattaaacaagaagacattaaagtgaaaggtcatgcgatcgaatgccgtatcaatgcggaagatccgaataccttcttaccttctccgggtaaaatcacacgtttacacgtgccgggcggtttaggcgtacgttgggattctcacatttataccggttataccgtaccaccgcattatgattcaatgatcggtaaattgattacttttgcagaagatcgtgatattgcaatccgtcgtatgcaaaatgccttatcagaaacgattgtagaaggaattaaaaccaatattccattacacaatctgattatggaagacgaaaacttccgtaaaggtggcacgaatatccactacctcgagaaaaagctcggtcttaaataagcaacaagcggtaagattttcagtaaatcttaccgctttcttttagcttttaagccattgctgaatgaaatccgcaatctgctcaacatcattaatatctaagcgattctctcgtgtgagcgggtaatcggtcgcagttgcaattgtccattgatctaactccggtaacggtttttcaattgcttggcggtgcagctgaatcttggcaatcggctcgtgtttaaaaccttccaccaaaattaaatctacagtttcaggattaaattttgcaattaattgctgaaaatcgaccgcttgtgtcggtgtttcagtcattaatgcccagcgctcttcacaggcaatcatagtcggatttgcaccggctacacgtaagcgatgactatctttacccggtttatctacttcaacattgtgatgagaatgtttaatcagcccgactctaatgttacaagcggtcaattttggaattaatttttccaataaggtagttttgccagtgccgctataaccagtaatacccaataatttgggtgtgttcgtaactgttaaactaaaattttccaaatcggcaaaggtattcatattttgaaaagcagctttttgctcggagaaatctaccgcaacacttttttgtgtttggaaaaattggaataggcgacgctcaccgcttgccagatagtgacggagcggttcagctaccgaacgatgaatcaaggcaatagtaggatgcgctcgctcaccgtcatgcacataagcgatttgagcttgattgatcgctaatgcgaccgagagttttttcactaaattatttggtaagaatggcgtatcacatgggacgaataacagatattcgctggcaatgttttcaaagccggatagcattccgctcaaaggtccttggaaatcgctcaaactatcgccataaaaaggcaattgtgggaaatgtgtttgatattcggcttgtgctcgattgatattcaaatgaatctgagcaatctgtggcgtaagacgttccacaatatgcgcaattagcgttttaccgttcaatatctgcaagcctttttctgctccattcatacggcgagcaagcccaccggataaaatgaccgcagagatttgatctatttgtaacattttatgtccaagttttttgcaaaagtatggctaaaagtatatgattccgaaaacttttcaacaaggatttttaaggaagcaaagtatgaaatgcaaacgtttagaggaattacttgagttattaggtgaacattggcgtaaaaacccggatttacatctgatggatattttacaacaactttcagttgaagtcggtgaaccagataactatgccgcattacgtgatgaggttttaatttatcaattaaaaatgcgtaatgcagataaacacgagccgattcccggcattaaaaaagattatgaagaagatttcaaaacggcattattacgtgcccgtggaattttaaacgactaagatagtccaataggcgaatctatttatttgaggaaacataatgaaaaaatttgcattaaaatcagcattagtagcactttccgcactttttaccgtaaattcaacagcgttagcggcagctccggcagaaggtaaagagtatacacaagtgcgccaagcgccttcggcacaaaaagaagtagtagagtttttctcattctactgtccacattgctatgattttgaattaacttataaaatcccaagccaaattaaacaggcacttccgcaagatgcaaaattagttcagtaccacgtgaacttcttaggtcgccaatctgagaatttaactcgtgcatgggcattagcaatggcattaggcgtggaagataaagtgaaaaccgcattattcgaagcagcacaaaaagatgcattcaaatcaatggatgatatcaaagcgatatttactgcaaacggcgttagcgaagcggattttgataatggcatcaacagttttgcggtaaacggtttagtaaataaacaagtgcaattagcggaagattttaaaattcgtggtgtaccggcatttttcgtgaacggtcaataccaactgaatatggaaggttttgcggattcacaatcaaccaatgaatttattaagcgttatgtagatgcagtaacattcttactgaaaaaataataacgaatcagttacaaaaaaggctcagttacaaaactgagccttctttatttctaattcgattacatcgaaacaatcacacattccgctacgctacgggcattcgattgtgcagtcgatgctgctgctctgtctccaaccggaccgacaaaaacacgattccaatcagaacttgaactaatacgcgcattaaaaccagccatcgctaagcgagcctgcatattttcagcttgcgctttattcttaaatgcaccgcattgtaaaccgaaacgacccgcttgattagttgctttatctgctggttttgccgcacttgcaactactttggtttgttccgcttttttcgcttttgctgctgcgagttttgcttgttgttctgcgcttgctgcggtttccaccggtttagccgtttcaaccggagcttggttctgcttcgcaagctcttgttgtttcttcaattctgcttgcttacgtttttcttccgctaatttcgccgccttttgttcagccgctttctttgcagctaactcttccggtgttaacgcaacaaccgcaggttgcgcttctgttactgtttcagtcgatgctgccggtgtcgctgcttcaggctgagttgccggtttttccgatgctaaacgagccgcttcttcttgctttaattttgcctcaagctgctgtttttgttctgctgaaagctgagctaatttttcttgtgatttctggctattgtcggttaacacttcacgtgtttccaaatcacgaatatagctatacacctcttccggtcgactcggtaaggcagggccttgcggctgctgaactggttgagtcggttgcgctacaggtattgcttgcgtcggtgcattttcttttaatacccatagaccaatcccaccagccaaaagtaagagaatgataatccctaaaatgagagatttattagtacccttttttttgttcgagcgggctgcataatcacgttgtggcacgataacaccttgtcctattagacctaaaaaactataaagattgtgatcctactaaaaaaacagtgccttgcctagaagttcataggacaagcagtctgattttcacaaaaatttacgcagattttaaatgtgaaagataaacatcaaagcggtgatttttcgtggtttgcgaaaaatccggtttttgccccgctaaaaagggcgcatagtccggacgttttaccaccactcttttacgggcaagagcttttgccggcgcaaaaaaatcatctgaatctaaatctgcaccaactaaatgttggaatactcgcatttcttttttcactaacgcactcttttgtttatgcggatacatcgggtcgagataaaccacatcagccatttgctgtgctgcgtctagtaacgagatattacgcacgtcggctaaaatcattcgttcttgcataaatgtgccgatttccggatcggcataggctcttgccaaaccgtcttccaataacgccgctacaattgggttacgttcaattaataatactttacagccgacagaggccaatacaaaagcgtctctgccgagtcctgcggtagcatcaataaccgtaggtaaataatcacctttgatccccactgcttttgctaccgcttcgcctcgaccgccaccgaatttacggcggtgtgccatagtgccatcgacaaaattcacggtaatcgcaccgagtttcggttcgtccagtttacgcagctctaaacgctcgtcagttaaaactagcgcaagaatagcggatgggtcgtgagctagttgccatttgtcacaaatttgctgaaatttctcagtatgcgaagattcgttgataagttgaattgtcattatattaattgcaaaaaaattattcggtaattaaccacggaaagcaccaaggtacacagaataagaaaaagtatgtgctatttccgtgccgtcggagtattccatggtaggaaatatcagctaaatagctgattaaaatgttcaagtaagcagggtttaccggcaagaggttcattttgccacgatttttgcaaaatctcatgactgaatagcttttcatattccgcggaaatcggacgataactgatgtgccaaggctcataaccaactttgatattattcacaccgttgaaaggaaaataaaaaccgaaatgttcggcattatggtgcagccattcggctaatggtgcgaaataaccgccggtttggtattcccaaggctcaagctgtaaattttgcccttccggcagcaaatcgggatcaaaaatatcaatttccgttccccaatgatgacggctggaaccgggtactgccgaccagcgcatcatcgcttggattttgtgtaaatcgtccaatttagccatatcaatcgcacagccgctatcatcatgtactttgcgttcaccattaaattttgcattccaaatcagcatttggcgttcgaaatcacgataagtgctagcaggctgtaaattaaaaccggcttcttttgctgcctgctgcaatgctagaaaggcatcgaccacctcagcttgcaaaaagtgtttattcgataacggattcggcaacggcacaagatgttcgcgtgttttaccggtgaggatttgttcgaggcttgctatcattttaatctttcctcagcattaacttttgagtaagtattcgaggatttgatagtacacctctccacatttgccaaggtcatcaacattaacacattcattcactttatgaatagtagcgtttaacggcccgaactcgacaacttccgcacccattaatgcgataaagcgaccgtctgaagtccctccgctcgtatctaaacgaggggtaatttttgtgacattttcgaccgcttgtactgctgctttgactaattccccattacctgctaaaaacggtttaccagataaattccagctaatgcggtgttttaactgatatttagctaacatttccgccactttgtttttgataatttcatcggtcacttcggtgcaataacgtaagttaaattgcacgtataattcgcccggaatgacattattactaccggttcccgctttaatattagcaatctgtaaactggtcggtgggaaaaattcattcccgttatcccattgataagtggttaattcggttaagaaatttaatgccatatgcaccggattttcggctaaatgcggataagcaacatggccttgtacaccttcgatataaagatcaccggtaattgagcctcgtctgccatttttaatcacatcgcctaacactttgccgctagaaggttctcccactacgcaatagtgaatcggttcgcctctcgccatcagtgtttccaccacttttaccgtgccgtcttttgccgccgcctcttcatcggaagtaatcagcaatgcaatcgtgccggcatggtttgggtttgctttaacaaattcttctgcggcaacaaccagagcggaaagcgaacctttcatatctgccgcaccacgtccgtaaagcatattatccacaatacaagcttcaaacggaggataagtccattgagtttcatcaccaaccggcaccacatcagtatgtccagcaaatgcaattacaggatgtccgctaccatgcttcacccataaatttaacgtatcgccgaatggcaaccactcgagtgtaaagcctaactgctgcaaacgatctgcaatcacttgttgacagccttgatcagccggactaattgagggacgacgaattaaatcttgtgcgaggttgatgatgttgtttttcatattctaatttccaaaaataaattatttaccgaacgcttgttcatattgtttgacatcaaagccaatgagcgcaataccgtcttgtaaaataatcgggcgtttaattagggtcggttgctctaatagcacttttaatgctgttgtacgatctagattatttttaaccgcgtcatctaaattacgccaagtagttgagcgcttgttcaccaaagcttcccaaccgaattggctctcaatttgttcaagccattcagtagttaatccctctacacgatagtcatgtaaaacgggttgtagctgatatgcttcaagccatttaagcgctttttttaccgtgtcacagtttttaatcccatatactcgtactgtcatgataagttcctttagcttgctcagaaaagttaaatactctagtgctttttgtagtgtgatacaaggttatcgtaaaatattcttcaataatttatcctgattgataagttaaaattaaggtaataaagttattcaaattataaaatttgtaatgaaaaattgaaaatactctgtataatttgcgaactcttctacaaaggtactaccactaatgaaaaaattaacattcaggacgctcacattatttattgtgttgctgctgactgcttgcggaagttacactgattcgaactcatccaacacaagaaaagcaaaatatcagatttcgaatgaagatgtacaaaaatgggtcattgaaaaaaacaaatacgaacaatgtctctatcctaaggaacggaaatctaagggtgctaaattatccgagggtaatcgaatgttgtatcaaatggctgtttatcaaacgactctcagccaagtgattggagaagataattatcttatccttacacaagatccagcttcacaacgttttttagctaaaaaattgcaacagcacggacattcacaaaaggcacaatttagccaagcttggtgtaatacattgaaagcgacttatttacagccgacaaaagccaaaaaggctgtcactaagccgactaatgtcaaaaaaacaacgaacaaaaaaacaagaaaagctaaagtaactaaaaaatcagctcgtattgttagaagcgaaattgataatagcgataaccaagatcaattagatatcgcacaagaagaagtaattgagccggtagcgctacctgttcaacctgaagaaaaagaatcatctttccaagagccacaagcaccaagtgatcgaatcagagtcaattgggaaccggtgaaaaacgaagtgtattcttactaaaggctaaacaaaaagagatgtgaagattaactcacatctcttttttatttattcacattccgctaccgccttccagactttcaacatatcggcagtttctgctacatcatgtacacgaataattttagcgccgttttgcaccgcaattaatgcaccgaccaccgaagctgtcacacgttgctcaactggtctgccggttaccgctccgagcatggatttacgagataaaccggcaagcactggaaaaccggcatccgaaaaggcttttaaatacttaagcagcgtaaagttatgctttacacttttaccaaaaccaaagccaggatcgaggataatatgttcttttggaatcccagccgtgatacattcaaaaatgcgttgattgagaaaatccgccacttcttccaatacatcatcatacaccggattttgttgcatattctgcggattaccttgcatatgcattaaacaaatcggcaaacctaactcaacagcagtgtctagcgcattcggctcggttaaggctcgaatatcatttagaatatcggcacctgcttctgctgactgtttaaacacttccgcttttgaactatcaaccgaaatcaaacaatcaaaacgtttccgcaccgcttccactaacggtacaacacgttccaactcttgctccaatgtcacaagttccgcattagggcgagttgattcaccaccgatatcaataatatccgctccgtcattcaacattttttccacttggaataacgctttatctaaactgaaaaacttacccgaatcggaaaaagaatcaggggtaaagtttaaaatccccataatttgcggctgagttaaatctaacaagcggtcttttttttgataatttttgaaatgaatttgcatggaatgtacttttatcctttaaataacatttattgatatttaatataatcatattcaatataacttcccaataaagaaattcttttctttattattaattttgacttaatagggaatttattatagataattctagatgttagcgtttctcttccaaaactatcagattttattttggtataataatatttacttcgtccatgaccagaactttccttatcatagacttcagcaaaataagtagtatcctgccctaaataacgcgtataaggatatgaaattattggcatagcaaaccaagcgaaaattaatggtgttactactatttttagaaattcctctccccaagaaaatttttctaattctttgtcaatttcttcttttgcttttttagaaaaagtatttttatatttttcaataagtttatcgtatctatttttatttcctattgtttcttttattaagaaaggtaaacatataatataagcaacaataatataaacgacaccaaatgcagagcttatatcattatttttagtaatataaatagaatacaatagaatagagagcacaataataaaaattgcaactccctttttttgggaattcattatccgttcccttgtagtacaacataattcgtcaaaatattggtatgaaaactaataggtaatcgttcccattgatgaatatctactaacattggtaacaggctattttggaatgcagcttgtaactgaacaagatcagcatcgccttttaccacaagatccaaatcacttccctcgtgtccattaccatttacacggctgccataagcccacacctctgcaagcggtgcattttccgccaaaatttgcaaaataacggatagatgttttggcttaactgctaatttttcaatcggctgacgcatcaaaaacctctttcattacaccggctagtgtacgtaaatcaactaaatagtggggcaacattgttaatgtttcttcggcaaaaaccaccccataatcgtgggcggtaatattacgatttgctcggtaagttaaccaacgttcagtcgcagcttcgtcaagtaaaccgtgtttattggcatagcgaaataagtcattgaatactagacgatctatttctcgtggactaccactatacaatttcagtacttttctaagtaatttccctgtcgtttctaaagaaagttcaaagctcttaatagctacattacgaaataaatcatataacacagtctctttaggatccgtttccgttaaacgtaaaatggcttgttccaaagtgtctgctgtatgttgcagatgctcgacacttaaactcatcacagcctcctgttcttagctatttttctgctctcaacttcgccaatacaccttttaaagttttgtccaatggggcggtaatcagcatttcttcgccggttttcgggtgttcgaaacgaattgaataggcgtgtaaaaataaacggtgtaaaccgaccgctttcattttactgtcgaattccgcttcgccgtatttatcgtctaaagcaatcggatgtccggcatattgggtatgcacacgaatttggtgagtacgaccggttaccggtgaggccttaactaaagttgcattggtatagcgttcttcaatcgcaaaacgagtttcagacggtttgccttcttcgcttactttaacaatacgttcaccgcttgctaattcatttttcaacaatggcgctctaatcactttaacgtgcgattgccattgcccacgcactaaagcgagataatccttttgcactactttttcacgcaattgctcgtgcagattacgcaaagccgaacgctttttcgccactaacagaatgccggacgtatcacggtcgatacgatgaactaattctaaaaatcttgcctgtgggcgtaaagcacgcaaagcttcgataacaccaaaactcaagccgctcccgccgtgaaccgcaattccagacggcttgttaattactaacatcacatcatcttcatacaaaatttgctgttctaactcggcaactttattcaatttagtggaaatcggcgcttcgtttttctcggcaacacgcaccggcggtacacgtacaacatcgttttcttgtaatttatattccggtttgattctgcctttattcacacgcacttcgcctttacgcacaatgcggtaaattaaacttttcggtacgcctttcaatttggcgagtaagaaattatctaaacgttgccccgcttcatcatcactaatggtgaaaaattgcacgctggcattaattactttctctgtagtcattggttttacttcttgataaaaaatttgtgctaattttaacataatcgcccctagcaaggcaggcaagcggtcagatttatcgaaaattttacaaatagcctgcactaatcatgatttctattgtcattagtacgcaatttgtgcaaaatgcgcaccttcaatttctctatccttcaacttgatgtgaaggatgtcaacataaaggaaaatcaaatgtcagcagaaaaaaccgctgaaacagtgcaacaggttgatgttgtagctgaaacaacaaaagtgattgataaagtaagcactatggatatgcaaactttattaaacgattgggttatcccatacggtacaaaggtattattagccgttgtcatttttgttgttggtaaattctttgctcgcttaatcagtaagttattaggcaaagcggctttagcttcaactaaagacgaaatgttacaaagctttgttagctcaatcagctatttcttattgttattgattgtggtgattgcatcactttcacaattaggcattaacactagctcgttagtggcattaatcggtgcggcaggtttagccattggtctatcactgcaaaactcattacaaaactttgcggcaggtgtgatgttattaatcttcaaaccgttccgtaaaggcgatttaatcgaaaccggcggtatgaccggtacggttgagcaaatgggtttattagtgttggaattgcgtactggtgacaacaaaaccgtattgatcccaaacggcaaagtgttctcggacagcatcgtcaactactctgccaatgatgttcgccgtattgattttatctttgatatttcatacgaatctaacttaaaagaggcgaaagaaattgtatctcgtctcttagaaaataacgctttagtattaaaagatccggcatttgtggtagcagtcggtgcattatcggcaaatagtgttcagcttgtagttcgcccttgggtgaaaacagctgattactggacagcttactggggaattaccgaaatggtcaaacttgaatttgataaagccggtattgagattccatacaatcaaatgaatcttcaccttgcagacaacaaaagccttgcgattgaaaataaataatcgctaaacggcttacaagcggtcggttttctagcaaattttgcaaagaaaccgaccgcttttattttctctatattctctcagttagcttcctatcaacatccaacctcatacttcactgattatttactaaaatcaataaaatgtgaaaatcattacccaaacacctcaaagtcgcttagaatctatacatatataatattttttaataaaaatttgtttattttaggaacgcaacatatgacaacaccactcaactttgtgatgatttcaccgcattttccgactaattttgagacgtttgccgtccgaatgaaggaaaaaggcattaatacgttaggcattgccgatacgccttatgagcaactgagcgataccttaaaagcccatttaaccgaatattatcgtgtggataatatggaagattatgatcaagtttatcgtgcggtcggttactttgcacataaatacgggcgcattcaccgcattgaatcgcataacgaatattggcttgagctggatgccaaattacgtaccgatttcaacgtgttcggttataaaaatgaggatatgctcacgattaaaaccaaagcgcaaatgaaagaagtatttcgcaaggccggtttgaaggtggcaaaaggacgtgtatttaaagacgaacaagacgctcgcaaattgacaaaagagctgaaattcccagtaatcattaaaccgaactcgggtgttggcgcatcggatacttacaaagtgcgtaacgaagcgcagttaaatgaattcttcgccgttcaaaatccgcaggttgaatatattatggaagaatttattgacggagatattgtgacctttgacggcttaaccgatcacgagggcaatatcgtgttctactccagcctcgaatattccgaagcggtgttagacacggtagaaaaagacggcgatatgttctattacgtcccacgtgaaatctcaccaaaattagtcgagttaggcaaaatttgtgtggaagcctttaaagtgcgtgagcgattcttccactttgagtttttccgtgtgaaaaaaaccggtgaattattaccgcttgaaatcaactgccgtccgccgggcggtttaaccattgatatgtggaactatgcaaatgattttgatgtgttccgcgaatacgccaatatcgtgacggaaaataaattctatgctgacattacccatccgtggaatgtggtatatatctcacgtaaagcgaaccaaaattatctgaacagtattgaggacgtttgccgtcagtatgccgacaatattatcagcgtacaaaccgtaccgggcgtatttgccaaaattatgggcgaacacggcattttagttcgcaccaaaacgatggaacaattacgtgaaattgtccgttttgcacaacaaaaacagtaaaggagctaaccatgcattttgaaagaagaagccattggagtggtgaattaggtcgtgaaatgcactttaatgtgtacggtcatgccggcaaaccggttatcgtgtttccttcctcgggaggtaatcaaaacgaatacggtaatttcggtatgattgaagcctgtcgtgaatttattgatcgcggtttaatcaagttctacacaccggattcctacgatagcgaatcgtggttggcgttacataaatccggacacgatatggcgttggcgcataacgcttacgaccgttatatcgtccacgaattagtgccgttaattcgccatgaatcgagctggaacggcacgatgatcgccaccggctgcagtatgggggcattccattcggtcaattttgcacttcgtcatccggatctgtttgatactaccattgcactgagcggcgtttatgatgcacgtttctttaccggtgaattttacggtgacccgaccgtctattttaattcgtctatcgattcgctttggggacagaatgacgattggttcttaaatcgttaccgccaaaatcattttattattgcggtcggacaaggtgattgggaagatcagcacgtggaagatacccgccgtttacaagaagcgtttaatgcgaaagctattccggcgtggtttgattattggggacatgacgtagaacacgactggccgtcatggcgtaaaatgatgccgtatttcttaggtaaattggcagagcaaaatattatctaaatacttctctttcccaaaatacaagcggttaaattctgcaaaaaaattgcaaaatttaaccgcttatttgctttctttgctcgtctattttcccattaacgaaaaacttaaaaattccacaaaatgatttgcccaatgtacttcatggtgggtttcatttgccataatttttaagcgaatgttatcaattggatgaaaagtgcgaagtagcgcttgatagtaataaagcgaactattgatataagcctgattcatatttgaaatatactgtgcatccatatcatcgccttcgttcgtgccgacttgaataaacactttgctcgctttattcagcggatgacgatgtacaaaatctaaaaaggcggattcgctaaaccaagacgcagaagaaaacacgcctaaatggccgaaagtatccggataagctgcccccatataagcggtaataatgccgcccatcgagctaccagctaatagcgtatgctcacgttgcggtttggttcggtagtgtgaatcaataaacggtttcaccgtattcaccacccactgcccgtattccacgcccataccgccggcattacgtgcctcgggcgtatgtccgacatcggtacgccacggcgcatattcgtctaaacggtgtaccgtcgcattatcgatcccgacaataatcagttttggaaattcttggtgatttttaatagtcgggatgattttccacgaataacccgaataggattctttactataaaacacattttgcccatcatgcatataaagtacaggataagtttgccaattctcgttgtgataatctttcggcaatagcacacgaatacggcggtgatgattgtagtaaggcacatacagaaaatgctcttccattttcagatagtatttatctaagctcatttgatatcccaactttaataatttttaaacaagatcgtagcgttttttgtttctgaaacacaagcggttttgtacaaaatttagcatgattcggaagggctttttagaaaagaaacaagcggtcattttttggcaaaattttacagaaaaataaccgcttgaaattagcttagattgagtagtcgtctttcagtaaatgcttataggcaaacagataagaagcaccaacgaatgccgcaccaccagtcacattacccaagaacaccagaatcatattaaagaagaattgtccccaagtaacgttcgcccccgcccaaatacctgccggaataataaacatattcgctacaaaatgttgtaaaccgattaatacgaaggtcatcacagggaaccacatcgctaaaattcgccctgaggtttgttttgcgccgaagtagaaccaaatgcccatacaaaccatccagttacaagcaattgccgaaataaatgcgcggccgaagtccatatgtactttagcttccgcaatcgcaatggttttcgctgccgaaacaccttccgctaagccgacataatggcctaagaaaaatgccattgtcacagcaccgactaagttacctaaactgacaatcacccagttgcggactaatttcggtaagctaacttttttactgaatttacctaatgccatcagcatcatattaccggtcgctagctcaccgccgccaatcaaaatacaaattaaacaaatcgggaaaaccgctgcgcccaataagttagcaagtccgccccattccggcggaataccgctaaccactttgagataagcgatatagccgaaactcacataaccgccaccaagaaagcttaaaatagcaagcattttcaagctactttgtgatttggcaaaacttttgtcgataacatcttgtaggatttagtgtgggtaaaggtctctgttgtgcataatgtaaattaaatgttaattaaagaatggcaaaaatgtaacagagcgctcagctttagagaaagaatctgaggttatatatcacgcattttagttatatgtttaaaaatgtgagctatctcgcaaaataagcgggcgaaatcgccaaaaattttgtaaattcgctatctagagttatactccaaaccgataaacaattttataaacaggagcatcttatgcgtattgatacctcagcactttgtgatatttattctgatcaagttgatgtcgtggagcctattttttccagcttcggcggtgcatcatctttttacggcaaaatcacaactgtaaaatgcttcgaaaacaatgggttaattgcagaagtgctggaagaagaaggtaacggtcgtgtgctgctcgtagatggcggcggtgccgttcgccgtgcgctgattgatgcggaattagcacaattagcggtcgataacggctgggaaggcattattgtgtacggtgcggtgcgccaacttgatgtgcttgaaaccctagacatcggtattcatgcgctagcgccaattcctgttggtgctgatgatgcggacattggtgaagttgatacgccggttaactttggcggcgtgacattcttccctgaagattatgtttatgccgatctcactggtattatcctttcaccagaacttttagatctcgccgaattagaagaataaaatagcgtaacgcagaaaccgaccaattggtcggtttttttgttgattacatattgagataaaacgccttagtcagctgtttaaatgcttcagtatattgattatccgaattataaatcaccaattcttgcacttgaagcggggcatttctgagcgaaaaactcacaatcatacgtttaggttgttgcccttgcttagtgataattttgcaaatttttgtacaaaacagaccgcttgtctggctttgctctcgcaatttttccgccgcatcaaagggcaaaataaaagtaatttcaccctgtgccgataaccattgctttgcctgtaatagccaagccaaatggctttgtgtagcggctcgtgccaaatctcttgcatgagagcgtgaagccaaactatcggtaaaataaggcggattagaaacaatcaaatcaaatttctgcgcaaaattgtgttgcaagacatcaccttggcaaacttgtaagcggccagaaaatgcagaattttggcaattttcgaccgcttgttgataagcattcggctctaattcaagtgcagtaatttgtgtcgcttccgcggttcgttgcgctaacatcactgcgactaaaccggtgccggtaccgagatctaagatctgatttgctttcgctacatctacaattgcgcccaataagatcccgtccgtattcactttcatggcacatttatcatgtgcgataaaaaattgcttaaattgaaatcctttcgatttgctcatcttgtgctgtcttcacccaaaaataaaatatccactataatcgcattgtttgtttgcttctacaactgatcagaactagaataagtattgaatttttattcattatcaatgccaaatatttggtttctttaagcatcataaaatacaaatcagtaaggaatgaagatgaaattagtgaaaaaactcggtttttccgcatttatactggcaacgattgccgcttgtatgaacacccaccaaatgaatagcaaagcagaacaaggctatatgcaaatgaagcagcaaaatgcgcgagctattgatcgaaattctgcaacagctaaacgggtacaaaccatatttaatcgtatgaaaccttacgcagaacaagcaaatacgaccggtgtgccgtttaactgggaaattaccgtattccgttcaaaagaattaaacgcatgggcaatggcgggcggaaaaatgggcttttatactgggcttgttgagcgcttaaatatgacggatgatgaaattgcaaccgttatgggacacgaaatggcacacgcattgcaagaacatagtaaatccgcttataacgtcgaaatgacgaccggtattttaggtgcggtagccgatgccgcagtgtctgttgcacttggagcggataccggtggcttacttagtactggcacggatttaatcgtaaataaaccgttctctcgcagtcaagaaactgaagcggatgaaatcggtttaatgctaatggctcgttcaggttataacccttccgctgcaccaaatgtatgggtaaaaatgagtaaagcggctggtaattcaggcatttctatcttctcaactcacccatctaatgaagaacgccaagcaaaccttgaacgtctgcttccagaagcgatgaaagtatataaaacaagcaaaagataatgtgatatatcctaaagctaaaggcagatcataaaaacgatctgcctttctttttgttgagcaaaaaacaaccaatacttttttgaacttgctaacatttgtgtataacatcataacttattgtttctattatggaatttagccctttctttatgatgttcaaagttattcacgatcattatgccgatctatcacacttttatccacagatgatggggataaatagctagccaatgtgaataaaacccaacattagttagattatctggaaggttatccatatacttgttgaattattccctaaaaaaactgatcctgtcactaaaaaagatcgcatattgatctaaaataaacctgaattatcctacaaataaaaacaaggagttaataaagttattcgattagaatacgcattcgtttgacaacttatccacagagttatctacaaaattggctttaaaggttgttctaagccgtaaagtgtgaaacaatctcacctattttctctattacctaaaataaataaggtggttaagtgatcgatttcgatggctaccgcccaaatgttggtatcgtcatttgcaataaagcaggacaagttctgtgggcaaaacggtttggacaaaactcttggcaatttccgcaaggtggcattaacgagggtgaaaacattgaaacggcaatgtaccgtgagctttatgaagaagtcggcttaaccaaaaaagatgtacgattattatgggcgtctaaatattggctgaaatataaattacccaaacgcttagtgcgtagtgacggttctcagccagtgtgtatcgggcaaaaacaacgttggtttttgctacaacttctcagtgatgaaaattcgattgatttaaaaacaactaaaagcccggagtttgatggctggcgttgggtaagtttttggtatccggtgcgtcaggtggtttcgtttaagcgagatgtgtatcgcaaagtgatgaaagaattcgccggtgtgttattaaatgaatcgaaaaaagtagaaacggttgaaaaaccacgtatagagcgtacggaaaaacgagattttcaaaagcgtgactatcaaaaacgtgaatttcgcaagcctactcgtgcgtggaacaatccgcatcagaaaggaaaatcgtaatgatagaagtatttttgagttgtcttgcattaggtaccgtcgttggctttttagcaggtttattcggtattggcggcggtttaattatcgtaccaagcttagtttacttattaccgatggcgggtgtaacacccgagaatttgatgtctgccgctttaggtacatcgttttcgaccattgtcattaccgcattttcttcggcacaacgccaccataaattaggtaatgttgattggaacgtcagtaagatctttattccgtctattatgatttcggtatttctcgctggtttagtgatcagcggattagatgccaaattgatgtcgaagttatttgcggttatggtgatttatttagccggtcgtatgattttctctttgaaaaaagagcaaaaaattaaaccgcttacgactcaaggcactattgttgccggtggcgttatcggagcattatccagtgttgcgggaatcggtggcggggcgtttatcgtgccgtttctaaatagccgaggcttagaaatgaaacgtgcaatcggtacttcatccttctgcggggcatttttaggcttatccggtacagttagctttatcgcaagcggttggaatgtcgcaagtatgccggattactctttaggctacgtttatttaccggcattattcggtattacgctaacttcctatttcacctctaaactcggggcgaatgcggcaaatgtgttaccggtagcaaccttgaaaaaagcctttgcagtgatgttagttgcgattgcgattaatatgtttttaaaatagctcgattttacttactcccctctactccagaggggaatttttttaaaggaacaatatgaacgaacaatttattcaatttccacaaattgatccgattatttttagccttggtcccatctccctacgttggtacggtttaatgtatttaatcggcttcggtttcgcttattggctaggtatgcgccgagcaaaaaattccaatggcgtttggacaaccgaacaagttgatcagcttatctatacctgcttctggggcgtggtattaggcggacgtatcggtgatgtgtttttctataatttcgaccgcttgttacaagacccgatgtttctatttcgtatttgggaaggagggatgtcattccacggtggtttaatcggtgtgattgttgcaatgatttgggtttctttccgtcaaaaacgcagtttctggcaaacatcagattttatcgccccgctaattccgttcggacttggaatgggacgtatcggtaactttatcaatgatgaactttggggacgtgtcaccgatgtgccttgggcggtattattcccaagtggtggctatttacctcgtcatccttcgcagctctatgagtttttcttagaaggtgtggtgctgttcttcatccttaattggtttatcaaaaagcctcgtccggcaggttcagtcgccggcttgttcttagtcggttacggtgtgttccgcttcttagtcgaatatgtacgtgatatcgacccgaacgtaaacacggtagatgatttgattacacgaggccagttattatcgttaccaatgattatcggtggactagctattatgatctgggcatattctcgtaaaaaagcataacgacaagcggttgaaaaagagtcgtttgaatcttggggtaaaatgtgtgatgatattacgaaagtcgcattattggcattacaggtaatcttatatagcaaagaatcattggaattccgtagtctaaatattttatttttatgtattatcgcctacgcttgtttaactatcggaagaatttttcgtcgtgcgtttaaggagaaataaaatgggtttaacattaggattggctattcttgccatactatcccttgccgcattaatttttgcaaattatgctgtaaaacattcaaaatagccaaaaagccgtaacctctgattgttacggtttttttatttgctaaaattagtgataactgaatttagataaggaaaaattatgactaaaaaatataaagtaattggttttgatcttgatggcacactaatcaatacattgccagatttaacattagtagtaaattcgatgtttgccgaacatggtttaccaactacaacacaagagaaagtattaacttggattggtaaaggtgcggatattttctttcaaaatgcgattgcttacacaggacaagtatttgatgcccaaaaattagtgcagttacgcaccagttttgataaatattatgccacttacgtttgcgaagaaagcgagttatatccgaatgtaaaacaaactttagaaacattaaaggcacaaggttatacgttggttgtgattaccaataaaccgactaaattagttgagccggttttaagtgcatttggaatttttgaattattcagcgaatatttaggcggacaatcattaccaaaaatcaaaccgcatccggatccgatgttgcatatctgtgaaaaatttgcgattcaaccaagcgaaatgttatttgtcggcgattcggaaaacgatgtaattgctgctaaagccgccggttgtgatgtggtcggtttaacttatggttataactataacgtaccaatcgagcaatcaaacccaaccttcgttaccagcgaatttgctgatgtattgaaatttgttggttaattctacatataacaagcggtcaaattcccttaactttttgcaaaaaatttccggaatttgaccgcttgtgcttttatcgaatggcaataaaggctaagataagtccattcgtttctaatttaataagagattataaaaaatgaccaaacctattgtatttagtggtgtgcagccatcgggtgaattgacgatcgggaactatttaggcgcacttcgtaactgggtgaaaatgcaagacgattacgattgccttttctgtattgttgatttacacgccattactgtgcgccaagatccggtagcattacgtaaagcatctttagacgtattagccctttatttagcttgtggtatcgatccgaataaaagcacgatttttatccaatcacacgtacctgaacatacgcaattagcgtgggtgttaaattgctacacttacttcggcgaaatgagccgtatgacccaatttaaagataaatcggcacgttatgaagaaaacgtaaacgttggtttatttacttacccggtattaatggcagcggatattttgctttaccaagcaaatcaagtgccggttggtgatgaccaaaaacaacacttagaaattacccgtgatattgccaaccgttttaatgcgttatatggcaaaaaagatgtcgagggtaatgtgattgagccggttttccaagtgccggaagtgtttatcggtaaagccggtgcaagggtaatgtcattacttgaaccgactaaaaaaatgtcgaaatcggatgataaccgtaataacgttatcggtttattagaagatccgaaagcggttgcgaagaaaatcaaacgtgcgatgaccgatggtgatgagccgcctgtggtacgttatgaccgtgaaaataaagcaggtgtatcaaacttattagatattctttccgcggtaagtggtaaaactattgcggaattagaagcggaatttgaaggtaaaatgtatggtcatttaaaaaccgaagtagcggaacaagtttcggcacttctaacggatcttcaagagcgttataaccacttccgtcaagatgaagcgttacttgaaaaaatcttccgtgaaggtgcagaaaaagctcgtgctcgtgcgagaaaaacacttgaagaagtatataaattagtcggttttgtacaataaaatattttttaatatttatttaaggctaaattggaaacaatttagcctttttatttgctcaaaatatgattatttttatttatcaaatttaatcatattcataataatgctcatattatattgattttactcttcctttttgttttaatcctagcccccttattttttaactatttattaaaaggatccgtaataaatatttaattttagatggggggatattttcgaatgtattagaaggaaactaaaacatgaaaagcaagagcttagttgttgcgatggcaacaatgttagccttatcaaccgaggcagatgcaagtaagctagccagcgaacttgcaaccactgcgagatattatccgaatgcagcgaatagttataataaatattcgtcaatgtattcaggatattatacgaataataatcgaaataattattcgtcttggtttaatccaactcgctatacgggtactattacccgaacggtaacgacaaaaataaacggtgtactcgttaccaaaatttatacaactgtaaatggtagaaccactgttcgagtaattatctcagatggaaaaccaactgttgtaaatagaccaacaacaccgccaacaaggcctgtcgtagataccaaaccggttgtaacgccaactcaaccggtggttgataaaaaaccagttgaagcaccaactcagccggttgtcgacaagaagcctgttgagcctccagttcaacctgtagtggacaaaaaacctgttgagacgcctactcgaccaattgttcgtaatccggttgaaaatccaagccagcctatcgtagatacgaaaccggttgttgatacgccaacgcaacctatcgtagataccaagccggttcgtgaacatgaaccacctatctcagatacaggtcctatcattattcgcccaagcaagcctatcgcaacacgttctccaattgttgcatctgatgtgcctactcgaggcgaacaatggaatgaccgttcacgcggctataacttacgcgatccaaataacaaggccaatgttaccttggatggtagtggtgtaatcgtcggtatcttagatagcggctttaaaaactatatgatggcaaacgatatcgagaaaaaattcggtaatcgtgctgaaatcattgaaacaggccgttctgcgccttcatcggcaactcacggtattatggtggcagaaatggtgggggggggtacatcaaataacggtgtagcaccgaaagcgaaactacttttagcggatattactcgaaccaccgccaatggtacaggtttatcggcaagtgcttcattctataatgatttatggaatagaggtgcaagaatcttcaaccagtcatatggtattccaaaaccattaacttactttaacaatgatagccgttctatgtactactacgaacgccaattcgacagtagtatcttgaacttctataaaaataaagtaaaagacggtgggttatttatttgggctgcgggtaacaaccgtggtgacaaagatccgagcgttcaagcaggtttacctcactatatgccggaattggagaagggttggatttctgttgttgcgttagcgacaagaagctctaacagtttaggtaattttgaatggagcaatttattaccatactctcaagcaggtgtggcgaaaaattggaccgtttcagcaatgggtgactacgttttcaacctaagaggtagtaacgtagtatcaagtggttcatcatttgctgcgccggccgtaacaggtactgcagcattagtgaaacaaaaatatccttggatggatggtaacttgatcaaacaatctatcttaaccacagcaaccgatatcggtgcgcgtggcgtagatgatgtatatggttggggtttactcaatgttgaaaaagctaccaatggtcctgcacgttttgacaaaggccttgcatttgcagataacgtgactgttaatatcccaactggacgttatgagttctcaaatgatattgacggtgacgccggcttagttaaaaatggtagaggtgaacttgtcttatcaggtgcaagtacttttgaaggcgtaacaaccttaaacgaaggtgcgatcaccattaacggtaagaaatatgcgtcaaaagttaatgtaggtaatcgtggtactttagttgcaaacagtacaacgttagaaaatggcgtaaataacgaaggtacgtttgttaaccaaggttattcaaccatcaacaataactacatcgcttcagcgcaaagtacgttagtgtcagatttaggttctaacttaaatgtgaaaggtgaagtggatttaaataattcaaccttagcactaaccgcagaaaaagacggtaaagcacaatatgttacagcaaaaggtgtaacaacttctgcaattacctctgatactgcaattaaaggcaactttggtgcgattgaaacttctggcttattaaatgcgacggcagttaaaaccagcgagaatgaaatcagtgcaacagttagccgtaaaaatgttgcggattatgtgaacgaaacaacctctggcgaagcaatgtgggaaaatgttgctatggcgttagaaaacagtttcaccactttagattcacaaattgaggaaaataaaggcacaacaactgcaacgaatgactcttttgcacaacaagcggctgttttacaaaacagcattgcaaatgctaatacgcaaagcgtagtcttagatagcttatctggtcaaatttatgcgtcagcgcaggcgcttacttttgaaaatgcagaaacagtaaacaaagacttatctaaccgtttagtgatgcttggtgcattagataatatcggtaataccgcaggtgtgtgggtaaccggtatttacggaaatggtaccttaaaagaagcaggattcggtgaaggaaaaacaaatacctatgcaggccaactaggttttgataaacaattcactgacgatgttattttaggtgctgcacttaattactcaaaagcggatgtaagcttcaaccgttacggtggtagctcaaaagcggatggaattggtgcgtctttatatgctcgtgtaggtaacaagcacaaaacaccttggtatgtacaaggtcgtgtaggttacggcagcgttgattcagatgtcgaacgtaatattattttggcggataataacgtaagtacagcaaaaattaaccaccgtgataaagtgctttctgcttatgtagagtcaggctatgacttcaaaatgggtaatcttgcatttacaccgtttgtcggtttaaatcacgatgttgtcagacgtggcgcatttagtgaggaaaacagccaattcggtttaactgcagataaagcaacctataaacaaactagcggacttgttggtttacgtacgtcattagatgtaaacgttgcagggatgaaaacaacccttcaaggttatgtaaatcaccaaaaagcgtttaatgatgaagatcttagctttaaagcaagctataccggtttacaagatgcgaaattcgatgtgaaaggtatcggccttgcgaaaagcaaaacgtgggttggtgtaggtgcattaacggaagtgaacaaaaacacctcgttatatgttaactacgatttaaaacttacgaaaagtaaaggtcataacaatgttgtgactgctggtgtgagagtaactttctaagccggtatttactgataagaacactatgagcgctagacgtagcgctcatatttttttgcaaaatttcggtgaaaaacgaccgcttatttcagcaagtcttttaggctggatttcattttttccatctgatccagatagatatgttgattttccaactcatcaatcaaatgattaatggcttcagacaacgtcatctctctttccttcgaatatttcgataaacgtaaccaactcgcatattctaaatcgatcgattttttcttcgtagttggtttctccgcattaaaaaaacgcttacgcttggcacgaatcgactggcgcattttcttacgttgctccgccgtcatctccgttttaatccattgctcgatttcttccggcgaatgttgaagcgtcgttaaaagttggactttcagctcaatcaaactggtttcttcgtacttagtgatattttcaccttctcgatgctttttgagcaaatacttccatttccaattcgcttcttgaatctctaacttttggtaacgcattttcttctcttcacactgcttaaacttaggcaagtataacggaattctgtataataaaccaaatttctattatgaggcattttcgtgaatttaaccccattagactggcaatctctcaccttacatcattcattcaaagaagcgagtaatgaagtaggtttctttgatttccaacccaatgcaaaacaagcgattgaccaattcaaacgtgggcaatttggctcgctattagtgataaagacggaaacattccctgaatttatccaagagattaaacattatcttaccgaaaatcttagcgcgccgttagttaccaaaaccgaatttagtcgtaatcacttattcggttacagcatttatcttgaaaaagagcataaagtagaaaacgtaacgggtgcgattcaacaagcaaacaacggtattttgctgctgaatgtgaactcattattattggatatcacgcaatgggacaaattaaaacaggcgttactgttcggctcatttgaacaaaatgcagtgaataatatcccttatctgcttcctgttattcagtcaaatttcaaactggtactcatcggtagccgagaagatatatctctattggctgaatatgacgacagcctctatcaagttgcacaatataccgaagtagaatcctatttaactcttaatgacgaaaatattaagcaatggggtgattatgttcaatcaagcgcccaaaaatggattaacaaatcgtttactaaccaagcgctaaatcagcttttacaagcttatgtgcgagaaagtgaaagccaagaattggtctctatttccccgactttactcaaaaagcatttgttaggccttgcaaatttttacccaaattcaaccgctttaaaccaagtaacagaatattttgattatttagaacagcaatcctctgttttaaataaatatacgacacaagatattcttacgcaccagttatatatcgagaccgaagatgaagaaatcggtcaaatcaacggtttgtccgtgattgagtttgacggtatcccccattcattcggtgagccgttacgtattagctgtaacgtacaacacggcgacggtgaaattaccgatattgaacgtaaagttgaactaggcggaaatattcattcgaaaggtattattattgcgcaatcctgcttagccaatttattagaatttccaacacaactcccgttctccgcttcgctcgcctttgagcaatcttatggtgaagtagacggagacagctcatcgcttgctatattctgcgtactcatcagtgcgctatccaaattagcattaccgcagtcgattgccgtcaccggttcaattgaccaatttggtaacgtattaagtgtcggtggtgtaaaccaaaaaatcgaggggttctttaatatctgccaagcccgcggtttaactgaaaaacaaggtgtaattatccccgcaacctgtatttcacatttgagtttaaaagcagaagtgatcgaagccgtaaaagccgggcagttcaacatttgggcgattggaaatgtttttgaagccattcaaattttattaaatcgtcatttttatgatgaggaaaattctccgactacagacaaaccttccgtatttgggctgattcatcaacagattgagcagaatcaagaacgagaagaaagcggttcatttttggcaaaaatttgccaatggtttagtaaaaactgatccgacaagctcagctaacagttgtacgccaaattaaaagcctgtactatcgctcacaatcctgagccctgattgtacgggcttttatcatatttatttggaagaaaaaaatgaacaactgtacaccaaacattaaaccaagctatacctatgaagacttattagcatcaggtcgtggtgaattattcggcaaagaagggccacaactacccgctccaacgatgttaatgatggatcgcattaatttaatgactgaaaacggtggcttattcgataaaggttatatcgaagcggaattagacattcatccggatcttccatttttcggctgccactttattggtgacccagtaatgccgggctgcttaggcttagatgcaatgtggcaattagttggtttcttcttaggctgggtcgggggcaaaggtaaaggccgtgcattaggtgttggtgaagttaaatttaccggacaaatccttccgactgccaaaaaagttatttatcgcattaatatgaagcgtgtcatcaatcgtaagttggtaatgggcttagcggatggggaagtggaagttgacggtcgtgttatttataccgctaccgatttaaaagtaggccttttccaagacacttctgctttctaattttgcgatcctgatcgaaaaaatagataaacttcatttcattctctaatcgaattaaataatatccctgcccagagggatattatttatgtttaaagcattcacacttattgaaattctcattacctttactattttagttatttcaatttattttatttctccaattgcatttcatttaaatgacttaattgcattaaatagtgaaatagaatccctccaatcatttttataccaattacaaacaaaatctcgttacgaaaaatcaaattatacacttactatttcacaaaataatcaagataaaaaatggtgcataatcgcaattaaaaaagccaaacaaaataaaaaacaaatcatttgtgattgtttaaatgccaatcactgcattattaataatgaacattatatttattctaatcgccacaaagacattttactaaagaataaaagtttatatcctcaagcttttattaatattgatgggctagctggaagattagaatctaaatgcattcacttatcattaaataaaacaaatgaaatattacaattagatcaatggggaagaatttatgtcatgccaaaacataaacgcagtcattgtaaagaatagattatcagcatttagtctaatagaattgctattgtctctctcattaagcatatctctcctactattaacagctaaatcctatacacaatttactcagaataatgttaaacaaaaagaattgttatttttacaaaaagaagcataccaaattatccattactttcaacaacatattcagcatttaggttttcaaggaagcaatagagaaaacagcaatttttatttatttgagaaagaaaataaacgttacgcattagataataaaagttgtttaatatttttctacgacttaaatagcgatggatgcttaggtaaaagaaaaacaaagaattccctatgcgtaaataatgagataaataacactcatgatttagccaaagaaatattcggttttaaaattgaatctcaagaaatttatatttacgataaaaataatttgactacttgtaaaaagcatgaatgtgaagggttattaaatgcttgtcaggaaaaatggaaaaaatttacttcgattgaggattttaaagtagataagctctcattttcatggaaagatcctgaaaaaattatgcaggtaacgttaaagcttatttctgtcaaacagaataatattgaatatagcacaaccaattatatctatattttaaattaatcagactaatatgacgcaatataaacttaacggaagcacattaattttctcactgataaccatatcttttgtgctgaccattatacttgtaacaaaagaaaagttcattcaatcagaaataaaaactcaacattatcaacggcattatttatccgaaaaactttctattctcgaaaaaatccgctcaaaaaatagtaattgtaatctaataaaacctgagcaacttattcttgatcgcatagcagaagtaaaaatagaaactgaagaacaaaaatattctttttactgtatcaaaaatagcttatttgtaggaaaaaaaccgactaaagaaaaatatattcattttagccaactatctgatgtattagatatttctcatgctgacataatagagatagaacatttaaatgaactacctaaaagctcagaacaagatcctaaaatcgttttagttatgcgtgatatagatgaaacgcttagccaagatttttatggcataattattaccaatcattacttcgatataaaaggcaatgctaaattttacggcatattatattcatcctatgataataatagagaagaacgaaatattactttcaaaaagaatgttgtattaaatttagaaaataaatatgctcattggcaagaactccccgattcaaggaatatgttaaataatgaataagttaattaaatcagaatcatttatttcaatacttattggcattgtaatattttcacttatctttatttctgcttcacgttggggaagtcatcaaaccgaaaaaataaattatatttatcagcaacagcaagccttacaaattatcgaaaatcaactcgcattaaaatattctaaacaaacttgcgaacaatatgttcaacaaaatcatttgaagtttaaaattgaatgccaagcaaataaaattagtgtgagttttccactaggtaaagtcgaaattaccccatagactttgcaaaaaaatagtaaaatccgaccgcttgtttatccgtaaggtatcggcaaaagtaattgaatctctaagctaattagtagaaaatcatcgccttatatgaggtatcaattatgttcacggtttaccattcacaaaagctattgtcattagcagaaatgctaattcatctacaaaaagccaacccgaatcccaatccgttcagcaccgaaaccatacttgtacaaagtgttggtatggcacaatggttacaaatgcaaatcgctgattccattggtgtggcgggtaattatgactttttatttccaaccagctttttatggcaacaataccgtgtgctattcccttcgttaccgaaagaaaatatttttgaacgttcttcggtaacatggcgattaatgcgcctgattcctgcccatttggacacggcagaattcagcacattaaaatcatacttgcagcaagatgcacgtcagtaccaacttaaactctatcaactttcgactaaaattgcggatctattcgaccaatatttagtttatcgacctcattggcttgtacattgggaaaacaaccaacttgaagcggttcttgctgaaatcatgcattccaatgtatttaaagttaaaaatgaacaagaaatcctagctaacctacaatggcaagctatcttatggaatgcgttaattgacgatattaaattagatagtgatgaaagcgtctttatcacgtcgcatcgtgcttacttacaagatcagtacttccaaaaattagataatttaactgctcaagaaaaagaaaaacttccacagagaatctttattttcggtatttcatctctaccggcaactcaattagctgtattaaaaaagttaagtgaacactgcgatattcacttatttttcttaaacccaagtcaagaatattggggcgatagtgttgaagatagtgcattagaaaaattagccttgaaacaacagctatcggagaccgatttagccgctttactcgaaaaacaaggtaatcaattgctcactatgtggggaaaacaagggcgagaatttttagcgcaactagtagagcaagagttcgactatagtttagaagtatttgacccgtatgtcggcgaaaccaatctcatcaagctcaaaaatgccattttagcgtttaataatgcacaaacttttgaattagacgaacaagaccaatcattacaatttcattcgtgccatagcgtaatgcgtgaagtagaggtgttacataactatctcttacaattattcgagcagaatccggcattaacgcccaaagatattattgtaatgtctgcggatattgataaatatgcgccttatattaatgcggtattttctcgctttgctcataaagatccgagaagaattccttttacactttcagatcaaaaagcgactgcggtagatccgattatcagcagctttttgagtctacttaatttaaaagaaagtaactttaacgcagaagtactattggatttattagatgtaaatgcgatccgaagccgttttcgcatccaatctgatgatatttataccctacgtcattggataaaagaagtgggtatccgcgccggattaactatcgagcaaaaccaatggcaaaactataactcatggcaaaacggtttaacccgattattgctcggcacaagcctcaaagaagaaagtggtatctggcaagagagtatcggatttaacgaaagctatggtttagcttccgagcttatcggttacttatgccattatttagaaaaacttagtacgtggcagaaatttatccaaacatcacacagcattggtgtttggcaacaaaagctagctgagttaatcaatgagttttatcaagatgatggcgaacattttgattcgctctccatgttacaaacaacgttacagaacgtattagaaaaaattgaaaacgcacgctttgaagatgaaattgctattgaaattctcgcctcgctactccaagagaatctcaacacgcagcaaaacagcctgcagtttttagccggaaaagtgaatttctgtacgttattaccaatgcgagctattccatttaaagtggtttgtttgctcggtatgaatgaggctgattttcctagacaacattcggtaaatagcttcgatttaatgcaatacgcaccaaaaaaaggggatcgcgcacgcagagacgatgaccgttacctatttttagaggctttactttcagcccaagagattttctacgtaagctatgtcgggcaatcggtaacggataataaagcacgcttaccttccgttttagttgcacaattattagattatatcggagaacatttatccgaatcggctcaacagacgctagctgaaacagatattttcagtggtatggtgaaacgccatcctatgacagtatttagcccaagaaacttcatctatcctcacatctcttatgatagagaatggctaaaactatttgaacagaatgcggttcagccgaatttcttaaatggacagcttcaatcggatagcccaacagaaattaatttaaatgaattaattagttatattacaaatccaattaaatatttctttaaccgccaattgggtatttattttaattacgatgaagaaagtattgaagaatcagaaaagtttactttgaatgcattggataattaccagttaagaaccaaattattaacagttgatgaggaacaagcgcaagctttattttaccaagaacagttaaaaggtaacttgccttcagccaactttgctaagctatctgaaaccgcgttggaaaactcaataaaaactatgagaaatgaaatatcgccatacttaaaacagagtgatattttaactgttgaacaatatttcccaataggttcaaataaaataaaactctatggaaacatccaacaattatttgacgatgaaatcgttttttggaaagtaagttcattaaaagataaagatattatccgtttttggatttattatttagtaacacaagtgcaaaataattctattcgtttgaaatatattgtgcgtaacggcgaagatactcaaatcttccaatttaattcgatcactcagcagcaagtgcaggaacaattagctatttatatagaagattaccttaatagctttcaagcgctacgctgggggatttctgccggtttagacgattattttgccaaaatagaagatgttgagaatattgaagaatattgttgtcagaaagtttttaaattactggaagacaattcgtttgaagctagttacctacagcgagttttagtacaaagttccaaattgaattacagtgttattcatcatacaacaaaacaatggtttactttaatgcaagacagtaagccacataacaataaaaaggagaattaatgaaaaaaaccttaataagtcgcatgattcgtcacgcgctttactctgcgattgcgcttagtgtcagcgtcacaaccacatttgcaaatattccgcaaaatccgaccgctagtacatcccaatcggctatacaaacgcaaggttttgagtttatcaatcagcagatcaataaaagcccgaatgataatgctatttatcaggctattcgtttaaaaaacgatatgaccgtactgctaatttcggacaacaaagcgaataaatcgctaatgtcattagcactacctatcggctctatggaagatcccattcagcaacaaggcttggcacactacctagaacatatgatcctcatggggtctaaacagtttccagagactaatagtctagatcgctttttaacggaaaatggcggttataacaatgcctcgactacggcagatcgtactgcttattacttagaagtgaataataatgcgtttgatgaagcggttgctcgtttagcggacgcttttgcacaacctctcctgtcagaaagtaatgccaaacgagaagtgaatgcggtaaatgccgaaatggttcgtgcaaaatcaagcgatggtcatttattgaatagcgtcaatttggcgaccgctaaccctgtacaccctattaccaaatttgcggtgggcaataaggaaacgctttcggataaaccaaacagcaaattacaaacggagttagaacaattttaccaacgctactattcagcaaatttagtcaaagcggttttatattcgaatcaacctatcgagcaacttgctgcattagctgatcgtaccttaggtaaaatgccaaataaaaatattgctgccccgagtgtagatgtgccatttttccgtgcggaagataaaggtgtcgttattcattacaaaccggtacaaccgactaaaatgttggcggtttcatttgatgtaccgaatgatgaagcacaatttgcccacaaaaccggcgattatttagcttatattcttaacaataataccgatggcactttatctgactacttaatcaaacaagggttatcagatagtggtattgctgcacaagcaacaccaaatgtcagccgtaatcgtggtactttcaccatttatgttgctttaaccgacaaaggtttgactgaaaaagataagatcatttctttgatttttcagcaaatcgaacaagtgaaacaaagcggtattcaagaaagttacttcaatgaagttcgagaaagcttaaagcaggatttccaacatttacaggtggaaaaaagcggtacttatatcgaatcattagctgagcaaatgttacattatccattggagcatattttagatgcgggctttattgttgatacgatggataaacaagcaatcaaagccaaactggctgagatgacattagacaatgcccgtattttgctggttgatgaaaaagcgcataccgataaaaaatcgccttactttgaggccaattatgcaattgcaaaaattagtgacgaacaacgaaaaaaatggttggatttcagtcataacccgacattaaaactacctgaattaaatccttatttcgccactgatttttctctgattcagccaatcggcgatcgccaagtgcctaaagcgttggtaagtacagcaggaaaagcaatttatgccatgccgagccaatattttgccaacgatccgaaagcgattgtatcgatgagtttctcgatcatgccgaaaacggatgatttaaaagaagcggtaagcgccacgctgttaggttatatgaatagccttgcgcaaacgaaattagcgttccaaacagcagttgccggtatgcaagcagcgattactacttatccgaacggactttcggttgaagcgacaggctacacacagcatttagcgaaattaatccaagactcgctgaatcaattcaaaacttttgaattaacggaagacttcttagcacaagccaaacaacgtgcattcgaagcactagacggtcaacgcaaagaaagtagcttaacacaagcgaaccaagctattgccaactttgccagctacccttattttgaagaagataaacaacgcaaagcactaaccgacactactttggcagatgtaaaagcgatgcgagatagattgttaacaaaatcaaccggattaggcgtactgtcagtgggcaacctcaacgataaacaggttgaagatttagtcagtgacataaaaggcattgttaaaagtagtgaggtggagcgaggtaaagcacgttatttagatctgaatgacagcaaccgcaaactcaactatgtacaaaccgtaccgcatgaggacaatgcactaagcatcacttatcttgcaaaaggctatggcgaattagaaggttcggctcgagctaatttattgcgtgatattatcgggcgctggtatttcgatgatttacgtacccaaaaacaattaggctacgtggtctatgcaaccaatactaaacttggtaaaactgccggtatgcgctttatggttcaaagcccgaatacaacaccggcaggcattatgcagcataaccaacgcttttttgcagaaagtttaacaaaattgaccgctttatcagagcaggaatttgtgaaatatcgtgatagtttaattgagaaattacagcgtaagccggaatcgttaaaccaagagttttcacagttcacgtttgactttaatcgccgcaatgaccagttcaaccaacgtatgaaaatgatcgaagcagtaaaacagcttactcaacaagatattgtggacttttataaacacacggtgatagagcagcaaggcttttcatttatcagccaagcgttaggcacgaaagcgaaagctgaagatgcagtgaaactagcgggctatgaaaaagtggaaagtattgaacaaatccaaaaacaattcccggtgaaatactattaaatcaccatctacaagcggttaaaaaagacctaaattttactattgtagaaaaacaaaaggcttagcaaattcgctaagccttttttaatgtttagtttttacctaagttcgagaagaagtttttcacactatctaaaaaaccttcttgctgcggacgatgctggcttttaccttctaaactttcttccagtttacgtaataagtctttttgctcgtcatttaacgcaaccggtgtttccaccactactttgcaaattaaatcacctgcataaccgccacgtggacttgttacgcccttacctctcactcggaataatttgccggtttgggtttctgccggaattttcagttttaatttaccatcaagcgttggtacttcaatctcacctcctaatgccgccatcgtaaagctgattggtacttcgcagtaaaggtttgaaccatcacgctcaaaaatatcgtgctcacgaacgtgaatcactacatataaatcacctgccggcgcaccgttctcgcctgctgcaccttcgccggataaacgaagctggttaccggtgtccacacctgccggaatggttaccgataagtttttcgctttctgaacacgcccgtcaccatggcaagatttgcaaggtttttcgattttcttaccgcttccatgacagctcggacaaaccgcttccgtcacaaaaaaaccttgctgacggcggattctgcccgaaccgtgacagtgcgaacaggtttccactttcgaacctttttccgcacccgaaccgtggcaggcatcacattccgctaatgttgagatacgaatatcttttttacagcctttaaccgcttcttctagtgagatttcaatgtcgtaacgtaaatcatcgccacgaacgacacgattacgacgtccaccgccgccaaaaccgccaccgaacatttcgctaaagatgtcttcaaagccaccgaaaccgcctccgccgaagccaccgccaaatccgccagcaccaccgccttgttcaaaagcagcatgaccgtattgatcgtatgcggcacgtttttcagcatcgcctaacacttcataggcttcgttgatttctttaaatttttcttctgcgtctttactgccttggtttttatccgggtggtgtttagatgctaaacgtttataagcacgtttaatatcgttctcactcgcccctttctgtaagccaaggacttcgtagtaatctttttttgccatagtgtttcgtttgtaaaattttacggaaatttgaccgcctgtcataaactcccctctttagcaaagaggggggacttgttagatacaccaaaagggcgtgttaccacgccctttgattttacgatttgagcgtaaaagattatttattatctttcacttcttcaaattcagcatccactacgccgtcatcttttgcagactgttgcggttgttcgcctgcttgtgctttagcctgagccgcttgcattaaaggttcggatgctttaattaacgcttcggttttcgcatcgatttccgctttatcatcgcctttcgccgctttttctaagtctgcgatcgccgcttcgattttcgctttatcgtctgcatttaacgctgaacctgtttcttcgatttgtttgcgagtagcgtgtgcgataccgtctgcttggttacgtgcttgaactaactcttcgaattttttatccgcttctgcgtttgcttccgcatcacgaaccatttgttcgatttcttcgtcagataaacctgaagacgcttggatacgaatttgttgctctttacctgtgttcttatctttcgcagatacgttgattacaccgttcgcatcgatatcaaaagttacttcgatttgcggcataccacgtggtgctgggttaataccttcaaggttgaattgacctaaagatttgttcgcagacgcttgtttacgttcaccttgtaatacgtggattgttaccgctgattggttgtcttccgcagttgagaacacttgtgatttcttcgttggaatcgtagtgtttttctcgattaacaccgtcatcacgccgcccatggtttcgatacctaaagataatggcgtaacgtctaataaaagaacgtcttttacatcaccttttaatacaccgccttgaaccgcagcaccgattgctaccgcttcatctgggttcacgtctttacgagcttctttaccgaagaattcagccactttttgttgtactaacggcatacgtgtttgaccaccaacgaggataatgtcgttgatttcattcactgatttacctgcgtcttttaatacggttttaagtgactcgattgagcttgctactaaatcttctactaaagcttctaatttcgcacgggttacgttgatcgctaagtgtttaggacctgttgcatccgctgtgatatacggaagatttacttcagtagattgtgctgaagaaagttcgattttcgctttttccgccgcttctttcacacgttgtaatgccattgggtcgttgcgtaaatcaacaccttgttcttttttgaactcgtcaatgatgtagtcaattacacggttatcgaagtcttcaccacctaagtgagtgttaccaccagttgctaatacttcgaatgtttgttcaccatcaaagttatcgatttcgatgattgagatatcaaatgtaccaccacctaagtcgtaaactgcgatcacttggttttctttagttgaacctaaaccgaacgctaacgctgccgctgtcggttcgttgatgatacgtttaacatctaaacctgcgatacgacctgcatcaattgtcgcttgacgttgtgcatcgttaaagtatgccggtacagtgataaccgcttcagttaccgcttcaccaaggaaatcttccgctgtttttttcatttttttcaacacttctgctgaaatttgcggtggtgctaatttgtcaccttttacgtttacccacgcatcgccgttgtcagcacgtgtgatttcgaaaggcataattttaatatcacgttgtacttcttcactttcaaaacgacgaccgattaaacgtttgattgcaaataatgtatttttcgggtttgtaatcgcctgacgttttgccggttgaccaactaacgtttcgttatccgtataagcaatgattgacggagttgtacgtgcaccttccgcattctcgattacacgtgctttgtcaccgtccattaccgctacacaagagtttgttgtacctaagtcaataccaatgattttacccattttaaaattcctctgaatataaatttgtttgattacgttttcgtaacgttacccacaagatggtgttctttcacaacttttcaaggctaaatttgaaattttcttgcaagtatttttgaaaaaagaaacgggacgttcaacgttcccgttcagacgaaacaataaatagggatgaaaatgaaatgatcaagggcgtaaaataaatttttgtaagatttttgaataaaacggacaaaaaagcccgtccatattgaacgggctggctttccgagcattaaagaccttttaatctttggtaaatttcggcaaattttgaccgcttgtcttggtattcggcaaacttgctgcgattcggttggtaaatcgcttcaagcggtaacggctgacagaaattagcaatatcttcatgcggatttaaggcaatctgtgccaatttcgccgccccaagtgcagggccgacatcgccaccggtacgatattcaaaggttcttccggtaatatccgccaataattggcgccaataagcactttttgctccgccaccgatcagagcgatattatccgccttcacaccggtttcgtgtaacacgtcaatgccgtccgctaatgcaaaactgaccccttccaccgcagctcttgccatggtaatcgggttatcgttatgagttaagccccaaaacacgcctttggcataagggtcgttatgcggcgtacgttcgccggataaataaggtaggaaaatcgcatcgctcgcttggctgcagttttcgacttgttggaatagcgttttaatatcactaataccggtaactttttgggcaaaatcgaccgctgatgcggcactgagcatgaccgacatcaaatgccagcgatccggtaaggcatggcagaaactgtgtaccgctttttgcggattagcactaaatttatcggttacaacaaaatacacccctgacgtaccgagcgataacatcgcttgtccggcttggtaaagcccgataccgattgcaccggcggcattatcgccccccccggcaattaccggaacggtatttaacttccagtttttggccaattcggggcgtaagtaaccggtaatttggttgccttcaaacagtttaggcatattactaacatcaagtccgcacgcatttaataacgcctgattccactctctcttaccgacatccagccacattgtgccggaagcatccgacatatcggaggcatattcgccggtcatacgtaaacgtaaataatctttcggcaataagactttatccacttgttcggcgatttgtggctgatgtttatctacccattttaatttcggtgcggtaaagcccggcatcatcagattaccggtaatttcacggctattcggcactaatgattccaattcggcacattccgcaaagctacgcccgtcattccacaaaattgccggactcaatacttgatcatgtttatccaataaagtcgcaccgtgcatttggccggttaagccgatcgctttcacagcagttaaatcttgctgttgtgccaaagcgagcatggctaaattggttgcatgccaccagtcttccggattttgttccgaccaaagcggatgagggcgagaaataggtaaagattgatgtgtggttgcgatgatttcttgagattcattgagtaaaacgactttaacgcctgatgtgcctaaatcaattccgatatacataaagcctcctgataccttcttactctctccctcttgcgggagagagacagtcgaaggattcgttcagaatccgcagacagagagaggggaaagatattcatttcccctctccctccaaaaatcctacggattttctcctccctctcccgtaaagggagagggtaagttctgaattaacgataaatataattattcactaaattttctaagtattcttgctgacctgaaaccggtttcggatcaagtgctttgctttcaacgattttcgctaaatcttcaaggcttgctttaccggcaagaatttgctgacctaaatcgccgttccagcctgcgtaacgttgatcaacgataccttgtaaggtttggtcttcaatcattttcgttgcacgttttaatgaaagggcaagtacgtcaatcgcaccgatatggccgtggaataaatcatacggatctgtactttgacggcggattttcgcatcaaagttgaagccaccggtagtaaagccgcctgcttttaagatttcatacatcacaagcgtattttcttccacgctgttcgggaattggtctgtatcccaacctaattgtggatcgccgcggttagcatcaatcgaaccaaagatatctaatgctgccgcagttgcaatttcgtgttggaaagtatgaccagctaaagttgcgtggtttgcttcaatgttcactttgatttctttttctaaaccgaattgttttaagaagccgtaaaccgttgctacgtcatagtcatattggtgtttagtcggttcttgcggtttcggttcgattaataacgtaccgttaaagccgattttatgtttatgttccaccaccatttgcataaagcgaccgatttgttcacgttcacgttttaaatcggtatttaataaagtttcataaccttcacgaccgccccataacacatagttctcaccgcctaagcgtttggttgcgttcatcgcattgaatacttgcgatgctgcccaagagaacacttcaggattcggattggttgatgcgccggacatataacgagggttagtaaagcagtttgctgtaccccataataatttcacgccggtttccgcttgttttttctcaagaatatccaccatggtatggaaattatgtacatattctttatatgaattaccttccggtgcaatgtctacatcgtggaagcaatagtaaggaatccctaatttttggaagaattcaaaggcaatttccgctttttgttttgcgccttcgagtaaatcacctgttttttgccaactacgatctaaagaacctacaccgaacatatcattccccgtccagcagaaagtatgccaataacatactgctaaacgtaaatgttccgccatggttttgcctaaaatcacttcgttcggattgtaatgtttaaaagcaaaaggattggttgagttagcaccttcatattttactttttcaattttatcgaaatagttagacataattaattctcctatgaatcaatggattttgaaaacgagagcataatgatgaaaattaaaaagcggttcaattacgttattttgttttgctattttgataattggttattgtggcggcgatcacaaaagcgaaaaaacgtaatgacattatgaaatctgataattgcaccttatttgaaatctaagcaaactgcgcacgaagcaataccgcttattttttatgcttaaaccaatcagaggtgttctatgaaacttaaatctaagttattagcagtagccgcagcaaccttattagctttaggtcaaaccgccattgccaaagatctaaaaattggtatgtctattgacgatcttcgtttagaacgttggcaaaaagaccgagatatctttgtaaaaaaagcggaatcattgggtgcaaaagtgtttgtgcaatccgcaaatggtgatgcaaccgcacaaatttctcaaattgagaatatgttaaataaagatattgatgtattagtgattattccgtttaacggtgaagtgctttctaacgttatttccgaagcgaaaaaagaaggcgtaaaagtattagcttacgaccgcttaattaataatgcggatattgatttctacgtatcctttgataatgaaaaagtaggcgaattacaagcacaaagtattattgagaaaaaaccggaaggtaattatttcttaatgggtggttctccggtagataacaatgcgaaattgttccgtaaaggtcaaatgaaagttctacaaccgcatattgatagtggcaaaatcaaagtagtgggagaccaatgggtagattcatggcttgcggaaaaagccttacaaattatggaaaatgctttaactgctaacaaaaacaacattgatgcagtggttgcttccaacgatgcaacggcaggtggtgcaatccaagcacttagcgcgcaaggtctggcgggtaaagtagcgatttccggtcaagatgcagacatcgcagggatcaaacgtattattgacggttcacaaacaatgaccgtatataaaccgattacaaaccttgctgataaagctgcagaactttccgttgctttaggtaaagacgagaaggtggaatcaaattcaaccctaaataatggcgtgaaagatgtaccggcttacttactagaaccagtagttgtgactaaagataatattgatagtactgtaattaaagatggtttccacaccaaagaagccgtatatggcaaataattagctcgaaaatcctgtgcggtagtcataccgcacattttttaactagaggaaaggattatggctcaattattagaaatgaaaaatattaccaagcggtttggtgatgtcgttgcccttaacaatatttctatctcattagaatccggtgaggtactttctctctgtggtgaaaacggttcaggcaaatcgaccttaatgaaagtgttatgcggcatttatccatatggtgattatgaaggtgagatttatttctcaggcgagaaactcaccgcaaaaaatatcaaagataccgaagaaaaaggcatttccattatccaccaagaattgactctcgtgaaaaatatgaccgtgcttgaaaatatgtttttaggcaacgagatgaaaaactatggaataacaaacgataatgaaatgtacctgcgttgtaagaccttactggaacaggtacaactgaatatcgacccgaacaccaaagtttccgagttaggtttaggtcaacaacaattagttgaaattgccaaagcgttaaataaacaagtgcgcttattaattttagacgaaccaaccgcatctttaaccgaaacagaaacagcaattctgctcaatcttatcaaggacttacaagtacataatattgcgtgcgtctatatttcgcacaaactcaatgaagtcaaagcaatttcagacaatatctgtgtgattcgtgatggcgaatatatcggcactcgcccagcaaaaggtatgagtgaagatgacattattaccatgatggtcggccgtgaaattacttcactttatccacacgaaccgcacgatattggtgaggaaattttacgagtggaaaatatcaccgcttggcatccaaccaatacacatataaaacgggtagataatgctagtttttcactacgtcgtggtgaaatcttaggtgttgccggcttagtcggttcaggccgaactgaaatggcgcaatgtattttcggttcttatttaggtaaataccaaggtgatatttatgtagaaggacaaaaagtccaaatcaaaaattgtgctcaagcgattgagaaaaatattgtaatggtgccggaagatcgtaaaaaacacggaattgtgccaattatgggtgtcggtaaaaacatcacattagccgcattaccgcagttctgtttcggtaaaaaagtgattaatgaaccgttagaagaaaccattatcaaccaatctatcgccaaacttacggtgaaaacttcttcaccagatcttgccatagggcgtttaagcggcggtaaccaacaaaaagcaatcttagcgaaatgcctgttgctcaatcctaaaattctgattttagatgaaccgacccgaggcattgacgttggggcaaaatacgaaatctacaaactcatcaaccaacttgcccaacaaggaatggcagtgattgttatctcatcagaattaccggaagtgctgggtatcagtgatcgtgtgcttgtcatgcaccaaggcaaaatcaaagcggatttaatcaatcataatttaacccaagaacaagtgatggaagccgccctcaaggagtaacctatgaacaagttaaaatcaattaatttacaagtttatattatgttgattgccattgtcgtgattatggcattcttctctgttgccactgacggggcttatgtaagtgcgagaaatatctctaatttactccgccagacttctatcacggggattctcgctatcggtatggtgtttgtgattatctcggcagaaattgatttatcagtcggttcgatgatgggcttactcggcggctttgccgcaattactaatgtttggtggggctggccgctttccgtcacaatcattgttacccttgcactcggtttattattaggtgcttggaacggttggtgggttgcttaccaaaaagtaccatctttcattgtcacgctcgccggtatgcttgctttccgtggcgtacttatcggcttaaccaacggtacaaccgtttccccaatcagccaagatatgactgtaattggtcaaggttatcttcctgatacggtggggatgattttaggcacaatcggtatgttcctattcatcgcttggggcagttaccaacgtaaagcacgtcaaaatcttaatttaaatgtgccaactatgggcaaagaaacgatgaaatacggcttggtagcaattgtagtacttggcgcaatttatctacttaacgactaccgtggcgtaccattcccagtattattactcgctttactcacaattgccggtacatttatcgcacgcaaaaccgcattcggtcgccatatctatgcgattggcgggaatattgatgctgcccgtttatccgggattgcggttgagaaagtgaaattaatgatttttgcaatcaacgggttattagtcggtatcgccggtttgattttaagttctcgtttaggtgcaggtgcgccgtcagccggacaaaatgccgaacttgatgcaattgcagcttgtgtcatcggcggtgcaagtttagccggtggtatcggctctatctatggtgtagtgatcggtgctttcattatcgccttactcgacaacggtatgagtatgttagacgttccaactttctggcaatacattgtaaaaggcgccatcttattgcttgcagtctgggcagatagtatgagtaagaaaaaagcctaatttggttacacaacaagcggtcaaattcttgcaaaattttgcagaaatatgaccgcttatcataaacagttttcaaaaagcatatctttttaaagagatatgctttttttatatcctattgatttacttatttttttattgttttgtggcagagatcacaaaagcgaaaaaacgtaatggcataaaaaagaatgataattgaagtacaaatttttttacttgaaaataagcttgtcaatttaaccaaaaggagttcattatgaacatggcaactgataaaagtaacgagtttgctaaactcagcacctttgagcgtattgcgtatggtagcggtgatttagcgcaaaatttggtatttggtacggttggcggtttcttactgacttaccttactacggtaaacggtatttctgccgcagcaggtgcaacaatcttcttaattgtgaaatggagtaatgtgttttgggatccttgggttggggcgtttattgataaaagcaaaccgaccaaacagggtaaatatcgtccttatttactgaaattcggcatcccgcttgttattttggcctccttacttttcttaccgcttgaatccgttcgtggttctgtgatttacgctttcctttcttactttgctaccgcaatgatttattcttttgtgaatattccttatggttcgctttccgcttctttaacccgtgatacggaagaaatcgctaaactcaccacaacccgtatgaccatggcaaatattgccaatttattggtttataccttattccctctttttgtccaattactcgcccctcatgcggaacttaaaaataccggctttttcggtatcgagttgcaattaggcgattatatgtctgcagcggcaggcccagcgtggtttaaagtctatgcggtttatatggtggttggctttgcagcattaatgttttcttatgcaggaatcaaagaacgcattattccaactgaagaagaaactcaaaaagtaaaatattccgaccttatcatcgaattaaaacgtaaccgcccactacaaattcttggtctgttctttttaatcggttttacctttatgtttttcggaaataccgtatggccgttctacttaaaatataacattggtcattccgaatggattgcttctatcggtttattaggttcaattccgggtattttccttgtgttcctatggcctaaattacgccgtagcatcggtaaaaagaatttcttccacttattccttggtattttcgtattaggacaactttgcttatgggtatggcaatttgacgctttcaaagattctccaacccttggttatatcggccgtttcttacaacaatggggcttaacttctgcgaccggttttatgtgggcgttagtgccagaagtgattaccttcggtgaattcaaatcgaaaaaacgtgttgccggtattatcaatgcgttaatgggcttgttcttcaaaatcggcttggcgttaggcggtattatccccggctacattaatgctgtttatggttttgacggttcattagccgtacaaaccggcgatgcgttatccggtattaatatttcgatgatttgggcaccgattgtattagcgattgtcgcgagtatcgtgatgagtcgttacccgctcagtgataccgatattgatcacatcaatgaaaaaattacctcttattctaaaaaataatccgatttaataataggagtctattatgcaaattcaaaatccaattctaccgggctttaacccagacccgtcaattgtgcgagtagaagatacttattatattgcctcttcaacttttgaatggttccccggtgtacgaattcacgcttctaaagatcttgtgcactggaacttaatcaaaaatgtgttggatacgacaaccttattagatatgaaaggtaatccatcttcgggggggatttgggcacctgatctttcctacgctgatgggcaattctggttagtttataccgatgtgaaagtggtggacggtgctttcaaagacatgaccaattacttaacgacggcgaaagatattcaaggcccgtggtctgcaccgattaaactcaatggtgttggttttgatgcctcactgttccacgatgatgatggcaaaaaataccttgtgcaacaaacttgggatcatcgtgaatatcatcatccgtttgatggtattaccctgactgaattcgatgtttcaacgatgaagctgaaaccggaaacccaacgtactatttttgaaggtacggaagtgaaattggttgaaggtccgcatatttataaaatcaatggcgaatattatctgtttgccgcagaaggcggtacggtctttactcaccaagaagtcgtcgctcgctcgaaaacgcttgatgcgcattcgttccaacttgcgccaaatacgccgtttattaccaactttgatacgccgaattcttatctacaaaaacaagggcatggatcgttggtacaaacaccaagcggcgaatggtattactcctcattaactgcacgtccgtggaatcatgcgactgaatcagcaactgatccgcgaggctggtccacattaggacgtgaaacctcgattcaaaaagttgaatttgatcaagacggctggccttatattgttggtgggcacggcgggcgtacctttgtcgaagcaccgaaagatgcgatttttaccgaagcaccggcagatcactcacaacacgatgaatttgacagccctacactggatatgaattggaataccttacgtgttccgtttagccctcaaatgggagaaaccggtaatggcgtattgaaattaattggacgtggttcgcttgccaatacacacgatttatcgctaatcgctcgccgttggcaggccttctattttgatgcggaaacgaaagtgaaatttacgccgttttcttatcaatctatggctggtttaaccaactattacaaccattcacattggtcttggattttcatcaccaaaaacgaccaaggtcagcaagtgattgaagtggcggaaaacaaaggcggcgcacgtaatggacaatatacttcgtatctgaaagataatgcgattgtgattccggacggtacggaatacgtctggtttaaaaccaaagtacgtaaagaatcctatacctacgaatattcatttgatggcaaacaatggcatagcattccagtagtgttagacgctgccgtattatcggatgattacgtgttgcgtagctacggcggctttttcaccggggcttttgtcggcttagctgcggttgattattcaggttatgaatccaccgctgaatttagttactttgactataaagaactgggcgacaaacaacttgctgacggctcgttctcttggcaaaaatccgaaagccgtttcggctagtcttttatgccgcccaaacggtggctcatcttctcaaacctcgcattgtaagatatgcgaggtttgcaaaatttcactgaaatttgaccgcttgtcattcctcttttgcgtataaaaataatttatcttatagtaacacttcaaaggagggacgaatgtcagatcaaaacttcaaaattgcactgctttttaatgcaaacaaaatttatgatcgccgagtgattgaagggatcgggcagtatatccaagcatcgcaatgtacttggaatatctttatgcaagatgacttcacctatcataaaaaagatattgaaggcttattaatcgacgggattattgccgattttgatgacccggaaaccgccgcattattaggcgaattaaatatcccggtcattgcagttggcggctcatatcaaaatagcgctttttatccgaaagtaccttatgttgcaaccgataattatgctttggtcgaaatggcgtttttacatttaaaacaaaaaggcattaatcaatttgcgttttatggcattccaagtgatgaacaaaaacattggtcggtagaacgtaaaaatgccttcttagatttaatggaaaaatacgaacatcaagccaatatttatttaggtcaccaagtcaattcgaaaaactggctagaagcacaatccgctttaagcgaatggttagtctctttaccggctcaaaccggcattattgcggtaaccgatgccagagccagacatttattgcaagcctgtgaatatttaaatattgcagtaccggaacaagtttcggtcattggtattgacaatgaagagctaattcagcatctatctcgcgtctcactttcgtctgtggtacaaggtacaaagcaaatcggttaccaagcggcaaaaatgctacatcatttacttgaaggtaaaaaattaggcctctctcccgtattaattccgccgctacgcgtagaacaacgccgttccaccgatttccacgcattccaagatccgtttgtcattcaagcaatgcactatattcatcataacgcctgcaaagggatcaaaaccgaacaagttctcgatcatttaagaatttcacgttccaatttggaacaacgttttaaaaacgaattaaataagactatccatcaagtgattcatgaagaaaaactgaatcgtgcaaaatacatgctacaatttactgatatttcgatccaagaaatttcagaaatttgcggttatccttctttaccctatttctattcggtatttaaaaaggaatatttagataccccgaaagcatttagacaatcccatcacaaaattttagttgagtaaggttatggcaaaaaaatttttattaagtctggcaaccctttcacttgggctagccggttgtacaacatatcaatctaccttaacggaaggtgtcgacaacaccgttgcaccgcaacaagacttttatcgttttgtaaatggtaaatggcttgcaaaagcgcaaattccggcagacagaacctcatggggaacgttagcggaattaaatgaattgaatgaacaacgttcgattaaattcttacaagcggtcatttccgagccaaaatttgcaaatgatgagaaagcccaacgtttaaaagcagtatatgaaacctatacggatttaaatgcgcgtgaacaagcgggacttactccgattgcaaaagatattgagaaaatcaaacagatcaacacttttgccgatttaaaacgctatttgattgaagaaaccaaagccggtaacgaagtcttattcggttggtcggtgttcgctcacttaaaaaattcccgccaaaacggtgtctatttaagcaatgtggatttaggtttaagtaacgattatttccaaaaagatacgccggaaaaccgcgccaccttaaaactttatcaagattatatcgaacaggttttaggttatgcgaacgtaacaaacccagcggcgaaggctaaagcgattgttgcttacgaaaaagcgattgcgaaaacattatttaccaatgaagaagatcgtgacgtccaaaaacgctacaacccaaccaatatggcacagctgaaaaaactgagtaaaaacattgatttagctcagtatttgaaagcggttggcgtggaaaccaatgaggtaattttatatgagcctcgttatttccaagcgttggatcagcttatcaatccgcaaaacttagcggtaattaaagactacttattattccgtaccttatcggataacgccccttacttaaacaaagaaatggatgatgttcgttttgagttctacggcaaaaaattagtaggtcagaaacagcaacgcccgttagaaaaacgtgctttagccacgataaatagctggctcggacaagaatttgcacagttttatgtggcggaattcttcccgcaagcggcaaaaaacgatgtactggaaatggcgcaatatttagttaaagcctatcatcatcgtattgataacttagcttggatgtcggcggaaaccaaacaaaaagcgaaagctaaattagataagtttattgtcgaagtcggttatccgaacaaatggcgcgactacagtaacttaacccttaaaaccgtggcgcaaggtggtacgctctacgccaatatgcaacaaattgccaaatggagttacgactataatcttgccaaagtcggcaaaccggttgatttaaatgaatggggaatgttaccgcaagtggtcaacgcttcctatagcccgttaatgaaccgtattgtgtttccggctggtattttacaagcgccgctttatagccaacaagcggatccggcggttaatttcggcgcaatcggggcgattatcggtcatgaaatcacccacggttttgacgatagcggttcaaagtttgacggcgaaggcaatctaaaagattggtggacagcggacgatcgcaaaaaattcgaagccttagcggataaattggtcgcacaattcgatcagtttgaagtcgcaccgaaagtatttgtcaacgggcgtttcaccttgggtgaaaatattgccgatttaggcggcttgagtatcgcttacgatgcactgaaactatacgaacaagatcacggcagcagcccgacgattgaaaactttaccagcgatcaacgtttctttatgagctggacacgttcgtggcgtcataaagcgaccgtgcaagcgcttactcaccaagtgaaaagtgatccgcacgcaccggggcaattccgcgcttatgcgccggtactgaatatcagcggcttccaccgtgcattcggtactaaagccggcgataaaatgtatcgcaatgaggcggagcgtattcgtatctggtaatcgcaagcggtcgaattttgataaaattttgcaaaaaagcagccaaatccgaccgcttgttttaaggaactgttatggcattacaacgttgcccagagtgtcgacacaaaattagcgagagtgttatcacctgcccgcattgcggcttttcatttaaagaagcggacttagccgtttatcgtgaaaaattggaacaacgccgcttacataatcaagcgctcaaccgccaaaatgcgaaagtacagctgttttggctatgcgtctttgcggttgttattacgatcgcttggttgatcaattaagtgcagggcataacttatgccctgtttttctacttacgatttattcacactgatacatagcaaaatctttgctcatattccgaaaacgcataaaaacaccaaattttttccatactcacctgtaattcatttataaactttgatctaatcccatattttaaatttgatattccattctgctctaaactatgccctgttagtatttttaagaataataaaatcgctctataaatacgccattgaagtattttttaaacgtggggattttatatgagcgttgagaataaaggcgaattacctttatccgctgaaaccatacaagttttggcaaatttagatcacttacaactggcatggctatctggatacgcttgggcgaaggcgcaaggcacaaatagtattggtgagaattttgcaaaaaatccgtcaaatttgaccgctttggtgccggtagaaccgcttaaagtgacggtactttccgcttcacaaaccggtaatgcgaaatccgttgccgataaactcgccgaacgcttaaccgctgaagggataaatgtgactcgcacttcattaaaagattataaggcaaaaaatattgccgatgagcagatcgtcttattagttacctcaacgcagggcgaaggcgaagcaccggaagaaggcgtagtgctgttaaagttactcaatggtaaaaaagcaccgaaattagaccgcttgcaatttgccgtattaggtttaggcgattcttcttatccgaacttctgccaagctggtaaagattttgatcagcgtttttatgatttaggtgcaacgcgtttattcgaacgtgtcgatgcagatttagacttccaagcaaccgccggtcaatggatcaatgagattgtcgagatcattaaagccaaaaataacgaaagtgctgcggttaatttagcgccaaattcttcccaaactcccgctgcaactagtcaatcaaaatacaataaagcgaatccatttccggcaacgcttatcaccaaccaacgtatcacagcaaaagatgcggaaaaagatgtacgtcatttagaatttgatttaagcggatccgatttgtgctaccaatccggcgatgttttgggtgtttactttgaaaatgacccaacgttagtcaatgaaatcctaactgctctcagtttatccgcagaagaacaagtgactctgcaagataaaacactgccactagccaccgctttacaaacacaatttgagcttacgcaaaacacagcggctttcgtcaagaattatgcagcgctcgctaatcatacagaactcaatgcgattgtaacggacaacgagcaattgcaaaattttgtgcaaaatacaccgcttgttgatgttatcaatagctatccgacaactctatcggcagatcagttgcttgccttactgcgcccactaacccctcgtttatattcgattgcctccgcacagtcggaagtcggtgaagaagtacatctcagtgttggcgttgtccgttacgactataacggcaaagcacgtgccggcggtgcttccagttatcttgctgatcgtgttgaagaagacgggcaagtacggatctttattgaacacaatgacaacttcaaattgccgcaagattcctctaaaccgatcattatgattggttccggtaccggcattgcgccattcagatcctttgtacaacaacgtgctgctgatgaagcagaaggcaaaaactggctgatttttggtaatcaacatttcgcctccgatttcctatatcaaaccgaatggcaacaatttgctaaagacggcttcctacataaatacagctttgcatggtcacgagatcaagagcaaaaaatttatgtacaagacaaaatccgtgaagaagccgagacattatggcaatggctacaacaaggtgcttatctctatgtgtgcggcgatgctagccgtatggcgaaagacgttaatcaagccttattagatgtgattgcacagcaaggcaatctaaatgcggatgaagcggaagaatatttagatcacttacgtgaagaaaaacgttatcaacgtgatgtttattaaaaatcagtggaatttaggagtgagaaaatgagtgataaaaaaaccaaaggcttagaatggcaagaaaaaccgttatctgacaatgagcgtttaaaaactgacagtaatttcttacgtggcacgattttagatgatttaaaagacggcttaaccggcggttttaaaggcgataatttccaactgattcgctttcacgggatgtatgagcaagatgaccgtgatattcgtgccgagcgtttagaagaaaaacttgagccgttaaaatttatgttacttcgctgccgtttacccggcggtattatcaaaccttatcaatggattgagattgataaattcgctcgcgaacacacccgttaccaatccattcgcttgaccaatcgccaaacattccaatatcacggcgtaccaaaaggcaaattacaaccgatgcaccgtttgttacatagtatcggtttggattcaattgcgaccgctgccgatatgaatcgtaacgtactttgtacttcaaacccgattgaaagcgaattacaccaacaagcttatgagttcgcgaaaaagatttcggaacatctcttgcctcgttctcgtggctatttagatgtttgggtcgatggtaaaaaagtcgaaagctcggacgatttacttaaaattgaagatgaaccgattcttggtaaaacttatcttcctcgtaaatttaaaaccgctgttgctattccaccacttaacgatgtggatgtgtatgccaacgatttgaactttattgcgattcaagatgataacgggcaattatgcggctttaacgtattagttggcggtggattatccttcgaacatggtaacaccaaaacttacccgaatgtggcttattcactcggctttgtaccgttggaacacacacttgctgcagccgaaggcgtagtcaaaactcaacgtgatttcggtaaccgttccgaccgtaaaaatgctcgtgtacgttataccgtacaaaatatgacgcttgacggctttagagcggaagtagaacgttgtatgaacattaaattcgaaccgacacgtccgtatgaattcactgaacgaggcgatcgtatcggctgggttaaaggtatcgataataactggcacttaaccttattcattgaaagtggtcgtattaccgataaacctgaaaaacctttaatgacaggcgtgctagaactcgctaaagtacataaaggtgattttcgtatcacagctaatcaaaatctgattgtggcgaatgtagcggaacaagataaagcacaaattgaggcgattgctcgccaatatggattaattcaagaaatttcgaaattgcgtgaaaatgcgatgtcttgcgtatccttgccgacttgcccattggcaatggcggaagcagaacgggtattaccggactttattagcgaactcgataaagtgctaagtaaacaccatattgccgatgaaagcattattactcgtattacaggttgcccaaatggctgcgggcgagcaatgctggcagaaatcggtttagtcggtaaagcaattggacgttataacctacatatcggcggcgatcgtgccggtttacgtattcctcgcttatataaggaaaatattaccttaccggaaatcgtcaatgaaattgaccaattagttgcacgctgggcaacggaacgtcaaaccaacgaagctttcggcgattttgtgattcgctctaatatcattgccccggttgtcaatgctcatattgatttctgggatgcaacgaaaattattccaacaactataatctaaacctcgtggtataacacaccaccttgcggttaatctgtaaagtagggcagattgaccgctttttttatgccgtacgatattgaattagttcggcccactctaaacgatggaaaaaccaatagcgttgttctatatctaattgattttcacaaccggcaacccacggtttataagcacaattatagtgaataactaacggttgctgctcaccaatatccataatgtcaggatacagttcaaaatgatttaattgctgtaagtaatagtaattaccaaattgataattatatttccgatgtaaaggtaaccaagtatgcataaatagcatatttaaaatatcttgatcgcctaaatcaccaccttgacgattatattgttcaatggtttccatcaacttctgctgtaaatcaggaatttctcgccatcttttattattaactaataacactcccgaattaaagtaaggatagcagtccaatatcgaatgcttaaaataacggctgctcagaatataatcttcaacagcacccagcatgtaatcgctaatatcgtgatcatacagctctcttaaggaaccgtttacaataatatcactatctaaatacagcgccttatccgcatgaataacttgtggaattaagcaacggtagaagctaatctcactaacatgcgcaatagttttcaactgttgaaaaacatcagcctgaaccgatacattagtaatgtcactttgaaaataagctaaatattggtttaaagatttaaaccattcattagaataatctttattaattaaatagaaatggacatttgtatcataaaaacaaatcgacttaattaatgtgatcacttgttctgcatatttgcgatcagctgatagaacaatatgcatcggctcgtaagacataggattcccgttaataaaataaagactaaataatatgatagcatgaaatcacatgtcccgaacaagcggtcaaatttcccttattttctgcaaattgcagcggtggaggctatttgaagaagggaaaagggaaaagagaaaagagaaaggagaagatgaataaagataaaaatgaggttgagactgagattgaggatgaggctgaagataaaacaacaccgttgtccgttgtaaaaaagcaaaaaccccgtggttatcgctaaccacagggtccctaaattcaatctggcgatgccctactctcacatggggaagccccacactaccatcggcgttactgcgttttacttctgagttcggaatggagtcaggtagagccacagcactctggtcgccagaatattctgttgatgtcttttgtcttctttctttgtctttgttctttcttcttaaattcgaaacaagctgctactgagtgtagtgctcaaaaacacttgagcgttgtatagttaagcctctcgggcaattagtatctgttagctcaatggctcacaccacttacacaccagacctatctacgtcgtagtctccaacaacccttaccgacttatagtcggggagaactcatcttgaggcaagtttcgtgcttagatgctttcagcacttatctcttccgcatgtagctacccagcaatgcctctggcgagacaactggaacaccagtgatgcgtccactccggtcctctcgtactaggagcagcccctctcaattctccaacgcccacggcagatagggaccgaactgtctcacgacgttctaaacccagctcgcgtaccactttaaatggcgaacagccatacccttgggacctacttcagccccaggatgtgatgagccgacatcgaggtgccaaacaccgccgtcgatatgaactcttgggcggtatcagcctgttatccccggagtaccttttatccgttgagcgatggcccttccattcagaaccaccggatcactatgacctgctttcgcacctgctcgacttgtctgtctcgcagttaagcttgcttataccattacactaacctcacgatgtccgaccgtgattagcaaaccttcgtgctcctccgttactctttgggaggagaccgccccagtcaaactacccaccagacactgtccgagaccgcgttccgcaatcttcgttagaacatcaaacgttaaagggtggtatttcaaggacgcctccaacaacactggcgtgtcatcttcaaaggctcccacctatcctacacatcaaaattcaatgttcagtgtcaagctatagtaaaggttcacggggtctttccgtctagccgcgggtacaccgcatcttcacggcgatttcaatttcactgagtctcgggtggagacagcctggccatcattatgccattcgtgcaggtcggaacttacccgacaaggaatttcgctaccttaggaccgttatagttacggccgccgtttactggggcttcgatcaggagcttctctttcgataacaccatcaattaaccttccagcaccgggcaggcatcacaccctatacgtccactttcgtgtttgcagagtgctgtgtttttaataaacagttgcagccagctggtatcttcgaccggttcaaccttcgagagtaaatctctacaatctacgccggcgcaccttctcccgaagttacggtgctattttgcctagttccttcacccgagttctctcaagcgcctgagtattctctacctgaccacctgtgtcggtttatagtacggtttagtataacctgaagcttagtggcttttcctggaagcgtggtatcggttacttcatctccgtagagactcgtcatcacttctcggtgttaacggaattccggatttgcctaaaattcccacctaccggcttaaacagacatccaacagtctgataacctaaccttctccgtccccacatcgcagttataccaagtacgggaatattaacccgtttcccatcgactacgcttttcagcctcgccttaggggccgactcaccctgccccgattaacgttggacaggaacccttggtcttccggcgaacgagtttttcactcgttttgtcgttacttatgtcagcattcgcacttctgatacgtccaccaaacttctcaattcagcttcatccgcttacagaacgctcccctacccaacagtctttcgactgatgccgcagcttcggtgactagttttagccccgttacatcttccgcgcaggccgactcgactagtgagctattacgctttctttaaatggtggctgcttctaagccaacatcctagctgtctaagccttcccacttcgtttcccacttaactagtactttgggaccttagctggcggtctgggttgtttccctctccacgatggacgttagcacccaccgtgtgtctcctgagtatcactcttcggtattcgcagtttgcatcgggttggtaatccgggatggacccctagccgaaacagtgctctacccccgaaggtgtccgctcaaggctctacctaaatagatttcggggagaaccagctatctcccggtttgattggcctttcacccccagccacaagtcatccgctaatttttcaacattagtcggttcggtcctccaattagtgttacccaatcttcaacctgcccatggctagatcaccgggtttcgggtctataccttgcaactaaaacgcccagttaagactcggtttcccttcggctcccttattcagttaacctcgctacaaaatataagtcgctgacccattatacaaaaggtacgcagtcaccccacaaagaggctcccactgcttgtacgtacacggtttcaggttctatttcactcccctcactggggttcttttcgcctttccttcacagtactggttcactatcggtcaatcaggagtatttagccttggaggatggtccccccatcttcaaacaggatttctcgtgtcccgccctacttgtcgttagcttagtaccacaatagacacttcgaatacgggactatcaccctttatagtcgagcttcccagctcgttcttctgtgtctactgctatcactaacaggctcttccgctttcgctcgccgctacttacagaatctcggttgatttcttttcctcggggtacttagatgtttcagttctcccggtttgcctttactacctatgtattcagtagtaaatactagattcttcatctagtgggtttccccattcggaaatcttggattaaacgcttcttatcaactcatccaagcttatcgcagattagcacgtccttcttcgcctctgattgccaaggcatccaccgtgtacgcttagtcacttaactatacaacctcaaatgttttcaaatcttattcaaatccattcaatgctgtattttattcaactaaacacttgactgcttttgttcagtcaagatttttttaactactcagactttctttcgaaaatctctcagtttttcagcttgtttccaattttttaaagaacaatttaagacaataatttgacttatcatcatgactaaataaacaaatcttttacttattcacttagtcatgatgattggtggagataagcgggatcgaaccgctgacctcctgcgtgcaaggcaggcgctctcccagctgagctatatccccatacatcatgactgaacataatctcacctttcagttttcactcgtttagagtggtgggtctgagtggacttgaaccaccgacctcacccttatcaggggtgcgctctaaccacctgagctacagacccaaaaggatgccggattatgtccgttttcgtcttctcttctatcaaacaatctgtgtgaacacttgcagtcgcttaattcttggtaaggaggtgatccaaccgcaggttcccctacggttaccttgttacgacttcaccccagtcatgaatcataccgtggtaaacgcccccccgaaggttaagctatctacttctggtacaacccactcccatggtgtgacgggcggtgtgtacaaggcccgggaacgtattcaccgcaacattctgatttgcgattactagcgattccgacttcatggagtcgagttgcagactccaatccggacttagacgtactttgtgagatttgctccatgtcgccatattgcttccctctgtatacgccattgtagcacgtgtgtagccctactcgtaagggccatgatgacttgacgtcatccccaccttcctccagtttatcactggcagtctcctttgagttcccggccaaaccgctggcaacaaaggataagggttgcgctcgttgcgggacttaacccaacatttcacaacacgagctgacgacagccatgcagcacctgtctcatggttcccgaaggcactctcgtatctctacaagattccatggatgtcaagagtaggtaaggttcttcgcgttgcatcgaattaaaccacatgctccaccgcttgtgcgggcccccgtcaattcatttgagttttaaccttgcggccgtactccccaggcggtcgatttatcacgttagcttcgggcaccagacttaaagtccaatccccaaatcgacagcgtttacagcgtggactaccagggtatctaatcctgtttgctccccacgctttcgcacatgagcgtcagtacattcccaaggggctgccttcgccttcggtattcctccacatctctacgcatttcaccgctacacgtggaattctacccctccctaaagtactctagttgaccagtatgaaatgcaattcccaggttaagcccggggctttcacatctcacttaatcaaccgcctgcgtgccctttacgcccagttattccgattaacgctcgcaccctccgtattaccgcggctgctggcacggagttagccggtgcttcttctgtagttaacgtcaattaccaaatctattaaatttgataccttcctcgctaccgaaagaactttacaacccgaaggccttcttcattcacgcggcatggctgcatcagggttccccccattgtgcaatattccccactgctgcctcccgtaggagtctggaccgtgtctcagttccagtgtggctggtcatcctctcagaccagctagagatcgtcggcttggtaggcctttaccccaccaactacctaatcccacttgggctcatctcatggcatgtggccttgcggtcccacactttaatccgaagatattacgcggtattagctacagtttcccgtagttatccccctccatgagccagattcccaagcattactcacccgtccgccactcgtcacccaaggagcaagctccttcgtgctaccgttcgacttgcatgtgttaagcctgccgccagcgttcaatctgagccatgatcaaactcttcaattcaaaaagtttaatcgctcaataaactgcttagctaaagtttacatattacttcaaaagtaaaaatgaatttctagtttaagcacctattaagacttcaaaatcaaaaatattttttcaattaagtcaatcaacaagtgcccacacagattgtctgataaattgttaaagaacaaaaagaaacgacgcactggcaatcaattttaaatcgttcacaacagtgcgtcgttgtgtgaggtgcattatagagaaatctaaaatccttgcaagcacttttttcatatttttttatcgaatgttgcgtttttcaccacttttatgcaatcgaaaacaataacacattgatttataagcaatttatttttacaaaaaatttagtaattctaaccgcttgaagtcccattgttgcatgattacttctcttttagagaactcttcatccatttttgtgcaaaaggcgatattttccctgttttgtgctgaattctcttgcgagaagtcactcaataaatcacttaccctattggcaatgccattgcccggatcaatgaagtacttcacattcggcagcaattgctgtaattcttgttttacgagcggaaagtgagtgcaacctaaaatcactgtatcaagtgttggatgcgtttgccattcagtgatcacttcagctaatcgttcttgatcgacttgccctgttcggatcttttcttctacaagctcaactaatgcggtactcccgatcttttctaccacacaatcttttgcgtacttttcaataagctctgccacatacggtcgttctaccgttccttttgttgccagtaatccgattattttcgtctcagagaccgctgctgcaggtttgatcgccggtacagttccgacaatcggaaatgcaaatttttctcttaaagcaggtaatacgactgtacttgcggtattgcaagcaaccacgaccatatcaagtgggtatttttctgcaattttttgcacaattttaaccgcttgttcaattaatacattttcagaacgttcggagtaaggaaagtaagcattatcgaaacaataaagataatgagcattcggtaaagtttggcgaatagcatcataaatggtgagcccgcccattcccgaatcatataaaaggattgttggtttcatattatagaaagaaagaaaatattgagtggaatgctactctcttatttttattgattcaagtctctcaaggtactgaagacaagtttaaccactattgagattttctttaataagattgattaaaaaataacgactagctaaacttaaaatatgtcaaacaataaaaggagcaaagttatgaaaaaacatttactttttagtacggctttgattgcattcagcaatttcgcttatgctgattctcacccacattggtcatacgaaggaaatagtagccctgctcattggggggcaatcgatgaatcctttagattatgtcaaatcggtaaaaaccaatctcctgtcgatctttctcaatcaatcgcttctaccacacagcatctcacacttagctcttcactttctggtgaatatcaaatagaaaataacggacatacgttgcaagcgacgccaacccaagctgtcagcccaattcaattagacggcaaacaatttgtgcttaaacaattccatttccatacaccaagtgagcatactttcagacgtaaacattttccgattgaagcgcattttgtacaccaatcagcaaaaggtgaattagcagtactggcggtgatgtttaagcaaggtaaagataatcctgcattaacgcctctgattactaaaattttagcaaaaggggaaacgacaaaaagtgtgttgaacccacaacaattactaccgcaaaatcaggaatatttccgtttaaatggttcattaactaccccaccgtgtagtgaaggagtaaattgggtggtattcaaaacgccacttgatgcaagtcaaacgcaaattgaagcaatgcagaaaattattggacaagagaataaccgtccggtacaaccaataaattcgcgtatcgtgattgaagaaagtaaatagaaaagaaagaggagcctattatcgctcctctattcttaaggaaatagaaacgccggcagaaacagttctctaacttctagcggatagccattcagccggtaacaagctcgacgcatatacattccgctttcatgatcttgttgccaagccaatagggtacgcttaggctgttgagcaaacagccataaaccgatcggctgctcaccgagtaacggcacctcttgagcaacattttctatagtttctttaggtaatagcgtttgagcaaaaatccatggacaattcgcttcttttagcaacacttctctataccagtaatctgaatcactctgggctaagttacaagcggtcatcttttccgtattttttgcaagccacttttgctcggtaatttgtacattaaagtcttgagtaacttgtagcaacttttgtgtcagtgagccttgatgcaataaccaagcagactgttgtgaagttagccctatagcttcttcgcaccaatggttttgcatcaaaattttgcgatattgagtgagcatataaaataaaaaagcggttaaattgcaaattattttagcaatctaaccgcttgttgtgaatcaacctcaatcagctaatattagcctttagcaagttgacgagcagcttccacgacaactgaaaccgcttttgcttccgttgcctgaatggtttcttcatttggaatttcttgctgcgtacgatttacgattacacctgaaaccatacctgcacgcaatcctaatgcagagcacatcgtaaataaagtcgctgattccatttcaaagttcattacatttagatcttgccattgttttaatgaaccttggaaatggcgatagattttaccggtaaatgtgtcatagcgctcttgacctggatagaaagtatcagatgaagcagtaatacctacataaggtgttaccccttccgcttttgccgctgcatagagtgcattcgcacattcaaaatttgcaaccgctggatactcaagcggcgcaaaatgacgacttgcaccgtctaagcgtaccgcaccggtagtcactagaatatcgccaacattgatatgtggctgaattgcccctgttgtaccaatacgtaagaaggtacgaacgccaagttgtgctaactcttccacacaaattgaaacagacggaccaccgataccagttgaacatacaactaccggctcgccatcaacatagcctaaccaagaggtaaattcacgggtagaaactaagaactccggattatccatacgtttcgcaatacgctcgctacgcgctgggtcacctgggacaatcgcaattttcgcaccttttaacattgctttggttaaacctaaatggaatacttcagacatatggtctctcctttatctggactctatgaaatttaaaacttgcgcttattcaagcacgaaacctaaagataagcgattgtttttactaaaaaattctcaaatttgtgaactggatcacccgtaaacgtttgcgttgaataaacacaagcggttcattttgccaaaaaatttaccaatattaaggtttaatttctcgtaaaatcggattttgcattgaaattaacgtttcggttgattgaatttcatcaattaactgaattttagtcgccaatactcggtgtaattcctcgatcgtatgtgtcatcactttaataaaaatcgagtaattacctgtggtatagtaggcttctactacctcttcaaattcatttaacttagcaattactgtctcataatcttttgccgattttaaaataatcccaataaagcaacaaacgtcataacccagtttgcgttcattaattcgaattttcgtcccctcaataataccggcttgtcgcattttctcgacacgcacatgaatagtaccggcgctaaccccgaaattctttgccatttccgcataaggggtacgggcatccgcaactaatgctcgtaaaatttgctgatcaagcggatcaatttgctgttttgaatgataattcgtgtgcaaaattcactccatttttcacttttattaaagaatccttaaaatttaccataaaaaattagataaaatctaatgaattaagttttttatttgacagctgttgtattttttatgaattgtattaaattgtgttcataccgttaaccgatacggtttatcgcataaacgattttatttaaggataagcaatgaaaaagacatttattttacagcagcaagaaattagctttgttaaaaacactttcacacaatatttaattgataaattaggcatcatcgaagtacaaggccctattttgagcgaagtgggcaacggtatgcaagataacctttccggtatcgaaaaagcggtacaagtaaacgtaaaatgtatccctaatgcaaaatttgaagtggttcattcattagcaaaatggaaacgtcacactttagcgcgtttcggttttaaagaagctgaaggcttatttgtacatatgaaagcattacgtccggatgaagactctcttgatccgacacactctgtttatgtagaccaatgggactgggaaaaagtgattcctgaaggtcgtcgtaactttgacttcttgaaagaaaccgtaaacgaaatctataaagcgattcgtttaactgaattagctgtggaagcacgttttgatattccgtcaatcctgccgaaacaaattacgttcgtacacagcgaagaattagtacaacgctacccgaacatgaccggtaaagaacgtgaaaacgcaatttgtaaagaacacggtgcggtattcttaatcggtatcggtggtaaattatcagacggtaaagcgcacgatggtcgtgcaccagactatgatgactggaccacagaatcagaaaaaggttacaaaggtttaaacggcgatattttagtgtggaatgaacaactaggttcagcatttgaactttcatcaatgggtatccgtgttgatgaaaaagcgcttcgtttacaagttgaattaaccggtgaccaagagcgcttagaaatggattggcacaaagatttattagcaggtcgcttaccgctttcaatcggtggtggtatcggtcaatctcgtatggcaatgttccttcttcgtaaaaaacatatcggtgaagtgcaatctagcgtatggccgaaagagatgttagaaaaattcggtaacattctataagttactttgcacacaaagggcttcctaatggaagcccttttttatacttaagtgcacacaagcggccatatttgcaaaattttttacaaatacaatcttatccataaaaaaatgccgagaggatctcggcaaaatgctataacttagcaaggatacacactatgaaattgttatgctttaaataactgtaaaattttattcccaaaaaatttccataaaacaattacgctcaccatgacaccaatcactatcggtcctaacgtaatgcctttaaccgaccaataataatgtattgcggcgaacacaattgctggataagccaattgatgcacgctaaaccatcttttacccaatgcttgtttcacaaaaggtaaagacgttatggtcataatgagtaacactagaaaagcaagtccacctaatactaaataaggtcttacaaataattcacttacgaacagggaaaaatctaatccaagttctaaaactaagtaactgcatacatggagtaatgcccatgtaaatgcccataaaccaagcgggcggcgtaaaatttggtattggtttttattgagtacctgaagcactatccccaataaaaatatcacacaaaaaataataattgcggtataacctaagaaatgaattaaatccttactcggatccgcacctaacgcttcactatctccaaccagtaaaatataagacaaccatgctaaaggtagcgcacagctaatatggataattcctcgtaataacgtcaacatttaaaaattcacctttaaatctaatcctttatataaatggccaacttctttttcataaccgttaaacattaatgtcggttgacgtttaacagcaagcaaaccaccgccaccaatcactcgttcagatgcttgtgaccaacgagggtgatcgacatttgggtttacattggcataaaaaccgtattcatccggcgcaagactttcccatgtcgttttcggacgtgtttctgagaaagtaattttcacaatagatttaatactcttaaagccatatttccatggtacaactaaacgaatcggtgcaccgttttgaggtggtaacatttttccgtataagccaacagaaagtaagctaagcggattaagcgcttcttctaaagtaagtgcttcaacataaggatagtcaataccgccaccaaagaatttatttttctgacctggcatttgctccggatcgtgcaatgtatggaatataacaaacttcgctttactagtaggctttgccatttcaactaaacgggccaattcaaacccaatccatggtacaaccattgcccaagcttctacacaacggaaacgataaatacgctcttctagaggaaaagtgttgaataattgtgtatgatttagcacgaaaggattttcaacctctccggtaatctccaattgccacggatctgttttaaaatcttgggcaaacttagcgggtgaagctttatctgtaccgaattcgtaaaaattgttataaccaataattttactttccggcgttaaagctaaatcggaagtcggtgcagctttaaaatccaatgcggctaatactttagtatcctgtgcggcaaaacccatcttaggcaagccagctgcggcaaatccaagccccattgccttaataatttggcggcgttggttaaaaattgtttcaggtgttacgtcataatgggttaattttttcattattggctccttttatgtataatccattcgtctgagacgctataaatataattacataatttttcacttaatttacaaaaagaaacaaagatgtcacaaattgagcaattgaattcgattacgccgcaaaaaatcgaagaaatccgcttacaaatgatcaaattcgcaaccttgcaactaaaagatcccgatctagcggaagatgtggtacaagaagcgttaatgagtgcttacaaaagcgcacactcctttcgagggcaagccgcattaaaaacatggatttttgctatattaaaaaataaaattattgatttgattaaatacaggaaacgaacggtaaacgtttccgagttaatggaagaagaaagccctaatcaattttttgaccataccggctattgggtgtcagaaacttacgagccgaaagaatgggaagacgtcaaccaaattgcttacaagaaagaattttgggcaatcttcgacatttgtttaaataaattaccagcacagcaagctcgtgtttttatgatgcgtgagcatttggaaatgagcagtgaacaaatctgtttagaatgcggtattactacagccaatttacacgttattttgcatcgcgcaaggctacaactacaagcttgcttagcaaaaaactggttcgaaggagagaaataataatgaattgtgagcatgcctcagaattaatttcactaagttgtgaacaaaaactcaaagttaaagacagtgttcagctacaagtacatttatggctttgtccgaaatgtcgttatttcaaacaaaataacgaaaaattacgtgaaatgctgaaagaatactgccactaaacgcaaaaagagcaattgtaatttagtgacaaaaaaagaccgcttgtcttaaaacaagcggtcttttttcatctcttttctgcaaattacgcttttacattttctttcaagaaagctaaaagttgatctttagcaatcatttgtttctcaccggtacggcggtttttgtattcaatttcgccgtttgcgagatttttctcaccgataactaccatatgtggtacaccgattaattccatatcggcaaacattacacccgggcgctctttacgatcgtcgaaaatcacatccacaccttgagcttttaagctgcgatacaattcttcagagaattgttgtacgctttccgatttgtgcatattcatcggcacaattgctactgtgaacggtgcgatttcgtctgacggccaaataataccgcgatcatcgtggtgctgttcgattgccgctgccaccacacgtgttacaccgataccgtagcaacccatggtcatcacaagcggtttaccgtcttcaccttgaacggtcgctttcattgcttccgagtatttggtaccaagttggaaaatatgccctacttcaatacctcgtttgatttgtagcacgcctttgccgtccgggcttggatcgccttccaccacgttacgtaaatccgccacttccggcattgccgcatcacgttcccagttcacattgaaataatgtttaccatcaatatttgcgccacagccgaaatctgacataactgctacagaacgatcgataattgctggaacattcagatttaccacgccaagtgaacccacgcccgcaccgattttcgctttgatttctgattcatctgcaaattcaagcggatcagccactaacggatgtttttgtgctttgatttcatttaattcgtggtcaccacgtaacactaacgccacaagcagttgttcttcggttgcgccttttacgattaaagtttttaccgttttttcaaccggtaaattgaattgctcaactaattcgttaatcgttttcgcattcggcgtatcgactaactgcatttctgccgttggcgcttgacgctcacccactgctaccgcttccgctaattcgatattcgctgcgaaatccgattcggttgagaataccacatcgtcttcaccgcttgacgctaacacttggaattcgtgtgaagccgaaccaccgattgaaccggtatccgcttgcaccgcacggaaatctaaaccaagacgagtgaaaatattgctgtacacttggtacatcacatcataagtttcttgtaatgacgctttgtccacgtggaaagaatatgcatctttcatcacaaattcacgtgaacgcatcaccccgaaacgtggacgcacttcatcacggaatttagtttggatttggtataaatttaacggaagttgtttgtaagacgacacttcacggcgaactaagtcggtgattacttcttcgtgagtcgggcctaatacgaaatcacggctgccacgatcaacaaaacgcagtaattccgcaccgtaatcgttccaacgacctgattcttgccataattccgctggttgcaccacaggcattaacacctcgatagcaccacctttattcatttcttcacgaataatgttttctacttttttcaacaccttgatcccggtcggcaaccagttatataaacctgaagccatcggacgaatcataccggcacgtagcattaattgatggctcaccacctgtgcatcgttcggcgtttctttaagggtcgaaaataaatactgacttgtacgcattgttattcctatttttattttaaatatcgaaaaatgggatctattttaaaacaaaagcggtcgaattttcacagaattttgcaatttgcaaaaaattaatgaaaacagaccgcttgatttgtacataaaaacagtatttgttatattagtccgattgaaaacaagcggtcggatttaatcaaaattttactatgagcgaacaattactagacggtgtgccacttaccgccctttccggggtgggggcggcgattgcggaaaaacttagccgaatcggcattaataacgtgcaagatctgttatttcatttgccttatcgctatgaagatcgtactcgaattacaccgattatcgatgtgcgtccggaaagtttttcaactatcgaaggcatcgtgcaacttaccgaagtgcaattcggtcgccgtccaattttatccaccgtgctttctgacggcaccagtaaaatcacgctgaaattctttaattttaatgcgggaatgaaaaatagcctgactgccggtacacgtgtaaaagcttttggcgaaatcaaacgtgggcggtttatggcggaaattcatcaccccgaatatcaaattattcgcaataatcaaccgcttgaacttgccgaaactttaacgccgatttactccactactgaaggcttgaagcaaaattcgttacgtaaactcacggaacaagcgttagcgttattggataaaatcaaagttggtgagctgctgccggacgaatacaatccgcataaatatagcctcaaacaagcgttacaattattgcatcgcccgccaccgagcgtttctgccgaacagctggaaaaaggcgatcatccggcacaaaaacggctgatttttgaagaattattggcacacaacttagcaatgcagcaagtgcgagtcggagtcaatcagctgactgctacgccgctacgctatcaaaccgatctcaaaagccgctttttggcgagtttaccgtttaaaccgaccaatgcacaaagccgtgtgacggaggatatcgagcaagatttagctaaatcctcaccaatgatgcgtttagtgcaaggtgatgtcggctcgggcaaaacgttagtcgctgcgcttgccgccctgctggcgattgataacggcaaacaagtagcattaatggcaccgactgaaatccttgctgaacagcacgccaataactttgccaactggctacgcccgttcggtattgaagtcggctggcttgccggtaaagtcaaaggcaaagctcgcaccgcacaactggaagcgattaaaaacggcgaggtacagatgattatcggcacgcacgctctcttccaagaaagtgtagagtttcataacctcgcattagtgattattgatgaacaacaccgtttcggtgtacatcaacgtttaaccctacgtgaaaaaggggcgaaagacggcatttatccacatcagctgattatgaccgccacgccaatccctcgtaccttagcgatgacggtctatgccgatctggatacctctattattgacgagctgccaccgggacgaacaccgattaccaccgtggcgatttcagaagaccgccgtgacgaaatcgtccgccgtgtatatgccgcctgcaaaaatgaaaaacgccaagcctattgggtttgtaccctaattgatgaatcggaagtcttagaagcacaagcggcagcggcaattgccgaagatttacaacgagccttaccggatttacgtatcggcttggtacacggacggatgaaaccgcaagaaaagcaagaaatcatggcggaatttaaagcggcaaatattgatttattggttgccaccaccgtaattgaagtgggggttgatgtgccgaatgccagcctaatgattatcgagaactccgaacgtttagggctggctcaactgcatcagttacgaggacgtgtcggccgtggtgcaaccgcttcgcattgcgtgttactgtataaaccgccactcggcaaaatttcgagtaaacgcttacaagtgttacgtgacagccaagacggtttctatattgccgaaaaagatttagaaattcgtggcaccggtgaaattctcggcactaaacaaaccggtatggcggaatttaaagtggcgaatttaatgcgagatcgcaaaatgattccattggtacagaactatgccaagcaaattattcagcaaaatccaccgcttgcagaagccctaattcgccgctggcttggcgaacgtaccgaatatagtaatgcttaatcagcaggacaaacagcgcaatgctaagccaatccggctctgaaaatattttgtgatcttattcacatttctacggattggcttttgcaagcggcctattttttagctacatttgcaattgttacaacacttagggtgttacgagaattcggcaagcctaagcaaaatgattttctaatttcggttagaaagttcttttgcttaggcttttttatttgcctgcagatttttattttgaagagggctacattatggcaaaagatttcagcaaactcgccggtgaaatcgtgcaattcgttggaggagaacaaaatattcactccttagtacactgtgcaactcggctgcgttttgttttaaaagacaaaaacaaagccgataaagaacgcttaaaccaaactgccggtgtcatcagcgtggtggaaagcggggggcaattccaagtcgttatcggcaacaatgtgccgaaagtctatgcggaaattatgtcacaagcgaatattcaagccggtgatgatgcggatttacccaaaccgtctttaattaaccgagcgattgatttcctagccggttctttcacaccgttgattggtgttatggcgggtgccggtattctaaaagggctgattgcgattttacaagttgccggctggcttgatccggcttccggcacttttaccgtcctagatgcggcagcaagcggaactttttatttcttaccggtatttcttgcttttaccgcagctaataaactcaaaaccagtccttttattgcggtgggtgttgctgccgccttactctacccaagtattgtcgctattagtcaaagcggaaaaccgctggaatttctcggttttcaattagcaacgatgaactatgcttatagtgttattccgattttacttgcagtatgggcgcaatcttatattcaacgtatttttgaaaatatcttccatgaagcggtccgtaacttctttgctccggcttgtacgctattagtagttgtgccgttaacccttgcggttatcgggcctatcggcggcgaagtcggtagtacgattgccgctgctttagcttggttatatgaaaccagcccgattgccaccggtattgtggttggcggattgtggcaagtgttagtgatcttcggtattcactggagtatcgtgccgattatgattaacaatatgtccgttgtcggtttcgatttaatcggcccattaaccgctgctgccgtacttgggcaggccggtgcaacatttgccgtattcctcaaatcacacaacaaagatattaaagcgattgccggttcaacgactttcagcggtgtgttaggcattaccgaaccgcttatttacggtattacgctacgttttaaaaagccctttatttgtggtgtgatcggtggtgctatcggtggtgcagtcattggttggggcggaacaaaaatgtttgcttttggtttctcaggcttattactctaccctgtcatcatcggtgaaggcagtaatatcgtcacctattctttagggatggcggttgcatttatcgctgccggtatcctgacctatctgttcggttatagcgataaaatgttacctgagcaagcttctgctactgagcctaaaactaccccaaacgccataaaaaacggtgaagtgtctactatcccacttaacaaattcaatctcgttagcccgcttgagggtaacatccaaaaattaactgaaattgccgatccgatgtttgcatccgaagcccttggtaaaggaattgccatcgaaccaaccaaaggcgaattgatttcgccggttaacggaactatcagctccgccttcccaaccaaacacgcttataacattatctcggatgacggcttggaagtattaattcatattggtatggatacggttcagctcaacgggacacactttgagacttttgtcaaagacggcgatcgtatccaagtcggacaattactgggtaaattcgatattgagaacattaaagctaaaggttattcggtcgttacaccggtaatcatagcgaacagtgatgagtatcttgatgttatcgcaaccaatgagccgtatatttaccaaaatgaaccgctcattaaagttttggaacataaagctccgtagggttttactcatccattttccctcaccgacatcggtgggggaaggtaaacgaacatataagaggaatgaattatgcgaaaaattatcttccttgatgtggatggcacattagtcgattaccaaaaccgtattcccccatccgctattcatgctattcgccaagctcgccaaaacggacatttagtctatctttgtaccggtagaagccgagcggaaatgcaacctcaactttgggatattggtatagacggtatgattggcggtaacggcagttatgttgaacatcaaaaccaagtcatcatgcaccaatgtattgagcctgaaattgctcgacaagcggtagattggcttcaagcgaatgcccttgaattctatttagaaagcaataacggcttatttgccagccgtttcttccgagaagtcgggacgactgctttccggcgctatatggcaaccaaaagtagcgatctaacggaaaacgatcgtattatcgagcaaatgttgggtgatatgatttggggaggtgaactctatcgagacgacctcaacaaaattagttttgtgctaaatagccttgccgatattgatgcggctaaagcggcatttccacaactgaaagtcggttcatggggcggtgtcggtgaaattccgttattcggtgatcttggtgtaccgaatatctctaaagcacacgcaattgaaatcttgctgaatcatctcaatgcggatcgccacgatacactcgccttcggtgatgccaagattgacattccgatgctcgaatattgcgaaatcggagtcgcaatgggtaacggcggtaaagaaattaaagcgattgccgattatgtgaccggcgatgtagaacaagacggcttatatcaggcttttgtacatttcggtttaatcgctgaatcataacaagcggtcaaattccaacttttttatgcaaattatcacttccaaggaggaaatatgcatcttaaatacctttcgttggcattacttatcgggacggcaagtgcgcaaaccgtcaatttcaacttacaagcaaaagtcttcgattatggtcagaatgtgacggctattgagcttgaaactaaacatttagctattccggctaaagcactaaaaacctcagatttccaagtacacgctaaatcttcgttacccattaatgcgatggggaataaagttgccggcgaatttgatacggagcgaaaaattactaaagtaacattgaataaacagggaaatatcgtactttctctcgaacacggtaaggatattgtcggcgctaatacattggcttatatcgcgggagatatcgggcgtaatgtacaacttggcttagattatcaaatacgccaaacccgagatttagcattgttgccaaaagatacgacctaccgccaacaagcactgattgatcatgaagtggcaaaattcaccgcctacacatctcaacaaggcattcattatcaattattccaaccgcaaaattctcatgaaaaacgaccgcttatcatctggctacacggtaatggtgaaggtggcgtcggtgcttatcaaaacaatatttcaacgctactcgccaaccgtggcggagttgcatttgctagtgatgaagcacaaaagattttcggcggcgcttatgttgttgtgcctcaagtaccggatacttggtatctcaattatcaaaaagactatattcaccaaattaaagcattaattgatgaggtaaatgctaaccatcaaattgaccgagaccgaatttatctgtttggtgcttctgccggcggttatatgtcattgcgtatgttgcttgaatatcctgacttttttgcagcaaccgttgccactgcaccggctttagataaagcgccgattgcaggcggcgtaccgaccaccgaacaggaattacaacgaattcaaggcaagccgctttggctggtacacgccgcgaacgacccaaccatttcttacccggcaaccagcaaacgcgtattccaaaccctacgtgatcacggtgcgattttaagtgtttatccggaagttaaaatcggcaaaacaacttacaacggacattggtcttggatttacaccttacgtaatattccaaaaacaccacatggcgagtcgctctttgaatggacggcgaaacaaaaacgctagtcgataataaattaatggagtcatacccaagcggtcgagtcttgtaaaaaaacgacaaaattcgaccgctttttttgtgatcacgttcacatttctcaacgctgccttttgcaagcggtgattttttcagataaatttgtatttataacacttagggtgttacgttaattcggcaagcctaagcaaaatgattttcgcacttccgtgggaaagtttttttgcttaggcttttttattgagttttattgcaatgaggatcagaaaatgagcaatttaaaaccgtttccagcgaattttttatggggtggcgcaacggctgccaatcaaattgaaggtggctttgatgcggatggtaaaggtttatccgctgcggatatggttgcatacgtaccaaaagaagagcgtggtgcgcacagtgctgcgattgaagtgacttcagagcgtatcgaatctattttatccggcaaattccaaggtcgcttccctaaacgagacggcattgatttctatcacaagtataaagacgatatcgccctctttgctgaaatgggctttaaatgcttccgtatctctattcattgggcaagaattttcccgaacggttatgatgaacagccgaatgaagcgggcctaaaatactatgacgatatgtttgatgaaatgctcaaacacggtattcaaccgatggtgaccctttgtcactatgaaactccattaggtttggtgcaaaaatataacggttggctacatcgtgacgttatcgggcatttcttacgctatgcggaaaccgtgtttaagcgttataaagacaaagtgaaatattggttaacgtttaatgaaatcaatatgatcactatgcatagcccttataccggtggcggcgtggttatagatcgtattcccgaagcggaacgtgaaaacgctaaataccaagcgcttcatcatcaatttgtcgccagtgcgctcgcaaccaaattactgcacgaaatcattccggacggcaaaatgggctgtatgctagcccgtttacatcactatgcgttaaccgccgatccgaaagaccaacgtctggcacaatggggtaatcagcaaaacttgttcttcacagatgttcacgctcgtggtgagtacccacgttatatgttgcgccactggcaagaaaataacgtgcacattcacaaagaattcggagatgatgcgattctgaaacaatatccggtcgattttatttcctttagttactatatgtcggtttgtgttactacacacgacgaaggcgagaaagttggtggcaatctgattgaaggcgtgaaaaatccgtatcttaacgcctccgattggggttggcaaatcgatccggaagggttacgtattacattaaacgatatgtacgatcgttatcaaaaaccgctcttcattgtcgaaaacgggctaggtgcctatgaccaagttgaagcggacggaagcattcatgaccattatcgcatcgattatttacgtgcgcatatccaacaaatgcaagaagcaatttcagacggtgtggaattgatcggttatttggaatgggggccgattgatttggtgagtatgtcgacttccgaaatgtcaaaacgctacggatttattcatgtcgatttggacgaccttggcaacggcaccggcaaacgtagccgtaaagattcattctactggtacaaaaaagttatcgccagcaacggaactgatttagcataaatgaaaatttttcattaaattagtagcaaacaagcggtcgtttttctcgttatttttgcaaaaaaatgagaaaatcagaccgcttttctgtataaaccatgctcaatacctgctgcattcattaccgattttcagcaacaaaaaactataactatttggaggcggaatatgctcaaaatcaccaaagtatttaacaataatgctgtacttgctgaaaatgaactgcaaaccgaattggttgtgcttggaaaaggggtcgcttttgctaaaaagttgggagattgcgttgatgccgatctgattgaaaaaacctttagtctcaataaaagtccgtttacaccgcacttgatcgctctacttgaacaaattccaccgatttattttcaactgaccaatcaaatcgttaacgaagcgaataaacaactcggcacacctctttccaacagcatttacgtcagcctgaccgatcaccttttccatgcgattgaacgtgctaaaaataatcaacagatcccaaatgcgcttacctacgaaatccaacgtctttatcgtgcggaatttgcactcggattatttgctatcgccaaaattcacgagcatttaaaggtagaattagacgaacatgaggccgcttttatcgccctccatatttttaacgcccgcacggatggttcaaccatgcatgatacctaccaagctacgcaaatcatcaaagacatcttgcgcttagtacgcttacaattcaatcatcatttcgatgaagatagctacgatttccagcgttttcttacccatttacaacattttgcccaacgttttttcatttccggacaacactcgactggcgatgatgattttctctatcaacaaacaaagttggcttatcctaaagcgtaccaatgtgtagaaaaaattaatcactatctccaacaacattaccaaaaatctcttaatcaagatgaacagctctatttaactattcatattcagcgagtggttaaaagtaaataatatccgcagtaagttcagctgtatttattgatcgatatcagttttttgaatttttactccaaattaaaacttttcaattagcaacaatattttgtgcacaaaaattcttcaagaaaaagactgtggtcaatttatctacaaattatagattttatcaccattgcaaacgattaacttaatcagtttactgatctaaatttttccttatagatcaacaagctcctttttacttctccaattgatattttatttagaaaataaattattttttcacaccaaaaaactaatgacttttaaaaaaatgctccctagaatggagccattcttcactttgtatttactttattttaacaactaaataactttctaaaggaaaaatagcatgccaaatcgcaacattatctggttcgaaaatttacgaatgaccgacgttgaaattgtcggcggtaaaaatgcctcattaggcgaaatgattagtcaacttactgaaaaaggcgtacgtgtgccaaatggttttgctacaactgccagcgcatatcgtaaatttctcgcccataatggcttaaatgaacgtatttcagcggcattagcgcaattagatgttgaagacgtggttgcccttgcccaagtgggtaaaaatatccgtcaatggattttagacacaccgtttcctgccgagcttgatgctgaaatcaatcaagcatggcaaaccatggtaaatgaagccggctcggatcaaatttcagttgcagtacgttcttcggcaactgcggaagatttaccggatgcttcatttgccggccaacaagaaactctcttgaatatcaatgggttagacaatgtcaaagaggcgatgaaacacgtatttgcttcactctacaatgaccgagcgatctcttaccgtgtacacaaaggctttgcgcatgatgtggttgccctttctgccggtgttcaacgtatggtgcgttcggacagtggcgctgccggtgtaatgttctcgattgataccgaaagcggctttgaagatgtggtctttattaccgcttcatacggcttaggtgaaaccgtggtgcaaggcgcggtaaacccagatgaattctatgtgcataaaccgacactcaacgccaatcgcccagctattttgcgtaaaacgcttggcgctaaacaaattaaaatgattttcagccaacaggcgcaagcaggaaaatcagtacaagttattgatgtgccggcagcagaacgccgccaatttgccatcagcgatgcggagattactgagttagcgcaatatgcagtaattattgaacaacattacggccgcacaatggatattgaatggggtcgtgacggtattgacggtaagctctacattctgcaggcacgtccggaaacagtaaaatcacaagaaaaagcacaaggcaataccttacaacgttataccctttccggtgagcgtaaagtgctgattaaaggtcgagcaatcggacaaaaaatcggacaaggtaaagtgcgtttagtgaaagatgcttcagaaatggatcaagtccaagccggtgacgtgttagtggcggatattaccgatccggattgggaaccggtcatgaaacgtgcttcggcaattatcaccaatcgtggcggacgtacttgccatgcggcaattattgcgcgtgaattgggtattcctgccgtggtaggctgcggcaatgccactgaactgctaacaagcggtcaagaagtaacagtttcttgcgccgaaggcgacaccggtttaatttaccaagggttattagatgtgaaagttgaccacattgcgctcgataatatgccgcaagcaccggtaaaaattatgatgaatgttggcaatccggaactggctttctcatttgctaaattgccaagtgaaggtatcggtttagctcgtatggaatttatcatcaaccgccaaatcggtattcacccgcaagccctgattgaatttgaccgcttagacagcgatctgcaagaagaaatcagtgaacgtattgctggctacgcttcaccggttgaattttatgtcgataaaattgctgaaggtgtggcaacacttgccgcctccgtttacccacgtaaagcgattgtgcgtatgtccgattttaaatcgaatgaatatgccggtttaatcggcggtgatttatacgaaccgcacgaagaaaacccgatgatcggtttccgtggcgctgcacgctatgtttctgaggaattcagccaagcattcgctcttgaatgccaagcaatcaaacgtgtacgagatgaaatgggactcaccaatgttgaagtgatgattccgtttgtacgtactctgcaagaagcacgccaagtggttgaaaccttaaaagctaacggtttagaacgtggtaaaaacggcttacgtcttattatgatgtgcgaagtgccgagcaatgctattttagccgaacaattcttagcttattttgacggcttctcgattggttcaaacgatatgacccagctcaccttaggtgttgaccgtgatagcggtggcccgattgccgcgaccttcgacgaacgcaatgaagcggttaaagcaatgcttagtatggcgatccaagcttgtcgtaagcaaggcaaatatgtcggcatttgcggacaaggcccgagcgatcaccctgatttcgcgcagtggctggttgaagaaggcatcgaaacgctttcactcaatccggataccgtgatcgaaacttggttatatttagctgaaaacatcaaacattaataaaccaaaaaagcggtctaattttgcccaaattttgcaaaaaatcggcttttttagaccgcttgttccctattcataaggactgattatgccaaatgttcgctatgcgttttttatttccgaccgtaccggaatcaccgcagaaaacttaggtgacgccctgcttgagcagtttgccgaaatgcaatttaaacgcaccacttgtccgtttatcgacacaccggaaaaagcccataaattggtcgctgaaattaatacggtagcggaaaaacaaccgcatccaccgatcttatttatgagcgtagtcaatgaagaaatcagagaaattctcaaaaccagcaaaggcgttttactcaacttttttgatacctttttagccgtgttagaacaggaattaggtatgcacgccagccacgaagtcgtgagccgtgttcataatgtcgaaaaatatgacgaacgtatggaagcggttaattttgcccttaatcacgatgacggcgtttcggataaagatctccaacaggcggatgtgatcctacttggcgtatcacgcagtggcaaaaccccgacctgcctctatcttgcgctacaatacggcattcgtgcggcaaactatccactcacaccggaagatctcgacagcacagaactgccaagaatggtaaaaccttatcgtcataaattatacggactgaccatcaaacccgaccgtttacacgatattcgccaagaacgccgcccggattccacctacgcagacctcaaaacctgccgcgccgaagtattggaagcccaagcaatgttccgccgctataatatcccatacaccaataccacccaccaatccgtagaagaactcgccgtctctatcatgcaagcctgcaaattgaagcggaagttttaggcgtgataaacagccggtacaagcggtcaaatttgataaagtttttgcaaatctagccgcttgcattgtaagcagcaatgaatttctgtataatctgtcgtctttttataaacgaaattcgcaaaaactctggagtaacaaaatggctcgtgtaaccgtacaagaagcagcagatagaatcggcaaccgtttcgacttaattttgaccgcggcacgccgtgcaagacaattacaacttcacgttcgtgaaccacttgtgcctgaagaaaatgataagccgacggttatcgcattacgtgaaatcgaaaaaggtttaatcaatagtcagatcatggatcaattagaaaacaatgatgcgatccaacaagaagttgctgaacaagaagcgatctctttcttagcagatgttcaagctaacgcttaagatcaaatttattcaatatttagatggataattgaaaataaatagtagtactatctattgtcaattatccattttttaattctatttttctcgaggtgtaccgtgtatctttttcaaccgttagatagcattattcagggctatttacctgctgataaaatcgagctggtaaagcgtgcctttgttattgcgcgtgatgcgcatgaggggcaaactcgctcaagcggagagccttacattactcatcctgtagcagtggcatctattattgcggaaatgaaactcgaccatgaagcggtaatggcggcattgttacacgatgtgattgaagatacaccttacacggaagaacagcttgccgccgaatttggcgcaagtgttgcggaaatcgtgcaaggcgtttccaaactggataaattaaaattccgtactcgccaagaagcgcaagttgagaatttccgcaaaatgattttggcgatgaccaaagacattcgagtggtattaatcaaactggctgaccgtacccataatatgcgtacactaggggcgttacgtccggacaaacgccgccgtattgcgaaagaaacgcttgagatttacagtccgttagcacatcgtttaggcattgagcatctcaaaaacgaattggaagatctctgcttccaagcgatgcaccctcatcgttatcgtgtcttacgtatggcgattgatatggcgcgcggtactcgccaagaccttatttcgaccatttctcacgaaattcaatcacgtttagacgaagccggaataaaaggccgtgtttatggtagagaaaaacacctctactcgctttatgaaaaaatgcgtcaacgcgaccaacatttccattccattttagatatttatgcgtttagagtggtggtggaaaatgtagataattgctaccgtgtattggggcaaatgcactcgctgtacaagcctcgtccatacaaaattcgtgactatattgcagtgccgaaaagtaacggttatcagtcattacatacctcaatgattgggcataaaggtgtgccgattgaagtacagattcgtactgaagatatggatttaatggcggaactcggcgtggcggctcattggcgttataccgaagatcaaaccacagcaaccagcgtacaacaaaaagcgcaacaatggctgcgcagtattatcgagctgcaacaaagcgccggtaactcggatgaatttattgagaacgttaaatccgaccttttctccgatgacatttatgtgttcacacctaaaggtcgtattgtagaattgccggcaaaagcgaccgctatcgactttgcttatgcggttcactcggatattggcgaccgttgcgtcggcgcaatcgttgatcgcaacccgtatccgatttcacagccgttgcaatctgggcaaacagttgaaattctgaccgaacaaggtaaacgtccaagcccgtcttggctgacgtttgtggtcagtgccaaagcccgttcaaaaatccgcactgcactgaaacatttagaaaatgttgatcaggttacggatgaagtagtgaaaccagaacagttggatgttgatatcgaattggaaatcaaagaccagccgggtgtgttggcaagtctaaccaatgcgatcgcttcaatgaatagtaatatcggcacagtagaaagccgtccgaacggcacgggtaattaccaagtgaaaatgcgcatttccgtcacggataatgctcatctttatgtagtgattcagaagctaactaaagtaaacggcgtcattcgtgtcacaaaagcctaatcgtctctaaacataagcggtggatttttgtaaattttttacaaaatttgaccgcttattttctcgttaatccctctcaattcggctataattgcccgaattttttatacacattaaaaaggaactccaatgttatatccaagcgaagaatttctttatgcaccagttacatgggtagatcacagcgaaggttacactgacattcgttaccacaaatcaaccgatggtattgcaaaaattaccatcaatcgtcctgaagtacgtaacgcattccgtccacaaacggttaaagaaatgatccacgctttcgccgatgctcgctttgacgaaaaaatcggtgtaattgtgctaaccggtgaaggtgaatgcgcattctgtgccggtggtgaccaaaaaattcgtggtgactacggcggttataaagacgatagcggtgttcatcacttaaacgtgttggagttccaacgtgatatccgtacttgcccgaaaccggttgttgcaatggtagcaggctatgcggtaggtggcggtcacgtattacatatgatgtgtgacttaacgatcgcagccgataatgcaaaattcggtcaaaccggcccgaaagtcggttcatttgacggcggctggggcgcaagctatatggctcgtatcgtaggtcagaagaaagcacgtgaaatctggttcttatgtcgtatgtacgatgcgcaagaagcattaaatatgggcttagtgaatacggttgtaccttatgcggatcttgaaaaagaaaccgtacgttggtgtcgtgaaatgttacaaaacagtccaatcgcattacgttgcttaaaagcggcattaaatgcggactgtgacggtcaagccggtcttcaagaattagcaggcaacgcaacgatgttgttctatatgacggaagaaggtcaagaaggtcgtaacgctttcaacgaaaaacgtgaacctgacttcagtaaatttaaacgtaatccgtagttaactctactttctccccttgtgggagagagacagcttgttaaagcgttaagcgaaaacaagcagagagaggggaattgcaaaatttttcgggaatttaaccgcatttccctctccctgattttcttctgaacaaagaaaaaaactatcctctctcacaagaggggaaggtaataacttaatcgcctaacttaattgaaaaggctctaacaagcggtctaattcgctgacttttttgcaaataattttctatgtcaaatacccaaaccgaacctcaaacgccagaacaagaagataaacagttaaagaaaaaaccgttctttattccaacttgccttaagttaggtcttgtcggtgcttgctttgccgcattttacgggatttatctcgatgggcgtattcgggccaaaatggacggtcaagtatggcaattgccggcggaagtttatagtcgcattgaaagtatcagcgttgaagataagttatcacttgaagcaaccaagcaagcgttgctcgataacggctaccgtcaagtttctcaaattgccacacccggcgattttaaaattgaaaacaatacactcgtgttattacgccgtgctttcccgtttcctgaaacaccggaagcacagcgtgtattacgtttacgttttgaaaacgataagctggcgcatatcgaagatttagtgcagcgccgattaatcaatgagtttcgactcgacccgaaattaatcgccatgctgcattcggataatgacgaagaacgccaagcgttacgtttacaacaatatccgtatttcttaattcaggcattaattctgactgaagataaacgtttctatcagcatgacggcattagtccgatgggtatcgcccgagcattactggcaaactatcaagcaggtagaacggtacaaggtgcgagtacacttacccaacaattagtcaaaaacttgttcttaaccagtgaaaagaccattgtacgtaaagtgaatgaagcgctgatgtcgcttattttggatttccgctacgaaaagaaccgtatcttagaaacctatctgaatgaaatttatttaggtcaaaacggaagttatcaggtacacggatttgctttggcgagtcaattctatttcggtcgcccaatccaagaaattactccgtcacaaatggcgttgttagttggtatggtgaaaggcccttccctctataatccgtggcgtcatccggaagcagcgctggagcgccgcaatgtggtattaaaattattacttgaaaatcaagcgattacccagccggaatatgaattattagtgaaacaaccgctcggagtaaaagaaaaaggcagcatttatcgtcagcaacctgcatttatgcaagcgctcaatctcgatctgaaaacagagttaggtgaaagtaaatatgcgcaactgtctggtgctagaattttcacaactttagatcgcaaacaacagcgttctgccgaacaggcagtaattaacggcttagaatcactagaagcttcgaatagtaaaatcaaagacttacaatcagcgattgtggttgccgaatataaaaccggtaaggttcgtgcgattgtgggtgaccgtttaactcaatttgccggctttaaccgagcgattcagactaaacgtcagatcggttcattggtgaagccttcaatttatgcgattgcgctttcggatccgaataatttccgattaaatacaccgattcagaataaaccgattacgatttataccaagggttctccgccatggacgccaaaaaactacgacaaaaaattcagcggctcggtaatgttaatggatgcgttagtgcgttcattaaatattccgaccgtgaatatcggtatgaaagtcggcttaaagaaagtcattgcgaagcaaaaagaaatgggttgggataaagcggatattccggcttacccttctatgctgttaggttcgtattcgatttcgccgtatgatgtgaccaagtcttatcaggtcttagcaaataatggtttaaaaacaccgttaaccacgattgaatcgattatgtcgcatgatggcagcccactttatcaacgtaacgttgaagaagtaagccaacaagtattagcgccggaagctgcgatccaaaccttatatgcgatgcagcaagtggtggaacgtggtactgcccgtagcttgcaaaatgactttgcacatttacgcttagctggtaaaaccggaacaaccaacaatgctcgcgatacttggtttgttggtgtcgatggtgaaaacgtgacgaccgtatggctaggtaaggataacaataccgataccaatttaaccggttctagcggtgcattgtttgtttacaaacaatacctagaacgtgcattgcctacggcgtttaaattaccgaagtcaaaaaatttacagtgggtaggtattaacagctacggtacgattaattgtgatccgaatcgccaaattccgatgtggcgggaccgtggacaacattattgtaccggcgcaggcaatatcgttgaagcgagcaaaccggccgtattagatgcaatttcactcaataagagtaaaacagaaaacactaaagcggatgtagcggaagatcaacaagcactcccaactgaagaaattgcaccgactgaatagcaagcggtccaaaaagacaatttttttaccaatacaaaagaaaaaatgcatattcaagttattttgaatatgcatttttacgttatgtcatgtgaaaaaaattaacgttggcgtgctttaaagcgaggattgcttttgcaaatcacataaagtttgcctttacgacgcacaatttggcaatctgggtgacgtgtctttgccgttttcaatgagtttaaaattttcatatcttatccttattttttagccgctaaaccagccatacctttaaagcgttcattaaacttgcttgctcgaccttccgtattcgcctcgcgacgtttacccgtataaactggatgtgacgcagatgacgtatccaatggataaaacggatattctttaccatcttcccaaaccatggttttattagttgcagcacaagaacgaattacccagcccatttgtgccgagctatcataaaacaatacttcacgataattttcagggtgaatcccttttttcataataaaaatcctccagaggcttatttattcccataaataaaaagtggatatatcctacctgagaactgtttttatttctataatttttttatggatataattcttttggttaatttttgtgctaaataataaaagtgcgacttagatcgccttttctttttgtattttatgataggctacacactaaaactgattgactatatttataaggataaaacatggctcaacaaccgtttttaatcgccccatctattttatctgctgatctcgcacgtttaggcgatgatgttgtagaagtattaaaagccggtggcgatattattcatttcgatgtaatggataaccattttgtgccgaatctgacgtttggtccggcaatatgtaaagcattacgtgattatggtatcactgcggaaattgacgttcacttaatggtaaaaccggtcgaacgcttaattccggattttgccaaagcaggagcgaactatattaccttccatccggaagcaaccgatcatatcgatcgtactttgcaaatgatccgtgatctcggctgtaaatcgggtttagtgttcaatccggcaacaccgctgagttatttagattatgtgatggataaagtggatatgattttgctgatgggtgttaatcctggtttcggcggacaaaaatttatccctgctaccttagaaaagctacaagaagctcgtcgtcgaattgataaaagcggctaccctatccgtttagaaattgacggcggcgtaaaaattgagaacatcgcagaaatcgctaaagcgggagcagacactttcgttgccggttcagcgattttcgatcaacccgactacaaagcggttatcgatcaaatgcgtgccgaattagcacaaatttaagacgataagtggttctattttgcaaaaaattaacgaaaatgaaccgcttgtgagtgagaaaatcacttacaaaccgtaatacgctatggataaagcctattcataatgttagaatatcgatcgcttttttgtccgattactacggataaacaattttaattcttgtgtgagaaaatttaggctggtttgaccttgcttcaaaagcgttgaatttagcatttttttctttacactatttaactctcgcacttaggcgaatttcacataggaaaaacaaaatgagcattgaagaacgcgtaaaaaaaatcatcgttgatcaattaggtgttaaagctgaagacgttaaaccagaagcttcattcattgaagatttaggtgcagactctttagacactgttgaattagtgatggctttagaagaagaattcgatatcgaaattccagatgaagaagctgaaaaaatcacaacagttcaatcagcgattgactacgtgacaaaagctaacgcataatttcgaatgaggcggtcaaatgaccgccttattttttacctaaatggctgcaatttttccgtgccgttcaaatagattgttcaaaaataatcaaaatcgtttacaaaccattcaaacaagataaatttgccaaaaagcacttgaccattttttttaaatccgtattatatgcgcctgttacgcaacgttaagggtcgttagctcagtcggtagagcagcggacttttaatccgttggtcgaaggttcgaatccttcacgacccaccatttaacttgcaacaccttctaaagggtcgttagctcagtcggtagagcagcggacttttaatccgttggtcgaaggttcgaatccttcacgacccaccactttagaactttccaaatcagtcaaatctgaaatgggtcgttagctcagtcggtagagcagcggacttttaatccgttggtcgaaggttcgaatccttcacgacccaccacttttacttccttacaaattttcttgaaaaaataaccgcttatttcgtgtttatagtgtaaaattcactgcatttttactgaaattattcaacacatcatttacagcgaacttatttaatgatcaaaaaacttgttatttcactcggtttaatcggcgttgtcgctttaggcggcgtattctacggctaccaaaaactcaatgatttagccaaacatcccatcaccgctaaagcagatcaattctttctgttagaaaaaggcacatctagccaaaaactggcgcaattgctggaagaacaaggcatcgttagtcatgatgatgtaagcttactgccctaccttatgcgctttaaaccggaactcagcaaattcaaagcagggacttactcacttaatggactaaatagcgttgaagacttattgaaacattttagttccggcaaagaagtacaacttaacgtacaatttatcgaaggtaaaacctttaaggtttggcgtgagcagctagcgaaagcaagctatatgcaacatacgttaaccggaaaatccgaagcggaaatcgctcaattgctcggtattgcccatgagaaactcgagggctggattgcacccgatacttatagctatgtgccgaattcaagcgatttggaattacttaaacgagcttatcaaaagcaacaaaaagcattggataacgcttggcaaaatcgtgcggaaaatctaccgcttgcaaacccgtatgaaatgctgattttggcttctattgtggaaaaagaaaccgcagttacgagtgaacgcccacaagtagcatctgtatttatcaaccgtctcagactaaaaatgaaactgcaaaccgacccgaccgtaatttacggtatgggcgatcggtataacggtaatattcgtaaaaaagatttagaagaagcaacaccttataatacttatgtaattgacggcttaccgccaacaccaattgcaatgccgagcgaagcggcattaaaagcggtttcacaaccggataatacgccatatctctattttgtggcagacggcagcggcggacacaaatttagtaaaaatctagaccaacacaaccaagcggttcgtgactggatcaaaatcgaacgaaacaaaaaacttgagaagaaataagaaatgcgtggaaaatttattgttcttgaaggtttagaaggtgcaggcaaaaccactgcacaccaagtgattttagctcagttggaaaaagcgggcaaaaacgtggtacaaacccgtgaacccggcggtacaccgttagcggaaaagttacgccatttaatcaaacacgaaaccgaagaagcggttagtgacaaagccgaattactgatgttatatgcggcacgtattcaattagtcgaaaacgtgattaaaccggcattggcagaaggcaaatgggtgctgggcgatcgtcacgatatgtcttcgcaggcttatcaaggcggtggacgtcaaattgatcgccacttactcgaaactttaaaagaaaccgtgctaggtaactttgaaccggatttgaccatttatcttgatatcgatcctgcggtcggcttagctcgcgcacgtggtcgcggtgaactggatcgtatcgaacagcaaagcctcgatttcttttatcgcacacgccaacgttatttggaactgacacaaaataacgagaaagcggtaattattaatgcggaacaatctatcgaacaagttgccgctgacattcaacaagcggtcgaaaacttcttaaaaattgcaaaataaatatgctatatccttggcttcaacacacttatcaacaacttacagaatcctttttgcatgggcgtggtcatcacgccctgttatttaaaaccgattcgggtttagggacggaaacgcttattcgtcattttgcgcattggctactttgccaaaatccgcacagggaacaagcttgccaacagtgtaaaagttgtttattgactgctgccggaaaccaccctgatttccatattttagagccgattgacggtaaagatatcggtattgatcaagtgcgtgaagccaatgccaaattgcaaaacttctcgcaacaaggtggcaatgcggtggtatatattcgtggtgcggaacgtttaaccgaagcaagcagcaatgcactcttaaaaacgcttgaagaaccacataacagcgtttattttctgcttgaagcaccactacaaggtgcaatgctcccgaccattcaaagtcgctgccaaacgtggttaattcatccgccggaaatggatattgcgttagattggttgcaagcaaactgtagcggtgttgatttttcctcttgtgaaattgcgatgcgtttatgtcatcaacgcccgctgatttgcaaaacttttttagaaaacgaccgcttgcaagcccgcaaaacctttttacaaactttttggcgtttctttaaaagccgagatgtattgctcctcttcaccgcatttgataaagaaaaggaactggtattgcagcaattagaatggttggatagcttttttgccgatgcgttaaaagccaaaatggatattgcaatcggttggacaaatccggacttacaagccggtattctgccgtttagccaacaactctccgcccaagcgctgctaaaaggtcaccaaattctgcaacaaacccgccaagacttacagcaagtaaatgcgatgaatttggaattgatgttacttaactacctgacaaagctagcgctagagacgtttgaataaataaaatagcatgtctacccacaaccttgtaatttttacgtagccatactgtagagaatacacgaaacttcactctccaataaacatcatttaactgtcagataataagcagaatacctgtcagataacaaagagagcattttaatattgcatatcagccacatgaagaattattatatgagcttaggctttaataaagctcgaatcctaagccaggaaatatagaaagtacattaaatataatttagtattgtattaatagaggataaagccacaaactggcaagcaagaattggttttactttttaacctcactaaaaggagacaactatgaaacatagcaaattcaaattatttaaatattatttaattagctttccttttattacttttgcaagtaatgttaatggagccgaaattggattgggaggagcccgtgagagtagtatttactattctaaacataaagtagcaacaaatccctttttagcacttgatctttctttaggtaatttttatatgagagggactgcaggaattagcgaaataggatatgaacaatctttcactgacaatttcagcgtatcactgtttgttaacccatttgatggtttttcaattaaaggaaaagacttgttacctggatatcaaagtattcaaactcgcaaaactcaatttgcctttggttggggattaaattataatttgggaggtttattcggcttaaatgatacttttatatccttggaaggaaaaagcggaaaacgtggtgcgagtagtaatgtcagcttacttaaatcgtttaatatgacgaaaaattggaaagtttcaccatatattggctcaagttattattcatctaaatatacagattattactttggtattaaacaatccgaattaggtaataaaattacatccgtatataaacctaaagcagcttatgcaacacacataggtattaatactgattatgctttcacgaacaatcttggcatgggtttatctgtcggttggaataaatattctaaagaaattaagcaatctcctatcataaaacgagactctcaatttacttcatctcttagcctttattataagttctaaaatagaatattctagggagaatactcattctttatctttataaagttaattgtttctccctgtttctatattatttagttacttgttcaaaagctacattggttattttgtcattttataaaagataataaggtggttattttgaaaattaagaaatatattaaatataccctatttactttccttttaggcatatcatatttatattttgggggcgaaaacgaaaattatcaagagattatttttcacgtcgaacgaggaaatattcaaaaaacagttattgctagcggcacattgcaagcgactgaacaagtagatattggtgcacaagtatctgggcagattaagcatattttagtacaagaaggacagaaggttaaaaaaggtgagctattagctgtaattgatccacgtctggctgaaacggaattaaaactagcaaaagctgagctagcaaatgcttctgctaatttggatacaaaaaaaattaatcttaagcaactgcaatcagattgggaacgtcatcaacgtttgatacgaaccaatgcgacaagccaaaaggaaacagaagaagcaaaaagtagattaaatacggccaaagcagaacttcaaattgcgcaaaataatctagatatcgctaaaatcagagtggaaaaagctgaaaccgaactaggatatacagaaattcgttctccacttgatgcaacagtaatttcagtatttgcgcaaaatggtcaaactttagtcaccacccaacaagtaccagtgctgatgaaattagctaatattgatactatgaaagtcaacaccaaaatttcggaagcagatgtaattcatatacaagctggtgctccaacttcctttacgctattgggagagagtgattcccaatttcacgggcaacttgatatggtaaaactggctcccgttcatattacagacactacagaaaatacaaacaatgcaatttattattatgctactttcaaagtgcctaatcctgatcatagactgcgtatttctatgactgccgctgtaacgattatgttagataaacgtgaaaatgtgttgaatattcctttatcagccctaggggaaatgattgtgccggagcaatattatgtcacggtcttgcgtaaacatggccaaaaagagcaagttgtagtgagaacaggactgaaagacggagcgaaagtagaaattatcgaagggttagtagaaggcgataaagtcctactgcccgttagtacaactcctgcatctaacgatgccgaaatttatagcataggattataatgaaacaaccattaattgaattaaaaaatattgagcgtcgttatcgcaatggcaataccgaaacaacagtattgaaatcagttaatttaaaagtatatgcgggcgaaatgattgctattgtcggagcttctggctctggcaaatcaactttaatgaatatcttaggtgcattggatatagcagattgtggtgaatattggtttcgagggcgaaatatcgcctctttgagcaatgatgagttagcagagttacgttgtagtcatttcggttttgtttttcagcgttatcacttgttgccacatctaagcgcaatcggaaatgtagaagttcctgctatttattcggcaacagataaatatagaagaactgaacgagcgaaggagctgctatgtcgattagggttggaaaaacaactggaaaataaaccttctcaactttctggcgggcagcagcaacgagttagtattgctcgagcattgatgaatggaggagagataatcttagctgatgagcctacgggagcattagatagccaaagcagccaagaagtattgaatgtgttgaaagaattaaatgcgcaaggacacacaattatcctaattactcatgatatgaatattgcgcaaaatgctaacagaattatcaaaatcaaagatggcgaaattattgcagataatagttcatactgcaagaatagcctctccccctcaacaaagcaggaaaggcaaagtctaaactgcttgatgtcgctacgaggctataaagaatcttttgtgatggcattcagtatgatgcgtgctcataaaattaggacgtttttgactatgttaggtataattattggcattgctgctgtcgtatgtgtagtagcattaggagaaggaaccaaacataaagtcttgaatgaatttagctctttaggtagcaacacaatagatatttttcctggtaaaaattggggagataccgaagcatataaaattcaaacgttaaatagcaatgacgtaaatttattacgccaacaaccctatgtgaaaggtgcgactccgaacttatcgttagaattgccaatccgtttcttaaataaaactgccaatgcaacgataaatggtgttagccaagatttctttatgttaaaaaactacaaattactaagtggcagattttttaaccaacaagatgtagatacttatcaagctgttggcataattgataaaaaatcacgagatgtaatcttcggcacaaaaattgcagaaagcaatatagtttttatcggtgatgtacctatttcgattatcggtgttgttgagtccgcctcccaaacaactgaagggcaacgaaccactatttggttaccgtacaacactatggctgctcgcttacgtaaccaaccctattttcaacaaattacagtgcagttacgagaaaattttgtaccagcagcagccgataaggctattgtggatttattggcagcaaagcatggcagaaaggatttttttactttcagtagtagcaagttcttgcaatccttaaatcgcactacacaagccctaactttaatgatttcatctatcgcttttatttcgctggtagttggaggtataggagttatgaatattatgttagtttcagtgattgaacgaaccaaagaaatcggtatccgcatcgcagtaggcgccaaagaaaaagatatactacatcagtttctaattgaatcggcgacagttagtctgatcggcggcattattggtatattgttatcattgttgtttggcttagttttttctttattaacagatagtatcaaaatgcaattcaccttttcctctttctttattgcatttttatgttcatccttaatcggcattatctttggctattttcctgcccgaaatgcagctcgtttaaaaccaatagaagcattatcaagagaataaaaaggcataataaaccaaaagattggggatagtggacaaaattgagtctaatttccccatgatatagccataatggacatttttgagtctgttatggctttatttttaacttcgctggcaaataaaatcctttataaacaccatcttatgttcatcagtcaatccttggtgaggagctaattttgctttcatcagcttaaaaaatgactcgactaaattcgtcgtatgtgcaatatgcagttcaggataatcttgataggtaaataaataatttatgctacgttttagactccaataggcacttcttaatcgtttgtgtttaaaccgttttgcattatgctccgagcgttcgttaaagtaagttttatactcattcagccattgcagtaatgcttgattaagcgtctcttttgtataagatttaagtgaatagtatagctccaataacgctttcccagccggaaatttgggggatttcgttaaataaaatatccctctcccaacttgatgaaaatgacacatctgagttggaatatcaggatatgcattgagtaatcctctcctaccatcgcaggtaatcgattgaatcttaatgcctttttccattaattctgatatagcttcgaaataatactgatttttctcagcgggaataaaacgaaagtagaccggtttggaagagagtgaatccactaaaaccaatacggcaaaacgctgtttaaaatgtgtggtatccatcacgatgttaatggtttcgggtaaaggtttttgctcagctttgatggatttttgaagatgtcttctgatggttctttcagaacattgatattcaatagtaagctgccgaatggtttgttttagcgaggtatacttaaaccagatttcttgtgaattaagtcgcttggatgcaacaaaattacgatggcaatcaagacatttatagcgttgaacaccattaattttgccatattttttgaggttaaaagatgagcagaaaatacaattttttagtcatttttataaaaagtgggttaaaaccttatagtcaacgcctttaatattatgtgttgaatataaatatttaaacttaattatcaacacctccttttttcaccaggattttagtatcatagtattgattgacagcctctacttatcattaaatagtaaaagccgaaaggatcatttattacaaaaaatgataaattgcttaagggaaaaaagtcatattattcaatcaattacctagccggcatgatttgctgaaagatttaatgaataccccacgtaaatgagtcaatctcatttaatcgcaagcattatgagatcaagaaaaaaatgtcaatctcatataggaaggaaattaaagccaattcgtattcgttattagatcaagtatttttaaatgagcgttcagagaaaccgaatgagagcagttattttccttataaacatcataatgttagaagtacctatacaggtataaaacgttatatgagttatgtttttatgtatggagaaataccccgaattaaatattgaaaagacaacaaataagataggagggtaaattaaaaaaagaaccacaagatgaattatagcaacatagtagtttaacaaaaataaagctaacttttatgtctactatgctacatttgccttttagagataaatttcttttctatatatctctgaatattcaaatcattacataatagctcgcaaatattatatgtaggaaaaacattgaaagacttatttattatcgactcacattgtcatttagatgctttagattatgaaactcgccataaaaacgtggacgaagtgatcgaaaacgctaaagcacgcggtgttcatcactttatttcgatttgtaccacgcttgggcgttttgaggcgatgaaagccttaactgcgcatcgtgatgatgtctcgctttcttgtggcgttcacccgttgaatgtcgaagaagagccatttgattacgacaaattacttgcctttgcacaagatgaaaaagtggtggcgattggtgaaaccggcctagattaccactacacgccggaaactaaagcgttacaacaatcgctgttttcacaacaaattgaaattgctaataaagtgcataaaccgttaattatccacacccgctcggctcgccaagacacgatggatatgctgattgcaggcaaagcggagaattgcggcggtgtattacactgctttaccgaagattgggatatggcaaaacgtgcgttggatatcggtttctatatctcgatttcggggattatcacgttccgtaatgcagaagaattgcgtgatgtggtacgtaaagtaccacttgatcgtttattggttgaaaccgattcgccttatcttgcgccgattccgtaccgcggtaagccgaatcagccggcctatgtgcgtgaaacttgtgaatatcttgccgcactaaaaggcgtttcgactgaagaattagctcgcattaccaccgaaaatgtgcaaaacttattcaagattaaactctaatctatcaagttaaaggttaaataaaggaacccgaatgaaagcgattttaaaatattttctgattctcgtctcactctcattttttattgtgttgggtggtgcagtcaattatgcaatgccaagctatgaaaccaccacggtaaccggtatggaagtacgccgtatggataaagacggcatcatcagtaaggcaaatccggcagacggtgaagtgcgtgatgtgtatttcttatttaccgagaatccggaaaccaaaaaagtgatggtatatcgtaacgaagataccggttggggcttaccgccttatttcaaattcggctctgccgacattcaggctaaagcacaagcgtatgcaaatgaaaaacaactggtgcaaattaaatattacggctggcgtattaacttcttaaacgagtttagaaacattgtgtcaatcaaaccgttagccgaaggcgaaagcagttcaatgccgattttcagttatattctctacggcgtattagcactgctcttcttcctttccattcagtttattcgtggcatcttccgtagcgaataacctattccaagcggttcaattttgctagaattttgcaaattgaaccgttttttattgcgagcgaaatgatttattttattgcagacctacacctcaacgaggcacagcctcagatcaccgaacactttttgcaatttatgcaacaaaaagcaccgcttgcggaaagtgtgtatatcttaggtgatttctttgatttttggattggtgatgatgaacaatccgagcttatcgaccaagtgaaaaacgccctaaaaaccctcactacaagcggtgtaaaatgttattttatttgcggaaaccgtgatttcttattaggcaaacgctttgcgcaagaaaccggtattgaaattctgcctgattatcatctgttagatttatacggtcataaaacgctgctttgccacggcgatacactttgcattgacgatgtgaaataccaacaattccgccgtaaagtccatcaaaaatggctgcagtggttatttttacgtttaccgctctcattacgcatccgtattgctcagaaaattcgggccaaaagcaaacaagataaacaatctaaatccgccgatattatggatgtgaatccggcatttactgcagaaacggtaaaacgctttggcacaacttatctgattcatggtcacactcaccgccaagcggtacattccgaagcggaatttacccgtattgtcctcggtgactggaaagcggattatgcttccgttttaaaatttgatgaacagggatttgagtttgtatgatagatgtgattattccttgctataacgcagaacaaacgttggtgcgagcggtacaaagtgcgctaaaccagccggaattaggcacgttatggctaattgacgatgcctcaaccgataacacgctagcactggctcaacatctacaagcgcaagtaccacataaaattcgtgtcgaaccaatgccgaaaaacggcggtgttgccaaagcacgcaattggggcgcattacaaagcgaagccgactttatcgcttttttagatgcggatgatgcctacgaagatcatgcgttacaaattgccgaaggcattttcactttccgaccagagatcagtgtggtacgtcttgcactaaaaccggtggatatgcctgaacgttatagcaaccacccgaattttgaatatgcttggcaacatatgcgaatgacctgtggtgggaataccgtgtttcgccgttcattttttctcgcttgcggcggctttccgcaacatcagctatttagagaattgggtggtgaggacggcgctttaggtattgccactacgcaaattagtgcagttgctacggcatttaatgatgccggagtgttacattattgtcgtgacggcatgcacgccgaacgtttattagacgctatcttatttaataaaacgcccccaggggtaacagcagaaaaaatggctgaagcacaagcggtaacagataaaatttgtgaacaaatcacacagcttaaaacatgtcttgaaaccaaaaagcttgggataaaaccattaaatattcaatggaattagttgaaaattagcgaaaataggtctagtatttgcatttgagattaattatcaaatgtaataactatgagactattttacatcgctatcggttttttatgtattggacttgggattttaggtgcaatgttaccaggcttaccaaccacgccttttttgttacttgcgcttttctgctttagtaaaagctcgcctcagttacaacaatggtttacacgcactaaaatctatcaaaaatatttaaaagattatgatgaaaaacgtgcgatgacgatgaaacaaaaagttaccatcttaatgatttcagccccattctgtctgttctcatttttcgtattaccgaatatttggggcaaactggcattagttgccgtggttatttgccagtattggtatttcttgtgcaaaatggaaacattacctgccgaaactcaaacacgttcaaacgcttaactattcctcttcttttttgcgtctcgctctcgggtgagccgcatcataaatttgtgcaagatgttggaaatctaaactagtatagatttgagtagttgataaactactatgccccaataattcttgtaccgcacgcaaatcaccgcttgcttccaacatatgagtggcaaatgaatggcgtaatttatgcggatgtaaatgcgtttctagcccctgctttttgccccatttctgcatcgcaagttgaatcgaacggtgtgataatcttccaccccgtttatttaaaaacaccgcattatcctgcggattaaaatcattgcgtactccaagccaagcctgcaatgcttgtaaagctttcgtaccgatcggcaaaatacgttctttattacctttacccaacactttcacttcacgcgtagctaaatccatatcaccgagatccaaaccttgtaattcagataaacgtaatccggaactatacattaattccatcattgccaaatcacgtagttcgagcggttcgcttgcttccgtattcaataattgcccgacttgttccgcatcaatatttttcggtagatgcttgccaactttcggcgatttaatgcctaatgcaggattcaccatcatttgttcttgttgaactaaatagttaaaccactgacgcaacgccaccaaacgcaaaccgatacttttagcactcagcccttgcttatggctttgagtgagcatccaacgcacggcagctgaattaacctcttgccaagcactgatccccgcctgactaaacatttcgctaacagccaatagttgacgttgataattgcttagagtatgcgggctggcttgcttttcaatacgcaagtaatcccaatacggtttagtttgcagataaagggggttttgtgaatttagcataatggtaaaacgtagaaaggactgaatggaggagaaaaacaagcggtcaaatttgcaaaattttttacaaatatcaccgcttgttccaattaagctagtttaagttgaccgatacgtacaccaacattacctaacgcaacagggcttaaatagtcgcccaaaaattcaaaaagttcgtttacatcggtaaagctacgttgaattttgacatcttcctcgactttacgtgtaaactcataacgaatgttgtcaccatcaattttcacttctaaggtaatgaacaccgtttcaaaaaaatggtttacattaccttcttcacccggatcactgacacgtacgttccaatggttactaaataaaatttcggttgttactgacattttgttacctctttttgccgatatgttgtgttagataaatcacctcgaacaaaataataaatgctcaaaggcgatcttgttttatatttatctatctagcatagcgattataaatcaaactatctagcataattttttattaacgcttacgagccaaaatataaaatggctgataagtcagagatacgcagccttcttggctaaattggagtttatattgacgtataaactcccgataaaaatcttcggtccattgcgctgtttttaatggcgaaatactcgtacaatccaaatgtgtaatcacctcttccggcgattcaaataaaaaacataaaccgtcttgttgaatgctgataatttcaaaatccgtctcaagttggtttatccagtctaatagtgaagggtaacagactccctctcctacaagcgctcgaatttctcggaaatgttgcggattcacactattaaacagtaaatagccgcctcgttttaattttgctttggcacactgcacaaatgtttgagtacaaggtaaatgctcaaccacagacgcagcggctaacaaatcataaccatcacccagtggcgtatttaagcaatcaccaaacacaaattcacttttcatcagcgtaaaattgcgttgtaatttctcgaccaaataaggctgacactcttcgtataaatcatttaacactagatgttcagcactaaaatctgctaaaaattctgcggtaaagagtcctgtaccacaaccaatctcaagcaccttattaaaatgtttcggtgcatttatttttaataactcgatcagttttttatttatcgttctttgtgcaactgcataggactcataattttttatcatgcatgccgctgccttatccaccgtcggataatttcccatcattaatttctccttttataaatgtggtaaaacctaatacatactttatagctacgaatgtctctttatgtgctatttttattttgacactcgaaaaaaagccctataccaaagcatagggcttagagtgcaataattattgtaacaatgaaatatctgctacttgcaagaacagcccttgtaatgtatttaaaatcgctaaacgattttgacgtaacgcagggtcttctgcatttaccattacattatcaaagaaactatccaccggctgacgtaagcttgctaacttatctaacaccgccgtatattcgccttttgcaatcagcggctgcacttccgttctcaatccaagtaccgcttccgcaagtgctttctctgccggctcaacacaagcggtcggatttacctcaccgattgcaacatctgctttcgctaaaatattgcttacacgtttatttgctgccgctaacgcttctgctgaatctaaagtgcggaagtgcgataccgcacgcacacgagcatcaaagtccgctgggcgagttggacggcgagccaataccgcttggattacgtccaccgcaatgccttcatcttgataccacgcacggaaacgaccgagcataaagtccactacatcttcaactacatttgcattggtcaatttatcaccgaataatgcagccgatttacgcactaaatcttctaaatcaagcggtaaatttttctccacgataatacggagcgaacctaatgccgcacgacgtagtgcgaatgggtcagcgctgccttttggtgcttgaccgataccgaaaatccctgtgagcgtatcgaatttgtccgctaatgctactgaacaagcgactaatgatttcggtaattcatcgcctgcaaaacgtggcatatactgctcgtttaacgctaccgctacttcttcatcttcaccatcgtgacgtgcgtagtgcatacccatcacgccttgtgtatcggtaaactcaaacaccatattggtcattaagtcgcacttagaaagtaagcccgcacgctctgctttcactttgtctgcaccgatttgcgctgcgatttcgcccgctaacgcttcgatacgagcggttttatcacgtaacgtacctaattgttgttggaacaacacggtttcaaggcgtggtaaacggtcctctaaacgctgttttaagtcggttttgaagaagaattccgcatcggttaaacgtggacgaaccactttttcattaccttcgataatcgcagttggatcttctgggttgatgtttgaaacaaagataaagtgcggtaataatttgccatctttatcatagatcgggaagtatttttggtcgcctttcattgtataaaccaaggcttccgcaggcacagcaaggaaacgctcttcaaattttgcggttaatacgttcgggaactcaaccaatgaagtcacttcatctaataagtcttcttcgatgtctgctacgccacctaaagcggtcgctttttcttgcgattttgcaagaatcaacgctttacgctcgttgaaatctgcaaccaccattcctttttcacgtaatgcagtaaggtattcatctgcgtgtgaaatagtaaattcacgttctcctaagaaacggtgtccacgtaccacgttagcgatttttacacctaaaatttcgccttcgattaactcgctaccaaagaataaggtaaccgtatgcacagggcgcacgaattgctcggttttatcgccccaacgcatcattttcggaattggtaaattcgctaaagaacgagaaataatgtccaccaataaattcttagtcggctgaccttcaatcaccgcacggtgaactaaccattcgcctttgtcggtcgccaaacgttccgcctgttccacagaaatgccacagcctcttgcccagccttccgccgctttggtcggattgccgttcgcatcaaatgccgctgaaactgctgggccacgtttttcaatctctttgcttggttgagccgtcgctaaacctaacactttcaccgccaaacggcgtggtgctgcgaaccattccactttctcgaatgataaacccgcttggtttaactcgttttctacattctccgcaaatgcggtcgctaattttttgagtgccttcggtggcaactcttcagtgccgatctcggcgaggaagttttgtgttgtcatttacgcgtatctcttaaaattttatgggattaaccaatctctatcaggacgagctaactgtcgtgcattgttatatgccatatctagagttaaacaagtggcagctctataagtagcttgattggagctttctactacgattgctaaatctgctattcctggtttagaaagacataaaggtaataataattgcactttatttctataaaaatggggaatcgctgttttataattacgtctaactctttcttttgcgttatcaatagccccttttaaaacaatttgtaaagtgtagtcaggcattgaataataaggttcagggaaacgctctttattatcagcaataatatgttcgatgttaacaattaactcttttttacaatcaaataccaaatcagagggattatcaaaataatgagccatatcaggaagaagtgtaaatttttgcatttcaaattccccttttcttttccagccattaaaataccaagggcttaatttatttccatttttaggagtgtttctattagtactacaaaaagcaaaaataggctcttgatttgaagtaactaacccagtattaaatgtcaaatattgcccatcaatagaaatttccaatttcccttcttgagccaattttgtatatgtatattggatgtaattatacaaaactggtaattttctacttgattgagtatttttgtagtcccaatcttcatattccgctaaagtagataaatctgttagtgatttatcaatatcaggaaaaaagattaaatcgtacaattcatcgggccaagtattagatgtcataaatattcctcaaaagtattaatattaagtaattggcttatgaaaacaataatcttgttttttctatctgtgctttcaactcaaactcagtcggcaaataaggcagatatttcgcactaaaaatttgtttgcgatcggctaataccgagtattttgccaccgcctcactttgttcgctacatagcactaagccaatagttggattgtcgtcttcacctttaaattgctcatcatacaaccgcacataggtatccatttgccctatatcttgatgtttgagcttgccgatttttaagtcaatcaacaaaaagcatttgagcttgaaattgtaaaatactaagtcgatataaaaatcttcatcatcaaatcgtaaacgtttttggcgttcaacaaaggcaaaccctttaccaagttctaacaaaaactgttgaaggttgctgattatcgcctgctccatatcagtttcttgataggttttatcctgtaaattcaagaaatctaaaatatatggatcacgcaagtaatcttggatagtttcttttaacgattcagttttctctgttgcttcttgctcaacaagggctttattttgacttgccaataagcgttcgtagtacagcacagaaatttggcggtctaaggcacgagcagaccagttattttctatcgcttctttgatataccaatctcgagcctgtggattttctatccgcataagtgagcggtaatgcgtccaacttaattcggtacgcagtgcgttccgaattggaaatgttaggtagaaagaacgcatatttcgtaaattacgaacatcaaaccctttgccatacatcgctgtcaaacgttccgaaacattctgcaaaatcgctttgccgtacttcgctcgttcttcgccttgctgttcatcttcaaccagtaaccgcccaatttcccaataactctgtaccattgctgtattaactgtttggcgaacttggctttttgcctgttcgataatttgggcaatgttttgaattaagttgtcattcgctgtgatttgcttactcattcgtttgctccacacacttccacttaatcatcatcaggcaactgccccacatgggcttgccactcacaagcggttatttttaaatcggtaaacaccgctttaaatgaggaatcttcagggctacatgcataaacaccgaagtggattttccctgtggcatttgccatatggcaaattcgcatttggctgaaattcatgccgtctggcgaacattcaatacgaaaatcttgtcccctacggctaaggcgataccacattgcttttacacttgcgggaatttctgtggttgcccaatcggaataaccttgattggttaccaccgaacctaaatgctgaaaatcgccattttcatattccaccgaggctttgagccaattttcgctatcgagatacatcaccacaccgcattggtcaaagcggtgttggctacctgaaaaatccgtttttaccacaaaagaaaagtactgctcttccgtgtcgatttgtagcattggggcattatcatttttgaaatgataataagttttctgccacaaatcggtgtgcggttcagtggtgatttcgattttttcttcggtaatgaaataagatttcggttcattccaccacttaaatcgacaattcttaaattgcatttttaggctcatttgcaaaatctccgagaaatttcaccgcttgtaacggtgcgttagcaacgcaccctacatttattttttacaacctggaaaacccaacgcctcacggcttgcataatacgcttctgctacacctttagttaaggtgcgaatgcgtaagatataacgttggcgttcggttaccgaaatcgctttgcgagcgtctagcatattgaagctgtgtgccgcttttaaaatgcgttcgtaagctggtaacggtagtggtttttctaatgctaataattcagtcgcttctttttcgtattgctcaaacgctttgaagaggaaatccacatctgcgtattcaaagttgtaggttgattgctccacttcattttggtggaatacatcgccataggttgttttgcctaatggaccgtctgaccacacgagatcgtacacgctgtccacgccttgaatgtacattgctaaacgctccaagccgtaagtgacttcaccggttactggtttacactctaaaccgcccacttgttggaagtaagtgaattgggttacttccataccgtttaaccacacttcccagcctaagccccacgcacctaaggttgggttttcccagttgtcttccacgaaacgaatatcgtgttgagtcgggtcgaaacctaacattttaagtgagcctaaatagagttcttgaatgttatccggagacggtttgatcaccacttggaattggtagtagtgttgtaaacggtttgggttttcgccatagcgaccgtcagtcgggcggcgagatggttgaacgtaagcgaacgccattggctcagggcctaaagcacggagtgcggtcatcgggtgagatgtacctgcgcccacttccatatcaaacggctgaacaatggtgcaacctacgtttgcccaataatcttgtagggctaaaatcataccttggaatgtttttacattaaattttgttgtcattttgctattcctaaaaaattcgttcaaaaatactggttattatagcctgtaagcggtcgaattttggaaattttttgcaaatttctttccgaataataatagttattattttatgacttatatcaacatagccttagccctatttttgctagaatagttgaataattaaacattatcctccgaggttttctatgaaatctgtttggctgcttggcgtaagtttgctgacattctgttctgcaagtttcgcccaaaattccaccgcttacacaccctccgaattagcccttttcgctgacgaatcactcaagcaatccattggacagcttgaagccggtgtgccgattaaactattgcaatccaaacaagattcctcacaaattgagttggaaatgtggcgtaaaaccaaaggtttcgggcgcatttggtacaaccaattttccaaacaaattaccgatgcggtaatggataaagactttatgcaaaataaccctacgtttgaagtgcttgagaagaaagaagatccacttaccggtttagtgtggcagaaaatcaaattacaagcgtgggtaaaaaattctaaatttaccgatagcctgactgatttttgggcgaatgcggagcaaacctttaagaccgaatgtagcgtttgccacaaacaacgtgataccaaaatgcacgatgcgaatgaatgggttgccgtatttaatggtatggttggctttaccgatatggacgagccgacccgtaaacaagtgctacgttatttgcaaatgcacgcctcagacagccaaccgaaagctgctaaataaggagtttgtatgtcatcatcactttcaacttcacgccgtcaattcttaaaaaatatgtcgctgatggcggcttctatggcaatgccgaatttccttgtgccaagagcaaatgctgaggctgcacaagcggtcgaaaacggttggaaaattaccggtgcgcaatggggcgcggtacgagcaaaaattgaaaacggtcgcattgccgaaattaagccattcgagttagacaaacacccgaccgaaatgattaacggtattaaagacttggtatacggcgaagcacgtattcgttatccaatggtgcgcttggattggctcaaaaaccgtcacaacagcaacagaacacaacgtggcgataaccgtttcgtacgtgtcagttgggacgaagcacttgacctgttctatgaagaacttgagcgtattcagcaaaattacggcccttgggcattacataccgccaatgtcggctggcgttcttccggtcaattccatagctgcggtaaccatatgatccgtgccattgcgatgcatggctcgagtgttggcacggtcggtgattactccaccggtgcgggacaaaccattttgccttatgtgctaggctcaaccgaagtgtattcacaagggacatcgtgggaagtcattcttaaagaaaccgagaacttaattttctgggcaagcgatccggtcaaaaacttacaagtcggctggaactgcgaaacccacgaatcttacggctacttagaacagcttaaacagaaagtggcggaacaaaaaatcaatgtcattagcattgatccggtgaaaagcaaaacgcaaaacttccttggttgtaaacagctttatatcaatccgcaagcggacgtgccgtttatgttggcgattgctcacaccttgtatcgtgagaatttatacgataaagcgtttattgatatgtacacactcggttttgagcaatttgtgccttacttactcggcgaaaccgaagacaaaattgagaaaactgccgaatgggcggcaccgatttgcggtattgaagcggaagaaatccgcaaatttgcccgtatgttagccggcaaacgtacccagttgattttcggttgggcgattcagcgccaacaacacggcgaacagccttattggatgggtgcggttttagccgcaatgctcggacaaatcgggcttgccggcggtggtatcagttatgcacaccattacagttctatcggtgtatccagttccggtgcggcaatgccgggttccttcccatctaatttggacgaagggcaaaccgctaaatatactaataaagattaccaaggttatagtgaggtgattccggttgctcgtactaccgattctttacttcactcaggcgaaaccattgattacaacggcagaaaaattacctatgcgccgtataaaatggcgattttctccggttgtaaccaatggagccgccaatccgatttgaataagatgaaacgcgccttccaaaaattggaaaccgtagtgtcgattaactatagctggacggcaacttgtcgtttctccgatattgttttaccggcttgtacgccgtttgaacgtaacgatattgatgcctacggttcttatagcaaccgaggcgttttggcgatgcaaaaattggttgagccgttatatgaatcccgccctgattttgaaattttcaaagacttatgtcgccgattcggcaaagaaaaagaatattgccgaggcatggacgaaatggcgtggttagaacgtttatacaaagattgtcgcaatgaaaaccgtggcaaatttgctatgccgtctttcgctgaattttggcaaaaaggttatgtgctgttcccagagggcaaaccttgggtacgtcacgccgatttccgtgaagatccggaattacacgcactcggcacaccttccggctttatcgaaatctttagccgtaaaattgcgagtttcggctataccgactgtaaaggtcacccgatgtggtttgaaaaagcggaacgttcgcacggtgggccgaaatcggataaatatccgttctggctacaatccgtgcatccggataaacgcttacattcacaattgtgtgaagccaaatcgttacgtgaaacctacagcgtgcaagggcgagaaccattttatatgaatccgcaagacgcagaaaaattaggcattaaagacggcgatttagtgcgtgtctataacgaacgcgggcaagtattggttggtgcggtattatccgataacttcccgagtggtgtcgtacgtttacaagaaggagcgtggttctcaccgcttgatgaaagcgtgggagcgattgatacttacggctgcccgaatacgctaacactggatattggcgcttcaagcttatcgcaagcgacttctgtcagtacctgtttagtgaatgtggaaaaatggcaaggcgatgcaccggcagcgaacggtttcagcggcccgacagaggtagctcgttaatggcaacgcaattactcagttcggaagaacgactattttgttaccgttggttccattcgttacttgccaaagagctatcggaaccgcagctacacgcattacaagcgggtcaatttgcctcattttttgcatttcttgccgagcttggttttcaaccacaagttaccgacttgcaaaatgaattggcaaaattgaccgcttacgattcacctcgcttagaactggcggcggattttgcgcaatgctttttattggagggcaaattaagtgcgcttccgtacgcctcttactatttggatgaacgagatctcagtgagaatcttgcggtaatggatcaatggctaacgaaatttcagcttaaaatcaatcggttacataatgaaccgagcgatcacctctgtatttatttagaagtgttgatcaaactgattgaaacgaaacagcctagccaaattcagcaacaatttatccgacaacaattactcggctggctaccgcaatgggcggagaaaaccgcccaaattcagagtagtaccgtgttttatcaagtaattagcaatttgttacttggttttctacaacaagatattgcttaaccacaaagcttaacgggcgctgatttggcgtccgttaagcggtcaaatttctattgttttttgcataagtagctgtgcaaatcgtaccgctgcttgcgaatccgtatgtaggtacaacgccggttcgatcaattccaattcattcagcaaaaatcgatcaccaataatcgtaccgtccacccgtgcatagcttggcatttcaggcaatctcatcaaaacatctcgtgcttgtcgaacaatattttgtggaggaactaccggtaagattgctacgccgtaagctgaatttgcccgccattcgcctttgggcggttggcgtcttaccgcatggctaaattcaccggcaaagaaaatcaaactggtttcgccattctccgccacttccttaatatagggttgtaacacgatttgttgtcctaaataggggctaaaatccgggatcggttgatccgcttgccatttgatgaccgcattaccactctgtccgatcgccggtttgctcaccacagcttgtccgttttggtggtacggctgacaagcggtctgaatttggtcgagatccgccaataatagttggcttggaatcacatctacacccatttgttgtaaatccagtaaatagcttttgtgcatattccaatccattaactgaacgggatttgcaaatttttgcccgaattcgaccgcttgttgcagccattggcggaagcattccggctgttgggcgtagtcccacgcacaaagcggtaaaataacatcagcttgcggctgattttgccagcaatccactttgacttgcagtccgttagcttgtaataagcgaatcagcggttgtaaattatcaggaagattggggtaagtttggcaggtagtaatggctatcgaatgtgacataatcggctcaaaaaaggcaagtgagccaaagcccacttgccattaaattgaatggttattttaacttaataaaaaatgtgccttgtggtacaactggcaaatattggcggtggaaatccaaataggttttctccggatcaatatctttaaactgttccgggtaaagcgtttttgccataaattgtgcgctggctaagtcggtaatcgagcgagatgctgtgtgataaatgccgtacacattgccttttttcaccgccggtacgttcgaccaaccggcacgctgagtaaaaccggcaagacgtttttgtgcatccgcttcactgatattaatccccatcgccataatttcggcatttttatcagtacccatttccgtaccggaaataatcaccacctccggattagacgctaagaattgctccggattaatcggtccccagttttcaataaacggtgcggcaatattgtcacctccgactgtattcgcaatcgctccccacatatttttaccgaaagtgaagctatattccgccggacctttgttgccaaattcaacgtaaatttttggtggtttttgaccgcttgccgccacacgtttttgaatctctttgataccttgttcatattcgctggcgatctgatttgcacgtgtttctgtgccggctagttgtccgaaaagttggatacttttcgtatgtttctctacggtttgcgcattgaaatccaccacaacaatcggaatacccgcctgttcgatacgaggaatatcagcggcgatcgtttgatattgccaatcggctaacaccaatacatccggttttaacgctaaggttttttccaacgagaacgttccggtattgatattaccgatatccgccatttccgctaaattcggtaacgctttactaaataaagcccagctaccggggttaaatttttcccaaaactcacgtgaaatgccgacaacatttttaaaattctccgaaccggttgcagcaatataatccggataataaaaaccaagcacaatacgtttcgccggtacatcaactttcacttggcgctccaatacgtcttgtaacacttttacttccgcttgcaccgaaacgccggcaaatagtaatgtgcttgcaataagatgtttaaaatactgctttttcattgtcatccttatttcacttgctcgagatattcgaataaacggcctttatgctctgtggtacgcttttcaattttttcaacttctttggtcgcattttctaaattagtcggtttgcctacttggataataccgctcatattcatcatacgatgtggagggcaaacatatacgtaaaccccttcgtgagtaagcgttaagctaaattgttcatcttctttcgagaggaatttctctgcgccttccggtaccgctttactttgtacccaatgccctttattcgtcggcacgaaagtcaccgtatcaccgacttccgctttcacaaaacccggttcaaacaccataccgccgtctttaccgttatctaacattttaacttcgtgatctgcagccaacacagcgcctgaaaaagcgagtaaggttgctaataatacttttttcattttttactcctaatgcgcatgacgtaacggacgaatcaccggttgtccggtactgtcatataaaatttcaatctcaacgttatacaactgacgaataagatcagcctgtaacacttgttttgcgtcaccgaaagcttgtaatttaccgttacccaataaaatcacctgatcagaaaattgagcggcaaggctcaggtcatgcaataccatgatcgtaatcagattattttgttgcgtatattggcaaacgtgttccaataaattgatttggtggtgcatatccaacgcactgaccggttcatccaataataagatttccggctgacgcaataatacttgggcaaacattaccatttgtcgttgtccgccactgagctgcatgacatcttggtgagcaagatgtgcaataccgagtttctgcataatggtggcgacttcggtcaacaactcgtcactcacgtgcatatttaatgcttccattctgccgagtaaaatcacttctaatgcggtcaacgatgcgtcaacttgtgtatcttgcggcatatagccgatacgtttacgccatgccgaaatagctcgtttattcagtatctgatccgcataatgaatttgccctttacaaccgatttcaccaaaaatcgtttttaatagtgaggatttgcccgccccgtttggacctaataccgtatagactttacccctttcgagcgataaatctaattggtcggcaataacaagcgagcctcgcttaatatgtacatttgcaagttttaacataaattctaccgcttgttatctcttagtaagcacaatccaaaagaagaaaggcacgccaacaaatgaggtaataatccccaccggaaacaatgcgccgggtacaatcactttggataataccgatgcaaccgataaaaatgctgcgccgataagcattgcaccgggtaggaaaaagcgttgatcttcgcccaataacatccgcgccacgtgcggtgcgaccaaaccgataaaaccgataatcccaacaaagctaattgcagtggcagtcataattgccactaaaactaacgtttttaaacgcaagcgttgcagatttatccctaggctcagtgctcgtgcctcacctaaacgtaaagcggtcaatttccataaatcttttgccagtaagctaacgcacacaatggtaaccacagttgcaatcgagaggttttcccaagtcgctttggttaaactaccgaataaccaaaacagaatttgttgcgaaatttccggagccgcaataaattgaatcaacgatagcagtgattggaataaaaacaataacgcaataccgactaataccaacatcgccgaactaaaacggcgcattgaagcaaacacaaacaaaataccggatgccaacatggtcatcacaaaggcacctaatggcacggcaaacgccgaaggcaagccgaaaccgccaaacgcaattactgttgaagcgcctaaaccggccgctgcggctaaacctaaggtataagggcttgccatcgggttattcaacaaggtttgaatctccgcaccgccaacgcctaatgccgccccaacgaccaacgccattaatgccatgggtaaacgtaagtcataaacgataacgttcgtggtggtttctacatcttcaaaacgtaataacgcttttaccacttcatccaatggcaacatcgaaggaccggttacaatatcaaataccaaaccgattaaactgattgcaaggaaagtaagaacgataaaccaacgcttgcgttccagcttgcgttggttttgaacgatcttttcaatcgttatctgactcatgactatttactctctggatagaggtagaaagtcccttgcggcacgataggtaagtttttacggtaaaactcttgataagttttagtcgggtctaaatctttgaatagttccggataaattgctttcgccacaaattgaattgaagcactatcggaaagtgtacgagaattagcatgatatacaccgtataaacgctgatttttaattgccggcaattcagaccaacctgggcgttttgcaaagccggctaagcgtttttgcgcttcttgtttatcaatattaaagcctgccaccattgcttcaggatttttcttcaactcggtttcgcgtccggaaataatcactacatccggtttagccgctaccactaattcaggattaatcgggctgtaaaattccaccgcattttttgcaatattttccgcaccgactaaatcaatcattgcgccccacatacttttaccgaacgtaaaactatgctccgccggccctttattaccgaattcaacatacactttcggtttcggtaaatttgccttcgctacacgctcttgaatatctttcacaatcgctttgtattcatcatttaactgttttgctttagcttcttgcccagttaattgaccgataatctcggtagatttaacgtgtttatcaaccgtttgtgctaaatagtccaccactacgaccggaattcctgccgtttctaacggttctaaatcagaatctaacgctttaaattgccaatccgccatcagcacgaaatccggtttaagcgctaaaattttctcgatcgagaaagtcccgacttccacttcaccgatatcttccaactgatttagtttcggtaccgctttgctaaattccgcccaacttgccggcgcccaatcagaccaaaccgctttagaaaagccaaccacattatctaacgccttttcaccaccgaccgccatataatcttgatagttaaatgcgagtaccactcgtttagccggcaactcaaccgtcactttacgctcaagtatatcggtaatttcagttggcttcgcattagccaatccggataatgcagataatgttgccaatgcaactgctgttaattttattgctcgtaacataaacacacaccttataaataaaaaattaaactaaatcattctttctatatttattttaatatatttccaccaaatgaaaatcattactaattgtctttaatcaaattttgtgagctttatcacaaaagtaaaacattttcctcactaattagctgacatagtgcaagaaattcaaacatttatcaggtagaatagtttcaatcaaagagaaaagacatgaggagcatctatgaacattccattctgcttacctgaaaatattagcccggaaactttcttacgtgattattggcaaaaacgaccgctgttaatccgtaacggcttaccacaaattgtcggattattcgagccggaagatattatggagttagcgttagaagaggaaatcactgctcgcttaatcaaatgtgaaaatgagcaatggtcggtaaaaaccagcccatttacggaaagtgatttacaagatctgccggctcaattctctgtaatggtacaaaacttggaacaatggtcaccggaacttggtgcattgtggcaagcgtttagcttcttaccgcaatggcaacgtgacgacattatggtctcttgttcgcctaaaggcggtacggtcggtaagcattatgatgaatacgatgtttttctcgtgcaaggttacggtcagcgccgttggcaactcggaaaatggtgcgatccatctacagaatttaaaccgaaccaacctatccgtattttcgatgatatgggcgaattagtgttagatgaagtgatgaatccgggtgatgtactttatgtaccttctcgtatggctcactatggcgtatccgaaaccgaagggctaacattctcattcggcttacgctacccgaatgcagcggatttactcgagaacttctgcaaaaccttagaacaccattcggaagtgattgccggttcggaatttaatatcccgttccgccttgcaccacatgaacaaccaaatgcattacttgatccgaaaatggtaaaagtactaaaacatcaattaatcgacttattacaaaactctgatcaatttgatgaaatctttactcacagtgttgctactgcggtaagttctcgtcgttacgatttactacaaacggataacgaatactatccagatgaagtacaaggtattttggaagaaggcggctggattcaacaagacgcgaatgtcaaaatgctttataccgaaaatccgcaacgtatttatgtaaacggtgagtggattgacgagctaaatgaagcagaacaaaatctattaattcgtattgccaacggtgatgcaatctcttggaacaagctagcgtcaaaagtgaaaaaccaagaagagcttgagttattattagatactatttgtgattggctcgatagcggttgggtaattttagaagaatcggaataaaccattcatttcatttttagtaatcagtaaaggcgggtagatacctgcctttatttttacaagcggtctgatttccacaaacttttgcaaaagattagctaaaattgaccgcttgttgcattacgtacataaaagaaaaggcttgggtctcccccaagcctttttatctttcgcattaagcgtgtgcgaattattcgccaagacgctctttgatacgtgcagatttacctgaacgctcacgtaagtagtaaagtttagctttacgtaccgcacctttacgtttaacagagatgctgtcaattactggtgagtgagtttggaatacacgttcaacgcctacgccgtttgatactttacgtagagtgaatgcagagtgcaagccacggttacgaattgcaataaccacgccttcgaacgcttgcaaacgtcttttactaccttctactacccataccttaacttctaatgtgtcacctggacggaagctaggtacgttttgttttaactgttcttgttcgatttgtttgatgatgttactcattttaaaaaccttctaaatcctagaattaactgattttgtgttgtttcttaattttagccaacaacacgcgttgttcgtcagtcagagctaggctatccaatagctcagggcgtcttaaccacgtacgttcaagcgattgttctaatcgccatttacgaatattttcgtggtgacccgacatcagcacttcaggaacaggaataccgtctaacatttccggacgagtgtaatgcggacaatccaataaacctgtcgcaaatgaatcttcatctgcagaggcctgtttgcctaacactccgggtacaaatctcgcaacagcgtcaattaacgtcattgcaggcaattcgccccctgtaagcacataatcaccaattgaccattcttcatcaacttcagtttgaatcaatcgttcatcaaccccttcatatcgtccacaaattaaaattagtttctgatttgaagccagtgttttcacaccttgttgatccagcttacgcccttgtggtgagagataaataacttttgcctctacaccgtcttctgcttttgctgcttgcttcgctgcatgaatcgcatcacgcaaaggttgcaccatcattaacattccaggtccaccgccataagggcggtcatcaaccgttttatgtttatcaaaagtgaaatcacgaggattccaacattgaagttgcagaagttcttgttttaccgcacgtcctgtcaccccaaaatcggtaattgctttaaacatttcagggaacagtgaaatgataccaatccacataatttatcctcaaatgtccttactacttaaagccaaagcgcaccgcatacctgaggttagaaaccagcgtcccaatccaccgtaattgttttggtggcgagatctactcttttaactacttgttcatataagaacggaattaatcgttcttgcttaccgaaagcatctttactgttagcacgcacaaccaatacatcatttgaacctgtttccattaattcagtcacaacgcccatggtatagccttcgagatttaccacttggcagccgattaaatcgtgccaataataatccccttcttccaattcaggaaacacagataaatccacaccgatttcggcattcgttagtaactgcgcgctttcacggtcgtcagtaccttttaatttcacaatcaaatcattgctgtggtaacgccaactttctaattcgattggttgccattgtcccttaatttttaagaaccaaggctgataatcgaagatactttcagtttcttcagttgatgaatagaggcgtaaccagccacgaatcccataggttgaccccagttttccgacaacttcaattttttgttcgctcatgctactcacctactttgcaaaatttttaataaattaagccgctttacgagcttctttcactaaagatgcaacacgatctgaaagctcagcacctttagcaacccaagcatcaactttagccacgtctaaacgtaaacgttcagcttggcctgcagctaatggattgaagaaaccgatacgctcgatgaaacgaccgtcacgtggtgaacggctgtctgctaccacgatttgatagaatgggcgttttttagctccgccacgagttaaacgaatggttaccataaccttcctctaaaaatgttgatagtaaaaaagaaaaccctcgttcgaggtgagggtactgatatgctttaatcatctaaaaaagatagaaaaagcggatagattataccgattttccactaaattacaagaaaagatctttgctacgataaagcaaatcggtaagaaaaagtttaaaagtattagaaaaaaacaaagcccgagataactcgggcttttcaaattaagctatttagctattattccgcagctgcttcagcaacttctggacggtcaactaactcaatgtaagccattggtgcgttgtcgcctgcacggaaaccacattttaagatacgagtataaccacccgcacgttgtgcaaaacgtggacctaattcattgaataatttagcaactgtttctacgttgcgagtacgagcaaaagctaagcggcgatttgcaacgctatcttcttttgctaaagtaattaatggttcaactacacgacgtaactctttagctttaggtaaagttgttttaatgatctcgtgaccgattaaagaacttgccatattacggaacatcgcttggcgatggctgctgttacggtttaattgacgtccactcttacgatggcgcataacctattccttcttagaaaatctaatacctaaaattagtcttcagcaatacttgctggaggccaattctcaaggcgcatacccagtgataagccacgagaagcaagcacatccttaatctcagtaagtgatttcttaccaaggttaggggtttttaataactcaacttctgtacgttgtactaaatcaccgatatagtgaattgtctctgctttcaaacagttagcagaacgaaccgtcaactctaagtcatctactggacgaagtaaaatcggatcaaattccggtttctcttctttaacttcaggctgacgaacatcacgtaaatcaacgaatgcatctagctgttctgctaaaatcgttgcagcgcgacgaatggcttcttctggatcgattgtgccattagtttccatctcaatgataagtttatctaagtctgtacgttgttctacacgagcagcttcaacattataagcaatgcgatctactgggctaaaacgagcgtcaactaataaacgaccgattggacgatcttcatcttgagaatgtacacgagctgatgctggcacataaccacgaccgcgttgaacacggatacgcatattgattgatgcgtttttatctgtcaaatgacaaataacgtgatttggatttacaatttctacgtcaccatcgtgcgtaatgtcggctgcagtcacagggccaattccagacttattaagtgtcaggatgatatcatctttatttgacacttttaccgctagacctttaaggtttaacaatacttcaagaatatcttcttgtacgccttctttgctgctgtattcatgtaatacaccatcaatttcaacttctgttactgcacagcctggcatagacgaaagtaaaatgcgacgaagtgcgttacctaatgtatggccaaaaccacgttctaacggctctaaggtcacttttgcgtgagttgaactaatttgttcaatgttcactaagtgcggctttaaaaattctgtcacagaaccctgcattttatcctctctttgtttttaagctttatttactaatttaataatgtaattttaaaaaattaactattatttagagtaaagctcaacgatcagatgttcgttaatatctgctgataagtcagagcgttcaggagtacgtttaaatacaccttccatcttagttgcatcaacttctaaccaagttggtttttcacgttgagttgctaattctaatgatgctttgatacgtgcttgttttttagatttctcacgaacagcaactacatcatcaacagaaacttgataagaaggaatattcactacacgaccgtttactacgatagatttgtggcttacaagctgacgtgcttcagcacgagttgcagcaaaacccatacggtaaactacgttgtctaaacgaccttctaataatactaataagttctcaccggtattaccttttaagcggtttgcttctgtatagtaattacggaattgacgttctaagataccatagatacggcgaactttttgtttttcacgtaactgactaccgtagtcagataaacgtggcttgcgtgcaccgtgttgacctggtgctacatcaagacgatttctacattttgattcaatcgcacgaacgcctgatttaaggaataaatcagtaccttcacgacggcttagcttgagcttaggacccaaatatcttgccattttctttctccaattattctaacgtcaattaaacgcgacgttttttcggtggacgacaaccgttatgaggaatcggagtcacatcagtaatgttcgtgatacggaaacctgctgcatttaatgcacggattgttgattcacgacctggacccggacctttaaccataacttccaagttctttaagccgaattctttaacagcttcagcacaacgttctgcagcaacttgtgcagcaaacggagttgatttacgagaaccacggaaacctgaaccacctgcagttgcccatgctagagcgttaccttgacggtcagtaatagtcacgattgtgttattgaaagatgcgtggatatgagctacgccatctgcaatctgttttttaacgcgcttacgtgcgcgaactggtgttttagccattatttatctactccgattattttttgatcggtttgcgtggacccttacgagtacgcgcattagtcttagtacgttgaccacgtactggtaaactacgacgatgacgtaaaccacggtagcaacctaagtctaaaagacgtttgatgcttaatgttacttcacgacgtaaatcaccttcgacagtaaatttaccaacttcttcacgcagtttttcaatctgctcttcagacaattctctgatctttacatcttcagcaatacccgttgctgcacagatagctttagcacgagttttaccgataccgtaaattgcagttaatgcgattacagtgtgtttttgatcaggaatgttaatgcctgcaatacgggccactatgcactcctattatttaagtttattgatatgctgatcttgaaaagcccgtttcaggatactcaaacagcatatcaggacgaatgagctgagcagtatacctgctcagcgggttctttgcaagaaagaatactaattaaccttgacgttgtttgtgtttaggatcgctacaaattacgcgaacaacaccttcacgtttaacaactttacagttacggcataatttcttaactgaagcacgaactttcattgcttatcctttttgatctaagggactactgccctaagcctttcaaattggctttcttcaacacagagtcatattgtaatgacattaaatgactttgaacctgtgcgatgaaatccataataactaccactacgattaacagtgaagtaccgcctaattggaatggtactttccataaagatgtaatgatataaggaaccaaacaaacaaaagtaatatacaacgcaccgattaaggttaagcgtgtcatcactttatcaatataacgtgatgtttgttcgcctggtcgataacctggtacaaacgcacctgatttcttcaaattatccgctgtatcacgaggattatattgcattcccgtatagaagaatgcaaagaagattactgccattgtgaataacacaatatataacggttgtcctggctgtaataattgtgataagtcaaataaccattcaagtccttcgctttgaccaaaccactgcgtaatactcgcagggaataagatgatacttgacgcgaagattgcaggaattacacctgccatattaacttttaatggtaaatgagaagatctagctggcgccatcattctgccttgctggcgacttgcataatttaccacaattcttctttgtccgcgttcaacaaagacaacaaaatatgttaccgcaaatgcgattacagctactaataaaagaacaagtggagaaatttcgccttgacgagcttgctcaattgtttgcccaattgtcgccggtaaatccgcaacaatacctgcaaagataatcaaagagataccgttaccgataccacgctcagtgatttgctcacctaaccacattaggaacattgttcccgtaactaggctgattacagaagttacatagaataagatacttggattaggaactaatccttgcaacatattcggtagggcaatggaaataccaatagactgaataaatgctaataacaaagtagcatagcgagtatatttactaatttttcgacgtcccgcttcaccttctttttttagctcagctaaaggaggatgaatcgctgtcaataattgaacaataattgacgccgaaatataaggcataatacctaacgcaaatatagacgctcggcttaaagcaccaccagagaacatattaaacatatcaatgatggtgccttgctgttgtcgaactaattcggataatacagaagcatcaatgccaggaacaggtataaaagaaccgatacggaaaacgattaacgcacctaaaacaaataataatcttgatttaagctcgccagtccctttttgtgtactaccttggtaccctggttgctttgccatctattattcctcgatagaaccgccagcagcttcgatagcagctttagcacctttagttacacgtaaacctttaactataaccgctttttcaattttacctgctaaaattacttttgcagataaaatatctttagtgattacgttagcagctttaagagcttctaaagttacttcgttaccatctactttagctaagtcgtttaaacgaatttcagctacgtggaatgattttaatgaagtaaaaccaaattttggtaaacgacggtataaaggcatttgaccaccctcgaaaccacgacgaacgccgctgcctgtacgagatttttgacctttatgaccacgaccaccagttttacctaaaccagaaccgataccacgacctaaacgtttagcactgtgcttagcaccttcagctggagaaagagaatttaaacgcattctattattcctccactttaaccatatatgacacttgattaatcataccacgaactgccggagtatcgattaattcaactgtatgacgaatatgacgaagacctaagccttttaacgttgctttatgtttcggtaaacgagcgatagagctacgagtttgagttactttaattgtttttgccatattcaattaccccaaaatttcttcaacagttttaccacgtttagcggcaaccatttcaggtgatttcatatttgcaagtgcatcaattgttgcacgaacaacgttgattgggttggttgaaccgtatgctttagaaagaacgttgtgaacgcctgctacttctaacacagcacgcattgcaccaccagcgatgataccagtaccttcgctagctggctgcatgaatacacgtgaaccagtgtgtgaacctttaacagggtgttgtaatgtgccttcgtttaaagctacgttaatcatattgcgacgagctttttccatcgctttttggatcgctgctggaacttcacgtgctttaccgtaaccaaaaccaacacgaccgttaccatcgcctactactgttaaagcagtgaagctcatgatacgaccaccttttacggtttttgatacacggttaaccgcgattagcttttcctgcagttcaccagcttgtttttcgatgtttgacatctcaaattcctctattagaactgtagaccagcttcacgagcagcgtctgctaatacttgcacacgaccgtggtatttgaaacctgaacgatcaaatgcaactgcttgaatacctttagctaaagcacgctctgcaactaatttaccaactactgcagctgcgtctttattaccagtgtatttaacttgctctttaattactttctcaacagttgaagctgctgctagtacttctgagccattaggtgcaataacctgcgcataaatatggcgaggtgtgcgatgcacaaccaaacgggttgcaccttgctctctcattaaatgacgtgcacggcttgcacgacggatacgagctactttcttatccatagtgttaccttactttactttttcttcgcttcttttgtacgaactacttcatcagagtaacgtacacctttgcctttataaggctctggacggcgatatgcacgaatatcagctgctacttggccgattaactgtttgtctgcactcttaagaacgatttctgtttgagatggacattcaccagttacgccagctggcaacgtatgttcaattgggtgtgaatagcctaaacttaaagcaactacgttacctttcatttgtgctctataaccaacacctactaattgcaatttcttagtaaagccttcagtaacaccgataaccatagcattaacaagtgcacgagcagtacctgcttgagcatctgcatttgcaacaccagcacgtggtgcgaaagttaatgcgttagcatcttgatttacttcaactgcattatgaatttcacgagataactcgccgtttttacctttaactgttaatagctgaccgttgagttttacttcaacaccggcaggaatattaacaggtgcttttgcaacacgagacattcttcctacctctctattatgctacgtaacagataatttcaccgccgaggcccgcttgacgcgctgcacggtcggtcattacacctttagatgtagaaacaactgcgatacctaaaccacccataacttttggtaattcgtctttacgtttgtaaatacgaagacctggacggcttacgcgttggatactttctacaactggtttattttggaaatattttaaagtgatttccaattcaggttttgaaccttcaacaattttgaagctctcaacataaccttcttcagctaaaacgcttgcaatagcaacttttaacttagatgaaggcatactgattgcaactttattcgcagcttgaccgttacgaatacgggtcagcatatctgcgattggatcttgcatgctcatgtatttactcccatgattccaaattaaaagaggttattaccagcttgctttcttaaggcctggaatttcaccgcgcattgcagcttcacgtaccttaatacggcttaaaccaaacttacgaagtacaccgtgtggacgaccagtttggcggcaacggttacgctgacggctaggacttgaatcgcgtggaagtgtttgtaattttaacactgctgcccaacgatcttcgtctgaagaatttacatcagagatgattttctttaactcttcacgtttagcgtagaatttatcagctaatttagcacgtttaacatcacgtgcaatcattgattgttttgccacgataacctaccttatttacggaatgggaaattgaaagcagctaataaagcttgaccttcttcatcacttttcgcagttgtggtgatagtaatatctaaaccacgtacacgatctactttatcatagtcgatttctgggaaaatgatttgttcacgaacacccatactgtaattaccacgaccgtcgaatgacttcgcatttaaaccgcggaagtcacggatacgtggaacagcgatagtaatcaatctttcaaagaattcccacatacgttcgccacgtagggttactttgcatccgattggatatccctgacggattttaaagcctgcaacagatttgcgtgctttagtaattaaaggtttctgaccgctaattgctgttagatccgctactgcgttatctaaaagttttttatcggtcaatgcttcacccacacccatattcagggtaatcttttcgattcgtgggacttgcatgacagatgagtagttgaatttagcttttaattcattaactacttgatctctgtagtaatcatgcagtttcgccatcgcattactccagttaattaaataatttcattattagatttgaagaaacgtacttttttaccatcttcgaatctaaaacctacacggtcagctttatttgttttcgggttgaaaattgcaacgtttgatgcatcaatcgcagcttctttcttcactaagccaccagctttacctaaagcaggaactggtttttcatgtttagtgatgattttaacaccttcaacaatcactttaccgtttggtaacacttgagttaccttaccacgtttgcccttatctttaccggtaagaacaattacttcatcattttgacggattttagcagccattacattccccttacagtacttctggagctaatgaaatgatcttcataaacttctcagaacgaagttcacgagtcacaggtccaaaaatacgagtaccgattggttgctcagtgttattgtttaaaattacacaagcgttaccatcgaaacgaataactgagccatctgggcgacgaacacccttcttggtgcgcacaacaactgcttttaacacatcaccttttttaactttaccgcgtggaattgcttcttttacagtaactttgataatgtcgccaattgcagcgtaacgacggtgcgatccacctagaaccttgatacacattacgctacgagcccctgagttatcagcaacatccagcatagtctgttcttggatcatattagtgctccgttaaattaaaaaaaaccctttcgggacgaaaatctacttgccctatgcaagtaggtggcgaattatacctcaataactcacccgaaatcaaataaaatttacgggcaagcggtaatatttccctcaaaaattgcaaataaaaaagccctaatcgcttatagctttagggcttaaaatttgcaaaaaacaagcggtattaaaccgcttgtttttaaatagattcgtagattaagctactgctttttctacaacacgaactaaagtatgtgatttagtttttgaaacaggacgacattccttaatttctactacatcacctaatttagcttcgttattttcatcgtgtacgtgtaatttagtagtacgacgaatgaatttaccgtataaagggtgtttcactgtacgttcgatagcaataacaaatgatttgtccattttatcgctaactactttaccttgtactgtacgaattttatcagtcattactcacccgccttttcggttaatacagttttaacttgtgcaatactacgacgcacttgttttaactgatgggtttgttgaagctgaccggtggctgcttgcatacgcaatttgaattgctcacctaaaaggttgattaattcagcattcagctcttcaacatttttgttacgtagttcttgagctttcattacatcaccgtcttagttacaaatgtggttttaaacggaagtttcgctgccgctaacgcaaatgcgtgacgtgcgatttcttcagaaacaccatccatttcatataaaactttacccggttggattaaagctacccagtactcaacgttacctttacctttacccatacggacttctaatggtttttcagtaattggtttatctgggaacacacggatccagattttaccttgacgttttaccgcacgagtcatcgcacgacgagcagcttcgatttgacgagctgttaaacgaccacggccaattgcttttaaaccgaatgtgccgaagctcacttctgtaccgcccgcgataccacggttacggcctttgtgtactttacggaattttgtgcgttttggttgtaacattcagtgattctccttatttacgacctttgcgagctggctttttaggctgtgccgctggttgttgttctgattcaatcactgcagccataccaccaagaatttcacctttgaagatccacactttaacgccgattacgccgtaagttgtgtgagcttctgcagtgttataatcgatgtctgcacgaagagtatgtaatggcacacggccttcacgataccattctgagcgagcaatttctgcaccacctaaacgaccgctaacttcaactttgatacctttagcacctaaacgcattgcgttttgtactgcacgtttcattgcacgacggaacattacacgacgttcaagttgagaagcgatgctatcagcaactaattttgcatctagctctggttttttcacttcagcaatgttgatttgagcaggaacgccagcaatttgagatactgcgttacgtaatttttcaacatcttcgccttttttaccgataacgataccaggacgcgctgtgtggatagttacacgaatgcttttcgcaggacgttcaatagtgatacgtgatactgaagcgttcgctaactctttatttaagaatttacgtactttgaaatcgccttctaagttatcagcgaaatcttgtgtattcgcgaaccaagtagagttccatggtttaacaataccaaggcgaataccattaggatgtactttctgacccatttgttattctcctaccgattaacgatctgacacaaccactgtaatgtggcttgtacgttttaagatacgatctgcacgaccttttgcacgtggcattacacgtttcatgcttggaccttcatctacgaagattttagcaactttaagatcgtctacatctgcaccatcattgtgctctgcgttcgcaatagctgattctaatactttcttaactaaagcagctgcttttttgttagtgaaagttaaaatttctaatgcttgcgcaacttttttaccgcgaattaagtcagcaactaagcgagctttttgtgcagaggtacgagcgtaacgatgtttagcaatagtttccatcttttacctcttatttcttagctttcttatctgcggcatgaccgcggtatgtacgagtcggtgcaaattcacctaatttatgaccgatcatttcgtctgatacataaactggaacatgctgacgaccattatggactgcgatggtcaaaccaatcattgatggaatgatcattgaacgacgggaccaagttttaattggttttttatccccgctttccaccgccttctctaccttcttcaacaagtgtaggtcaaggaaaggacctttcttgagggaacgtggcattggactatcctatattaatgaataaaattatttgccacgacgacgtacgatgtatttatcagtacgtttgttgtgacgagttttcttacctttggtttgaacgccccaaggtgtaacagggtgtttaccgaagttacgaccctcaccaccaccgtgtgggtggtctaccgggttcatcgcagtaccacgaactgtagggcgaacgcctctccagcggttagcacctgctttaccaagaacgcgaagcatatgctctgagttacctacttcaccgatggttgcagtacactcagctaatactttacgcatttcgcctgaacgaagacgtaaagttacatagttaccttcacgagcgataatttgtacgtaagcaccagcagaacgtgcaatttgaccacctttaccaggttttaattccacgttatgaactgtagtacctactgggatattacgcattggtaacgcattaccagctttaattggagctgaagcacccgcttgaatcgtatcaccaacagataaaccttttggtgctaagatataacggcgttcaccatctttataaagcactaatgcaatgttcgcagaacggtttggatcgtattctaaacgctcaactactgcagggatatctaacttattacgtttgaaatccactaaacggtagtgttgtttatgaccgccaccaatgtgacgagttgtgatacgacctaaattgttacgaccaccagttttagatttgctatctaataaaggtgcataaggtttacccttatgtaattctgcgttaacaactttaactacgtgacgacgaccagcggaggtcggcttacatttaacgatagccatttataaattctcctccgtaattactctgccgcaccttcaacgaagtcaagtgattgaccttcttgaagagtaacataagcttttttccagtcactacgacgacctgatttagcaccgtgacgtttagttttacctttaacaacaacagtacgtacagaatccactttcacttcaaataattgttcaactgcgttagcaatttcaactttgttagcatctaatgctactttgaaaacgatagtgttgcctttttcagcattattcgtcgctttttcagagatatgtggtgctttaagcacttttagcaaacgttcttgttgaatcatgctaacatctcctcaatttgttttaccgcatcagctgtgataaccactttatcgaaagcgattaaacttactggatcgataccttgaacatcacgaacatctactttgtataagttacgtgctgctaagaatagattctcatctaagtttgcagtaatgattaaagcgtcgtttaacgctaaatcttttaatttttgtactaatactttagtttttggtgcttcgatttcgaatttctcaacaaccactaaacgttcttgacgaactaattcagaaaggatgcttttgattgcaccacggtacatttttttgttcactttttggctgtgatcttgtggtttcgcagcgaatgtgataccacctgaacgccagattggtgatttgatatcacctgaacgtgcgcgacctgtacctttttgacgccaaggttttttacctgaaccagacacttcagcacgagttttttgagcacgtgaaccttgacgagcacctgctgcatatgcaacaactacttggtggattaacgcttcgttaaactcacgtccgaaggtagtttcagaaacagttagtgcgtttgcacctacaacttgtaattccatctctatctcctagacttatgctttaactgctggttttacgataacatcactattagttgcgcctggaacagcacctttaactaataataatttacgctcagcatctacacgaacaacttcaagtgattgaacggttacacgctcagcacctaagtgtcctgccatttttttacctttaaacacacgacctggagtttggttttgaccaatagaaccaagtacacgatgtgataaagagttaccgtgggtagcatcttgagtacggaagttccagcgtttaacaccgccagcaaaacctttacctttagaagtaccagtaacatctacttttttaacatctgtgaagatgtcaacattgatttcttgacctaaagtgaattcttcaccttcagtacgaaattcccataaaccgcgaccagcttcaacacctgctttcacgaaatggcctgcttctggcttagttacacgactagcttttttagtaccagtagtaacttgaattgcagaatagccatcgttttcaagggttttaacttgagtaacacggttggcttcgatttcgataacggtaactggaattgacacgccgtcttcagtgaaaacgcgggtcataccaactttacgaccgactaaaccaatcattgtaataacctcttaaaattcccaattaacctagactaatctgaacgtcaacgccagcagctagatctaaacgcattaatgcatcaacagttttttctgttggttcaacaatatcaactaaacgtttgtgagtacggatttcatattggtcacgtgcatctttgttcacgtgtggagaaatcaatacagtaaaacgttctttacgagttggtaaaggaattggaccacgaacttgtgcaccagtacgtttagctgtttctacgatctccgcagtagattgatcaattaaacgatgatcaaatgcttttaagcggatacggattctttggttctgcattagaccagagctccaattaaaatttagctaataaaaaaaccgaactaccacttaaaccatatagaataagggagcgcagttatacctgtatagtttccaaatcggaaacattgtatgtactacaatatctgtagtaccgcttaataaatgattacattaagcgactttaaaatcttcgtatctacatcgtaaatacgatgagtatcaaagtgcgcgtatattacactacttctctggtaagcgcaagaacaatgtgcatcgaaataaaccattaataaaatatggtttttaaatcacaaatcattgacattacttaatttattttacattattatacagcctcttaatagcttatagctataagtaagtggcccataatgaatataaagttacaaaagtaaatcatcaaaaggagctcgtatgaaatacacaacaaaggagttagaaagacttaaagcgctattgtcccctctcggggaggtgacctttaagccttatttttcattcttaggtatctttaaaaacgataccatgtttgccctctacaaagatcaacatttatatgtacgcaaatcagcccaatatttagaagaaataactcaaacaatatcgattcattttctggttgatcgtcatatcaactgtcgttccaaaatattttatcttcttccttcctcaattcttaacaacctacaaacttactctcactggatcacttcagccattcacgaatatcaacaatctaaagcaaaaattgaaaatcaaaatcaaaacaaaattcgtatgttaccaaacttaaatatcagtattgagagattattggctaaagtcggtatttatacagtaacagatttaaaagcgacaggtgctattaacgtttttgtacgtttaatccagcaaggtttggaagcaaccgcattgttattatttaaactatatagtgcgattcaatataaatatatttatatgctgacagaacaagaaaaacagaatttattaattgaagccgacaatgcgctttatcaagcaggattacggaaaagattcatgctgtgcgtaaaataaagtcagacataaaaaaaccgaccatttggtcggttcttttatacaaaaagcaattacgctaattttttgatttgagctgctaattttgctttgtggttagctgctttgttagcgtggattaagcctttagatgccatacgatccactactttttgcatttcaacgaaagctgcttgtgaagctgctttatcgcctgctgctactgctgcgtatactttcttgatgaatgtacgcatcattgagcgttggcttgcgttgtgttggcggcgtttttcagattgaaccgcacgtttttttgctgacttgatattagccaaggtcaaactcctaaaatatctgtgtaaaaattaaaaaacataaactttggtttatgtttagctatcgatagtttaaattcattttcaacgagacacgtgcttgaaaataacaccgttttactgatagaaaacgataggcggagattttatcagtttttttctgattttcctacaacaaactgataaaattccattcaatttatatgaagatcttcatgcaagcggtcggatcctcgcaattttttgcaaaaaatcacctaaaaatgaccgcttatggagaaaaagtgaactattcctctattatttctatgttctatctctaacaggcatatgtggttcttcacttttttgtattaacctttgttaaactaactttttctttcctatttatagtaagcgatattctatgagcaaaaaacttcttaaatcgggcatattagtaagtagtatgactctcatttctcgcatcttaggtttagtacgagacgtagttatcgccggattactcggtgccggagcgatgtcagatgtattcctatttgctaatcgtattccgaactttttacgccgcctatttgcggaaggcgccttttcaaaggcattcgtgccggtacttgccgaatataacgccgataacgatttggataaaacccgtgaatttgtcgcaaaagtatcgggtacattaggcggtttagtcaccattgtgactttggtggcaatgattggctcaccggtagttgcagcattattcggtaccggttggtttatggattgggtcaatgacggccctgacgcacaaaaattcacccaagcttcattactgctgaaaatcacttttccttatttatggtttattaccttcgtggcactgtccggtgcagtattaaataccattggtaagtttggggtaatggcgttttcgccggtattactgaatattgcgatgatcagtatggcgttattcggtgcagattacttcgaacaacccgatgttgccttagcttgggggatctttctcggcggcttgctgcaattcttattccaaatcccatttatgaaaaaagaaggtttactggttaaaccgaaatgggcgtggaaagatgaaggggtcaccaaagtccgcaacttaatgattccggcattgtttggggtttccgttacccaactcaacctgttaatcaaccaaattattgccagtttcttggtcaccggttcaattacatggctctattattccgaccgcttaatcgagtttccgctcgggctattcggtatagcgatttcaacggtagtattaccgagtttatctcgtattgcgaagaaaaaagaaattgacgacgcacagcgtgcggtcgaattccaaggcacgatggactggggtgtgagaatggtgctattactcggcattccggcaatgattggtatcgcagtattagcacagccgctaatgatgactatctttatgcgaggcaaattcggtttatcggatgtggtagccacctctcatgcattatggattatgtgcctaggcttaaacagttatatgttaatcagtattttggcaaacggcttctatgcccgccaaaataccaaaacaccagtcaaaatcggcattattgccaccatttgtaatatctgtttcggtgtgttagccattccattcggctatctaggcttggcaatggcatcggcactgtcagcggcagtgaatgcttcgttactttatcgtggtcttgctaaagaaggagcttatcgtattaccggaaaaactgcgctctttgtattaaaagtcgctatttcggcttgcttaatgggggcattggttgcttatttctcaccaagtttggaaggttggtatgcgatgacaacttggatgaaggtgtattggctggcttggttaattgtcctagcagcgattgtttattttagtgcattatttgtacttgggattcgtaagcgagatttcagagcttaataaatatagaaggtaaataatatggatatgcaaaatattattttatggcgtaggttcttttctggactcgcttataccgcaatgcagagcgtattttttatttatctgacaaaatataaagggtttgatacaacacagattgccagtgcattctcgttattggtgtttgccagccaagctttctccttatttgccggctcatggggagatcgcttcgggcgaatgccgataatgttgttcggatgcttgctcgattcgttagcttatatattgttacttaccactgatcattatgctctactcttgctggcaacattctgctttggtttaggtagcacactgtttagtactaatgccagagcatttttactctcctctgccgaggataattatgcgtctaaaaccaaagcgcaaggaaagtttctcaaaatctccagtatggcgtctatggttgcaccattagtttccattccttttattcattatcaaaaagcggaatggttgatttggtgtagctgtgcaattgaagtcacgatgttactttttatgtggcggacaatgccgagaagaaaatgcaacttccgttttacccctttccgcttcgcacaatttaaagaagtgattaacaagcggtttattttcgtgcatttattgctatttattccgctcggtatgggctcggcattttatgtgattttcccttacatttttaccgagctgttggatcagcaagaattagtgccgattgcattttttatcaataatctgatcgcagtgctgctgcaagcacagttctctcgcaaggtaaatttcggcgtagtgaaactgaattatatcgcaccgctgcttatcgcattactgattgtgccatggttttatgcgctggaatatatttcagaagtgactgcttttttatacctgattatcttttcgctagtcagtttatttgccaataccgcattagcgaatatgttggttaaactggataaaggtgaaaaccaaggattaatgttcggtttatctaagctcattttggcaattacgactgccggggtaatgaatatactgccttatatattcctcgtgtaacaagcggtcgtttttgggtaaaaatttgcaaaactttggcgaaattagaccgcttgtaaaaagtgctaaaaagcaaaaaggcttaacttacatcgcataaaagcattaagttaagcctttttaattgaatttggcggaagtgaatgggagtcgaacccacccaagaacgctggcgtcctcaacaggatttgaagtcctgtcgcctcaccggagacgactcacttccatggaaaaagtagcggtattctactttatttattaaaattgttcaaaatcctcctattcttttttgattatgcaagcattatttcgactcattccctcaatggataaattgataaaaagcccgcaaggtactgatttaattcatcaatttgggcatcacgccttcgtcacacaggcgagatcctttattgaagaagcacgacagcaaattgtcaaaaaccaaatgttgccagcttttctacaagacgagtctgcgctgtttgcgctgattgaagcgaatttacaagctatgcgccagccgcaaatcaaaaaagtattcaatctgaccggtacggtgctgcataccaatttaggcagaggattatggtcggaatctgctattactgcggcaaccgatgcaatgcgtcataacgttgccttagaattcgatattgagcaaggtcagcgttcccatcgagataatgctgtttccgccttaatttcacaactcaccggtgctgaagccgcttgcgttgtgaataataatgcggcagcggtgttactcatgctcgctacatttgcccagggcaaagaagtgattgtatcacggggagaattggtggaaatcggcggtgcattccgcattccggatattatgcaacaagccgggtgcaaactagtggaagtcggtacgactaaccgtactcatttaagagattatcgcaatgcgattactgaaaataccgccttgttaatgaaagtacacaccagtaactatcagattcaaggattcacaagcagcgtctccgaagaagaattagtcgaactgggtaaagcatttaatttaccggttatcagtgatttaggcagcggctcattaaccgatatgacgctgcttcacttacctgcagagccgatggtgcaacaaaaagtggctgccggcgttgatttagtgtcgttttccggtgataagttactgggcggccctcaagccggtattattgtcggcaaacaagctcaaatcgccgcattacaagcgcacccgctcaaacgcgtgctacgttgcgataaagtgatcttatcggcactggaagccacattgcgccactatttatttccagaaaaattagcggatgaattacctacgttacatttgctcacgcagccgctttatgtattaaaagttaaggcggaacaattaaaacaagcgctaagtaagtatttgacctcgaattttaacgtgcaaattgaggagagtgtcgcccaaatcggcagcggcgcacttccgaccgaaaccttaccttcaatcgctctcacgattagcgccgataaacaaagcgacttattagcattagagcaacgctttaaagcctttagttgcccaattattgggcgttttgcacagcagaagttttggttagatttgagatcggttacgcagtttgagcaattaattaccatgttggagaaagaatgattattgtcacggcaggccatgtcgatcatggcaaaagtgcccttttgcatgctatcaccggcactcacaccgcccatttaccggaagaaaaaaagcgtggcttaaccattgatttaggctacgcttatttgccgatacacacagattcaaaccaaaccgatacgcttggttttattgacgtgccgggtcaccaaaaatttttatcgaatatgttggcaggattaggcggtgtagaacatgctctgttagtcgtttcggcggaagaagggattaaaccgcaaacgcttgaacattttgaaattcttaacttgctgaatttcaagcatattatggtggtattaaccaaagcggataaggttgaaccggcgcaaattgatctgcttatttcgcagatcaagcaacaattaccttcgctcaatagcgcacctttttttgtgacttcttgtataacaggtgccggcattgccgaattaaaagcatatttaattgcgcaaaaccgacaagtgacgaataaccagccgtttcgttatgttatcgaccgtgtgttccacattaaaggcgccgggcaggtagtgaccggtacggcagttgccggtaaagttgttgttggtgatgaaatctatttgtccgatggaacaaaagtacgagttaaagcgattcacgcacaaaatcatccgtcagaatctggcgttgccggacagcgtttagcgctgaacctcgctaatgtggataaacaaaaaatcgcccgaggtcactgtctcactgagttagcaccaacatttgcaaccgaccgtattacggtaaaactgagcgctgcacagccattaaaagaaacgtcagtggtgcatatttaccattttgcctcgcatatcactggcaaattaagcttactcaatgcgaaacaagcggtcaaaaataccgaatattttgcagaagtactattagatgagccgttacacattgcattcaatgataaactgattatacgtaatggtgatgacagccaaaccgttgccggcgcacaggtattagaaattcactcaccgaaacgccataaacgtagcgaagctcgtttagcttatttaaccgctttggcacaagccggtaatcatgcacaacgtatcgcgctttatctgcaacacaatgttcttgcgctggaacgtttattatgggacgaacaattatttgcgacagagattgccagacttggttttgatacgaatgccgaatggctttatagctcgactttcaaacaaacagctcaacaaaaagtgttaactaaactagcggaatatcattcgctccatcaagatcaattaggcgtagcgaaagcccgcctacgtagaatggcattattggaattgcctgaaaagctcggattggcatttattgatgatctgttaaccacacaactattagcccaaacacgtggctggttgcatctgcccgatcatcgcattgagtttaatccgcaagaattgcaaatttggcaacaaattcgaccgcttttcgaagcaaccaaccaagcattatgggtacgagatattgcaaatcaattggcaattgatgaaaccgaaatgcgaaatttattatataaagcagggaaattaggctatttaatccctattgtgaaagaccgtttcttattaaatgaacaaattgaagcctttgcgcaattgattcgagactttattctccaacacggcgaaatctcggtaaatcaactacgagacgaacttcaatacggacgcaagctcaccgtacaattaattgaatattttgaccgctccggctttttacgccgtaaaggcaatgtacatttattaagagaccacgacattttttaatatgaaaaacaaaaaacaaaatacacgtgcgattgccgcacaaattatcttacaagttttagagcaggggaaatcactttccagcctactgccggaagcacaaacccaacttgatccgaaagatgttcccttagtgcaagaaatcacgtttgggatttgtcgtgtattaccacgtttggaactagtgattaaacagttagtcgcaaagccgcttaaaggcaaaactcgcttagtccactgcttattactggtagggctatatcaattactctatatgcgagtgcctgcacacgctgcggtagatgaagtggttaacgctactaaagtgctaaaactggatagcttcagagcgctaaccaacggggtattgcgtcgcttcttacgtgaacaagcacagattttagcagttgccgataaacattggcagacgctacatccggactggtttgtgaatcgcatcaaaaaagtgtacccgcactggcgcgagattgtggaagcgaataatcagcgcccaccaatgtggattcgagcaaatcagcaacatattaaagcacaagactatgcggtattactcggtgaattagttgtaaaaaattctgaaaattcgaccgcttgtgtgccggattgcgccattttgcttgagaatccggtaccggtggctaaacttatgcatttcgagcaaggttgggcgaccgtgcaagatgcgcatgcacaatggtctgccgaattactcggtgcaaaaaacggcgaattagtgctggacgcttgtgccgcacccggtggcaaaaccacccatattttagaaaaagcaccgcaagcacaagtgattgcattagacattgaagaaaaccgtctcaaacgtgtgcgagaaaacttagcacgtttagggcaaaccgctaaggtaatttgcggagatgcttcaaagccgcaagaatggcttgaaccggatgtgatgtttgatcgtatcctactagatgcgccttgctcggcaaccggtgtaattcgccgccacccggatattaaatggctgcgtaaagaacaagatattgccgaacttgccgaattgcaaagcaaaatcctacatgcattatggcaaaggctcaaaccaaacggcgttttattatatgcaacctgctctattctgcctgaagaaaacgaacaacaaatcaaccgctttgtcgcccagcaaacggatgccaaactggtagaaatggattttaacggtgaaaaaacagcaatgaagcaattcttccctcaggaaaaaggcggagacgggttcttctatgcaaagttggtaaaaactgaatgaaaataattattttaggagccggtcaagtcggctccactctcgcagaaaatctggtaagtgaagataacgacattaccttaatcgatgacgatcaggggcgtttaaacacgttacaagataaacacgatttacaagtattaaaggggaacggtgcatcgccgcaagtattacgagatgcgggtgccagtgatgcagacttaattgtcgcagtaaccgaaagcgatgaaaccaatatgattgcgtgccaaatcgctcatacattgtttcatattccaaccaaaatcgcccgtattcgtaattccgattacgtacgagaaaaggaaaagctctttaccgatagtgcgttgccaatcgatcatattattgcgccggaagtattggtaaaaaaagaaattctgcgcctaattgattatccgggtgcgttgcaagtggcacattttgccaatgagcttgtcagcctcgtcagtgtgaaagcttattatggtggcccgttagtcggctacccgatttcggcattacgtgaccatttgccttatatcgaagcacgtattgtctcgattttccgccaagaccgtgccatcattccgcaaggctcaaccattatcgaagccggcgatgaagtattctttatctgcgcaacccataatatcaaagcggttatgagtgagttacaacgcttggacagaccgcataagcgagtgatgattgtcggtggcggcagtattggtaccggtctggcaaaagatctcgaagaacaatgcagcgttaaaatgattgaacgagatcctcgtaaggcggagaagcttgctgaaaaattagaaaaagcgttagtgttgtgcggtgatgcatccgaccaagagttactgtttgaagaacatatcgaaaatattgatttattcctcgcactcaccagcgatgatgaagccaatattatgtcggcgttattagcaaaacgacttggtgcgaaaaaagcgattgttctggtacagaaaatggcttacttacacttaattcaaggcggaaccattgatattgctctatcacctaaacaggcaaccatttccgccctctccagccatgttcgcaaaggtgatattgtgcaggtcgcttcattaaaacaagggcaggcggaatgtatcgaagccattgcgcatggtgatgcggaatcgtctaaagttgtcggacgtaccgtacgagaattgaaactgccgcaaggtgcgattgtcggcgctattgtgcgaaatgaagaaattatcatcgcccataaatcaacccaaattgaagaaaacgacagagtgattgtatttgtgaacgacaagaaacaagtcagcgagattgaaaaactcttccaattaagcactttcttcttataaattgtaataaataaaagccatagtgaaaaatcgttactatggctatttttttagctaattcggtaaattctgatccatatcacaaaataataaaaaaagtagaacggaatgttttgagccggtttctttcttcttttgccagtgctactatcctacctagaaattattagatacccaaattaaacatttacattatccacaggagaacacaaatggaatatcgtattgagaaagatacaatgggcaaagttcaagtacctgctaatcgttattgggcggcgcaaaccgagcgctctcgtaataacttcaaaattggcccggaagcatcgatgcccgctgaaatcatcgaagcgttcgcttacttgaaaaaagccgcagcctttgcaaataccgatttaggcgtgcttcctgctgaaaaacgtgacctaattgcaaccgcttgcgatgaaattcttgatcataaactagacggcgaattcccattagtgatttggcaaaccggttcaggtacacagtcaaatatgaacctcaatgaagttatcgctaaccgtgcccacgtaattaatggcggcaaattaggtgaaaaatcaattattcatccgaatgatgatgtaaacaaatcacaatcttcaaacgatacctacccgacagcaatgcacattgcggcatacaaaaaagtggtagaacacaccttaccttgtgtaaaacgcttacaaaaaacctttgcagaaaaagcggaagcattcaaagacgtggtaaaaatcggtcgtactcacttaatggacgcaacgccgttaacattaggtcaagagttctctgcatacgcggcacaattggcattcggtattaaagcgttggaaaatactttaccgcacttatctgaattagcattaggcggtacagcggtaggtaccggtttaaatacaccgaaaggttatgatgtaacagtagcgaactatatcgctaagttcaccggtttaccgtttatcactgcgcaaaataaattcgaagcgcttgcaacacacgatgcaatcgtagaaacccacggtgcattaaaacaaattgcagtatcactttataaaattgctaacgacattcgtttacttgcttcaggccctcgttcaggtatcggtgaaatcttaattcctgaaaatgagccgggttcatcaatcatgccgggtaaagtaaacccaacacagtgtgaagcaatgaccatggttgcggcacaagtattaggtaacgatacaaccatttcatttgctggtacgcaaggtcatttccaattgaatgtattcaaaccggttatggcggcaaacttcttacaatcagcgcaattattaggtgatgtttgcgtatcattcgacgaacactgtgcaaccggtattgagccaaacttcccacgcattaagcaacaacttgagcaatcattaatgttggtaaccgcattaaacacacatatcggttatgaaaatgcagcgaaaattgcgaaaaccgcacacaaaaacggcacaaccttaaaagaagaagcgattaacttaggtttagtaactgctgaacaattcgatgaatgggttcgtccggaagatatggtaggcagcttaaaataagctgttagctgacagataaaagaagggctatcgtttgatagccctttttactgtttacaagcggtctaattttctgctttttttgcaaataatctgataaaaatgaccgcttatttcttcacgccggtaatacggcaccactcttctttttctactaccggatcaagattgaagtccggcgcataggcttcgcagaccgattccgcttgcgttgctaaaataccggataaacctaaatcaccttgtggtttcaccaaagtaataatatttggtgcaagctctttcaacgggccggcaagaatattcgctaccaccacatcggcttgtagatcttgcggttgatctttcgctaagaataactgtaaacgatccgccacaccgtttgcttccgcattattggtagaagctaaaatcgcctgcgggtcgatatcaatcccgatcgcttgctttgcaccgagtttaagtgccgcaatcgctaaaatacctgaaccacaaccaaaatcgatcaccgttttaccagctaaatctaagctatccaaccattgcaaacaaagtgcggttgtcgggtgcgtaccggtaccgaaagcaagccctggatcaagcatcacgttcaccgcattcggatccggtacttcacgccaacttgggcaaatccataagcgtttaccgaattgcatcgggtggaagttatccatccattcacgctcccagtctttatcttcgatttgctcgatcttatgtgcaaaatccgcttcgactaaacggctggcaattaatgcttcaacaatcgctttcatatcggtttccgcatcaaataaacccactacatccgtgttaccccataaacgggtttcacccggtaacggctcaaaaatcggtgtatcctgactgtccataaaagttaccgacaccgccccgatttcttctaaaaaatcactgatttgctcagcctgtttatccgtactatttaaacgaatttgtacccatgccatattattttttccttgtttttatccactttcctcaaacgaaaaccgataatttgtaaaatatcagtcaaaaatgactgcttgtttagagttttaacattaaaaccatctcatcaatgggtgaacatgaaaaaccatactttaaataaaattgttttgcttgcgggtttaacgcatgaacaagcaatgcttttaccccgatttggttcgccaccgtcttcgactttaagaccgcatcttttaacattgatacgcctaactgcttaccctgtgctgagcaatcgaccgctaatctacctaaaataatcacgggaatcggatcgggcatattacgtcttaatgcgcctgcaacaaactgacgactcaccgaaccggcagataaacaataaaatcccatcacctgtttattctcatcacacacaacaaaagttttactggcattattttgctgatttttcaatgcagtacgttgtagccattggtctagtacgacctcaccgcattgaaaatgttgcacaatatgttgctcggaaagcagttccggtgcgtgcattttctactcccacaccgctttggtatttaacagtttatctaaccccggattatctgctgttggttgttctagcaatcggttaaattgctcaaaagtctgctcatttaattggaaaacagtgcgatctaaaatcacattttgggcagcttggcatgcggtttctaacataaagtcagaacgtgtcttacctaaaatacttgccgcataatcaattaaatcacgctgatcaggcatcgctcgtaaattaattggcgcagttctcatgcttcctccacttccacagatacacaatagatatacatcttaaaagatttaacgaagtaaggcaatcacaatcgctttagtataaaaaacagcaagatcgttgaatcttgctgcctttatttaccctcgtccaccaaccgtaatcttatctaacttcacggtcggttggcctacaccgaccggtacggattgcccttctttaccgcaagtgccgatacctgggtcgagctccattttcttaccgaccatagaaacctgctgcatagcatcaataccgctgccgattaaggttgcaccggtaaccggtttagtgattttacctttttcgattaaataagcttctgcagttgagaacacaaatttacccgaagtaatatccacctgaccgccgctgaaatgcggtgcgtaaataccgtaatcaactgattcaatcatttcttcaaagctgtgcgagccttctgtgagataggtattggtcatacggggcattggtaagtgtgcatacgactcacggcggccattgccagttggagcaactcccattaaacgggcgttaagtttatcttggatatagccttttaaaatcccgttttcaatcaatacgttacgttgcgaaggaactccctcgtcatccaccgtaatcgaacctcgaacatccggtaccgtaccgtcatcaatgatcgtacaaagtggcgaagttactagttcgccaattttgccggtaaatagcgaagattctttacggttaaaatcgccctctaaaccgtgcccaaccgcttcatgtaataaaatacctggccaacccgcacccaatacaatcggcatcgtgccggctggtgccggcattgcgcctaaattgactaatgccatacgtaccgcttctttcgccagataaaccgctcgagtgtcaccggtcatttccccgttaaccacttgcggttcaaagaaccagtttaagccgaaacgtccaccggcaccggcagaacctcgctcacgtttaccattttcttctaccaataccgaaaccgataaacgtaccaacgggcgaatatccgccgcaagcgtgccgtctgttgccgctaccaacatttcttcatagaccgctgaaagccccgcattgacttgaatcacacgagggtcttccgcacgtgcaactttatcgactaaatggagtagctcaactttttgctcacggcttaacgtatctaacggattgaccgacgcataacgtttgatcgcattcgtttgtttgaaactttttaccgataattgaccgcttgcattagtaatcgagcgagctgcggtcgcacattgttcaagctggctcaagccgatttggtctgcatacgcaaagccggttttctcgcccgatactgcacgcacaccgaaaccacggtcaatataaaaaccgccctctttgataatcgaatcttctaacgaccaactctcgtcttggcttaattgaaaatagagatccgcataatcaatttggcgattcgcaaaatgatcaagcactttactcaagtgcgataactcaagcccacttggcgcaagcaagctttctgaaacttgatttaacattgtttttctcttcttaataaaattctttaaattttaacatattaaaaccggctctcactgctctttttcaaaaacagtcgctgaataatgatagaatgaggaaaatgaccgacacagataaggcgcaatatgttactggatacacttcaaacacagtttaggcactatttcccgactcagcgggattttgtgcttggcttaagcggtggtattgattcgattgtgttattgcacctgttagccgaattacagctcaacctaagagcggtacatattcaccatgggcttagcccgaatgccgacagttgggcagctttttgtgaacaagtttgcaagcggttaaaaatcccatttattttgcaaaaagttacggtggatcgcagtgaaggtatcgaagccggcgccagagcggcacgttatcaggcaatcggtgaaatcattctgcctaacgaagtgttagtgaccgctcatcatcttgatgatcaagcggaaaccttcctgcttgccctaaaacgtggcagtggaaccaaagggctatcggcgatgcaagcggtcggattttggcaaaattttaccatttttagaccgcttcttaatgtgagcaaaacgcaaatcgaacaatatgcacaccaaaaacaattcacttggattgaggacgaaagtaatcacgacagccattacgatcgcaactttttacgcaatgaggtgttaccgatcgtgaatcaacgttggcagcatttcagtcaaatggtggctcgttctgcacagcattgtgccgaacaacaaatgctattggaagaattgcttgctcaagaattacaacgctatgcggatttttcggaaaagcgtttaaatatcgaagcgtttccacaattttctttggcaaaacagcaacaattgatacgtttatggctggaaaaatgtggcgcacaaatgccaagtacggcacagctgatgcaagtgattcagcaaacaatttatgcggatgccgataaaaacccacagcttaaattagccgatttttggctacgccgttatcaacatcatctctatttaaccggtgaattgcttgaaccggatgatttttgccagccgctctttgcccaacaatcgttaacgctaccggacggaatcggtgagctacaacatttaggcgaaagcattatttacaaaaaatcaggtaaaattgaccgcttgttattaccggaagcgttagtaaatgctccgttgcaaataaagttggcgcatcaaggtaaagtcaaacagtatggcaagccaatgcgagaagaaatgaaaaaatgctaccaacaagcgcaagtgccggtctggttacgtaaacgcacaccacttattttttgggatgatcagttaatttttgtttgtgcctagcgtcggccacacaaaaaagcccacgttttgctgcgtgggctttttgtcgataagcggtcattttggctaaattttttgcaaattctaccgcttgtgaagattacgctaaaaccgctaatgccgcttcgtaattcggttcagttttaatttctgccactaattcgctatgtaatacacgattattttcatctaatacaatcaccgaacgtgatgttaaaccggctaatggtgagttttgaatatcgacaccaagttgttgatgtactgctttatgacggaaggttgaaagcgtttgtacattttcaatgccctctgcaccacaaaaacgcgcttgtgcaaaaggtaaatctgcagaaatacataaaacgaccgtatttgttaaatccgctgctttttggttaaacatacgtactgaggttgcgcatataccggtatcaatacttgggaaaatatttaacactttgcgtttaccggcaaaatctgtcaaagaaacattctctaaactattattcactaatgtaaaattttcaacggtttcgcccgcttgtggaaagttaccctctacatcaatcgggttacccattaatgttaccttgctcatatcaaactcctatcattggttaaaagccaacctaatatagcgacttttaattaccgtttaaaccttttaataaaataagtaaattttgttatactgcttgcaattaaatgttgattttttgaagggcttactatgctaaaactcgctcgtattcttgcggtcgccgtgactgcgattcttatttctatcattggtacagtgtacgcttttattcgtttccgtcaccctagcacggtcggcatcgtagctagaatgtatgcctcaatgcacaaactggtcggcttgaaagtgatttatcgtccacgtccggaattttctcaaccggcaatctatatcgctaaccatcaaaataactacgatatgcttaccattgccggtattgtgccgcctcgcaccgttacgatcggtaaaaaaagcctgatttggattccttttttcggtttggtgtattgggcgactggcaatatttttattaatcgagaaaaacgtagtagcgcaattagcacgatgaataaagtgggtgaaattattcgtgagcgtcaaatttctatttggatgttcccggaaggcactcgtagccgaggccgtggcttattacctttcaagaccggcgcatttcatactgcaatcgcagcaggcgtaccgattgtgccaattgtgtgttcttcgctacataataaggttgatctcaatcgttgggataatggcacggtcatctgcgaaagcttagagccgattgatacgagcggttacaaccgtgacaatatcaaagaattgattgaaaaatgccatagcattatggcagccaaaattgctgacttagatgctgaaattgcagcgttagatgccaagaaataagcacataatgaaacaaaatctgactcgaagacaactactgaaacgctccgcattagccggagcgatgctttctgcacccaacacactttttgccgcagaacgccagccattacgcattccaccgattattgaagtgggacgaggtcgccctgttcgtttggatttacgtccggcacaaacacaatttaataaaggaaaattggtggatgtttggggcgttaatgggcaataccttgcgccgaccgtccgagtaaaatcggataatttcgtcaaattaacttatgtgaataatctaccacagccggtatccatcaatattcaggggctattagcaccgactgaaatgattggttcggcacaccgtaaattagcgccgaaaagcagttggtcaccgattctttccgtccatcaacccgcttgtacctgctggtatcacgctgacactatgctaaattctgcgtttcagctgtatagaggtttagccggactttggatcattgaagataccaatagcaaaacggcatcgctacccaataaatacggggtgaacgatattccgctagtcttgcaagaccagcatattaataaagacggcattcagctgctcgatttaaatcagaagcaattctttggcaaacgtttatttgttaacggacaagaatcggcttatcacaacgtggcacgaggctgggtacgtttacgtattgttaatgcgtctttatcacgagcttatgagctacgtttagataatgataaacctttacacgtgattgccaccggcatgggaatgcttgccgagccggtagaaatgcctagcgtcacgcttgctccttccgctcgtattgaagtgttagtcgacctcaatgacggcaaaatcgtctcactaataagcggtcaaaaacgggatattttttacaaagcgaaaagcctattcgccgataataacgatttagtggacaatgtcattttagaattgcgccccgaaggtatggcatcggtattcaccaccaaaccttcattaccggttttcgatttagattcgttccaactgaaaatcactcaggaacgccgtatcgcattacgcccgttagatcgtttaatcaaccaacagcggtttgatcctaaacgtattgattttacggttaaacaaggcagtgtggaacgctggtacattaccagcaacgaagcggtcggttttaccctacaaggtgcaaaatttattgtcgaaaccagagatcgtaaacgtgaaccgcataaacaactagcgtggcaagataccgtatgggtagaaaaagaccaagaagtcaccttgctggttcgctttgaccatctcgcttccgcccagttaccgttcacctttggcgtttctgactttatgttaagagaccgaggagcgatgggacaatttatcgttgaggaataagcggtcggatctgttacgaaaattgcaaattttttgcaaaaaaacaccgcttttctgcctattttccttctatcactgatagaatagatagaattttctgcaaaacaggattgaaagaatgagccaagaatatttagattttgaattaccgattgccgagcttgaagctaagattgaatcgcttcgtgctgtgagcgcgcaagacggtaaaattgatttagatgatgaaattaaacgcctacaaaagaaaagcgaagagctgacgaagaaaacctttgcgaacttagatgcatggcaagtatcacgtatggcacgccacccgaatcgtccatatactttagattatatcgaacatattttcaccgaatttgacgaattagccggtgaccgtgcttttgctgacgacaaagcaattgtcggtggtattgctcgtttagaaggtcgtccggtcatggttattggtcatcaaaaaggccgcacaaccaaagaaaaagtaaaacgtaactttggtatgccggcacctgaaggctaccgtaaagccttacgtttaatggaaatggcagagcgttttaatatgccgattattacctttatcgacacaccgggcgcatatcctggtatcggtgcggaagaacgtggtcaggcggaagctatcgcacgcaacctacgtgaaatggcgcaattaaaagtgccggttatctgtacggtaatcggtgaaggcggttcaggcggtgcattagcgatcggcgtaggtgataaagtaaatatgttgcaatattcaacttactcggttatttcaccggaaggttgtgcttcgattctgtggaaaagcgcagaaaaagcgtcaaccgccgcagaagttatgggcttaaccgcacaacgtttaaaagagttaaacttaattgacggcattgttgctgagccattaggtggtgcacatcgtgatgttgcccaaatggcacaaaaccttaaagaacgtattttagcggacttagctgacctttcaccgttaagcacagaagatttattagatcgtcgttaccaacgcttaatgagctacggatacgtttaagcgaaaacaagcggtcggattttggcaaaattttgcggaaatcttaccgcttttttatgcgcaaaaaaatagacaataaactaaaagttagaaatttgagtgaagaataaatttgaagaaataaaaggaaataaataagaatggtgccgactaccggaatcgaactggtgacctactgattacaagtcagttgctctacctactgagctaagtcggcatacttcgttggaagagccgttattataggtatttttactatacatgcaagtttatttcgtccaaattatccacaattgaacataaaaaaggaatcaaaagaatgaaaaatatcctctctattcaatcccatgttgtatacggttatgcaggaaataaatccgcaactttcccaatgcaattactcggtgtggatgtatgggcattgaatacggtgcaattttcaaaccatacgcaatacggtaaatggaaaggtatggtgattccaaaagaacaaatcggcgaaatcgtacaaggtattgctgagattgatgcacttaaacattgcgatgcagtgttatccggttatatcggttcggcagaacaggtggaagagattgttaaagcctatcaagcggttaaattacagaataaaaatgcaatttacctgtgtgatccggtgatgggccatccggataaaggctgtatcgtggcggacggagtcaaagaaggcttaattaatatcgccatggcgcacgcagacattattacaccaaatttggtcgagcttcgagaactaagcggtttaaccgttgaaaactttgagcaagcgatcgaagcggttaaagttattttaagcaaaggcccgaaaaaagtcttagtcaaacatttaagtaaagtaggcaaacaagcggataaatttgagatgctttttgcaacggctgaaggtatttggcatattagccgcccactctatcaatttgacaaagaacctgttggcgtaggcgatttaactgccggactcttcttagcaaatttattgaatggtaagtcagacttagaggcattcgaacacacggcaaacgcagtaaatgatgtgatggaaatcaccgcaaattcgggtgtatatgagttacaaattattgccgcaagagaacgcattgtgaatccaattagcacatgtaaagcggttaaaatcgcctaatattgccacaaaaaagccgaccaatcgtcggctttttttatgaggacaaactacaataatacacctgttcttggctaacaagctgcatttctaacatcgcctgagcaagcgcatactgttttatgtagccatcggaaagctggcgttcttgctcatcggttgaggtcaaaaagaataatttcgctaacttactttgctcactatttacatgaattgtgctagcaaaaccgccgattttctgcggactaaagcctaataaggttaatatttcaaacggaatattttccggtaaaaatatcacattaggataatactctcgtaatgcctgattaatttccggactattcggatggcctttaaacacaaataaataaggctcgccaataaacagttggctattgggatccaaatgttcacgaatcagtatcgcatgaatattggctaagcgctgtttatcttcaaagctaatattaaaaaatgtcgtaccgctgaaaaaataaaccggttgagcagttaacttttgcatcaatgattctaattcggtatcaatctttaatatttgctttaaccataacaaatcttcgctcgataaatattgatatgcggaaagattgagtaattgataatgccctaattcagcctttaacggttgtaacttttcatctaataaaaaatggtcagaaagcaaataatagtgcgtttcaagcacagcattccaaacatagcgaatcaaatcaatttgtgaaaatgatccttccccattctcaaataaagaaactaaagaggcttttgttgctgctaaatcttgtaccaatgaagaagatttctgtaactgatactgtttcatcaccccttccgagccgtcatcatataaatgtaaaacgatcttactgattttttccttatactgtgtataagtcggcgataaattcagaaacatctcaaaactatgaaacaaatttaaatgcaaatgtaattcgaattgtttaccttcttgagacaaaatcgtttgtaattgttcaagtaacggctccacattatgttcaacattacgagaaaattgaatgatgccttcatattgttcgataagcgtttgtggcatttcaaaacgtgctaatgaaaatagacgtaatctttgatcatcatgcttgtgtttaagaaaatgcaaaaagtaacttaaactgggaatggttgcaaaatcaatatagatatcgactgcctgtagttggggggttctttccataactttttattttaaacaataatttaatcaggcaatctagctatagcgaggtcaaattatttatagattatttgtgaatcggagaacaaatacttctatgttctgcttatttgcataaagcgcgctgaattatactctgtgattcaaatagatacaaaacaaaaaaggcgtgtctttcgacacgccttctctagcatttcgctctcaaatattaagtctaatacctaattatttgatgattttcgctacaacacctgcacctactgtacggccaccttcacgaatcgcaaaacgtaaaccttcgtccatcgcgattgggtgaattaagctaacagtcattttgatgttgtcgcctggcattaccatctctacgccttcaggtaattcgattgtacctgttacgtctgttgtacggaagtagaactgtggacggtaacctttgaagaatggagtatgacgaccaccttcttcttttgataatacgtaaacttctgattcgaagtctgtgtgtggtgtgattgtacctggtttcgctaatacttgaccacgttcgatttcttcacgttttgtaccacgtaataatgcaccaacgttttcacccgcacgaccttcgtctaataatttacggaacatctcaacaccagttactgttgtttttgtagtttctttgatacctacgatttcaacttcttcacctgatttgatgataccgcgctctacacgacctgttactactgtaccacgacctgagattgagaatacgtcttcgattggtaataagaatggtttatcaatcgcacgctctggctctggaatgtatgtatctaagtggttcgctaactcaagaattttttcttcccactctgctacgccgtttaacgcttgtaacgctgaaccacgtacgattggtgtatcatcacctgggaagtcgtattgagaaagaagttcacgaacttccatttctactaattctaataactcttcgtcatctaccatgtcgcatttgtttaagaatacgatgatgtatggtacacctacttggcgacctaataagatgtgctcacgagtttgtggcattggaccgtctgtcgctgctactactaagattgcaccgtccatttgcgccgcaccagtaatcatgtttttaacatagtccgcgtgtcccgggcagtctacgtgtgcgtagtgacgtgtttctgtatcgtactcaacgtgtgaagtgttgatggtgataccacgcgctttttcttccggcgcgttatcgatttggtcgaatgcacgagctgcaccaccgaagtgtttcgctaatacagttgtgatcgctgctgttaaagttgttttaccatggtcaacgtggccgattgtacccacgttaacgtgcggttttgtacgttcaaatttttctttagacatttttaaaagcctcttaaacaaacacggttacaaatggtacataaccacattaaccaaatgtagaaattgttactaagatttaaaacactgaaaagaagattttagaagagtagtggtgctgataggcggatttgaaccgccgacctcacccttaccaagggtgcgctctaccaactgagctatatcagcgcttggagcgggcagcgggaatcgaacccgcatcattagcttggaaggctaaggtaatagccattatacgatgcccgctgttctaaattcgtctgtccgatgtcatatgcgattcaattaagtaagaaatggtggagggagaaggattcgaaccttcgaaggctgagccaacagatttacagtctgccccctttggccgctcgggaatccctccacgataattgaatacttaatcacgatttgcaataatggtgccgactaccggaatcgaactggtgacctactgattacaagtcagttgctctacctactgagctaagtcggcgttgcgttgtcgtaagcaagtgaggtgcattatagggaaattttgaaactgtgcaagcattttttcaaaaaaaattgaaaaacctgttttttcgcttgtttaatacgcaaaacgtctgttttttgtatgttttacgtgattttaacgagataaaacgccctatttttagatttatattgtatatttgtgactgcgcattccattggaaatgcaatctgcactacctgaaaactagagaatttggctatgagcctgcaaaaatcaaacaaaattactccttttttaacttttgatcgccaaaaatgggctgaattgcgtaaatcagtgccattaaaactcacagaacaagatttgaaaccgctactcggctttaatgaagatctttcattagaagaagtgagtacgatttatttacctttggcacgtttgatcaactattacattgaagaaaaccttaagcgtcagaccgtattacaccgttttttaggtgttgcggcaccaaaagtcccttacattattagtattgccggcagtgtttccgttggtaaaagtacttcagcacgtattttacaagccttgctttcgcaatggccggaagaacgtaaagtcgatttaattaccacggacggttttctatatccgttaaaaacgttggaagaaaaaaacctattaaagaaaaaaggttttccggaatcatacgacattcatcgtttaatcggctttgtatcagacatcaagtcaggtaagcgccatgtgcaggcaccgatttactcgcatttaacttacgacattattccggaccaatataatgtggttgatcaaccggatattgtgatcttagaaggattgaatgtgttacaaagcggtatgaactacccttccagcccgcataacgtctttgtgtcggattttgtcgatttttccatttatgtcgatgcggatgaagatttgctaaaagaatggtatgtacatcgtttcttaaaattccgccgtagtgcgttttctgatccgaatgcttacttccaccattattctaaactttcagagcaagaagccattcaaaccgcttctaccatttgggacgaaattaacggcttaaatctgaaacagaatatcttaccgagtcgtgaacgtgcgaatttaattttggtaaaaggtgaagatcacgccattcaaaccgttaagttgagaaaataacagacaggcgctagagatagtgccttttttataggtaaaatttagcaaaaatttaaccgcttagataaaacgcaaaatacagcgaattagtaggcgattaatacacaaatttttgttaagctaacgttctatttgcaaaattttaaacaaaacagaccgcttgttatgaataagaaacttttacttcctctcatcatttttttagctttaaccgttacctttatggtacagctttcccgtaatgctcaaggcgatgatccgaaaaagctcgaatccgcattagtgggtaaaaccattccaaatttccaattagagtccgttttagatgagaaacagctacttgatcaaaatgtcgtaaaaacaggcaaacctcgtttattaaccgtttgggcgacctggtgtccaacctgctatgccgaacacgaatacttaaccctactggcaaaacaaggtgtggaaattgtcggtgtggactacaaagacgaacgctcaaaagcaatgaaattcctagcgaattatggcaatccttacaaagcgaatatttatgacccgaaaggttctctcggcttagacctcggcgtatatggtgcaccggaaacttttattattgacggtaaaggcgttatccactaccgccacgccggtgatgtaaatgatcaagtatggaatgaagtattaaagccgatttatgaaaaacttaagcaacaataatatgaaaaaactcctcccaatttttttaatggcaagtgccatagcgactgccgcgccggttgaattcaaccaattcgataatccgcagcaagagtcggattaccgtgcattaattcaagaattacgttgtccgcaatgtcaaaacaataatattgccgattcaaatgcaacgattgcgaccgatatgcgtgccaaaacgttggaattgttgaaacaaggcaaaaataaagatgaagtcgtggattatatgattgagcgctatggcaattttgtcacttataatccaccgataacaccggctaccgtattactttgggcattacccatcgcattactgttattcggttttgcgttgatttggagacgcaaatcgaagcaaaaacaagcggtcgaatttaacccaaattctgcagattcaacgcttgatcaagcacgtttaaaacaaattcttaacgagaaggacaactaatgaacttttggattattgtagtggcaatgaccgtggttatctgcttaattgcgttttatcctttgcttaccaagcaaaccaaacgccaaagcttaaaacgagataacttgaataaagctttttactttgaccgcttaaaagaagttgaacgtgaggcgaatgaagggataattgacgaccctgaaaaaactaaattagagcttcaacaaagtttattagacgatattcccgaacaagcggaagcagtaccgactaaacaaagtcatatcggtaaaatttggtttgcagtgttactgatcgcagttgggattatcagtaccagtgcttatgtcagcgttggttcatggcaagccggtaccatgattgatatgacccataaaaaattagaatatttttatgagcgtatcaaagatgaagacactaatccgttgtctgagcaagagttaaaccaatttgccatggcgttacgtgtcgaattacaaaataaaccaaatgacgccaaaggttggtttatgttaggtcaaatcggcatggcgaaagatgacggtcaattggcgctagagagctatgaaaaagcgagcaaattagacccgaaaaatctgcaatataaaggcagttatgcacagatactgatgttctcgcaagatcaggcggataaagccaaaggtaaagaagtgctaaaagaaattttacgccaagatcacaccaatttagatgcactgagcctactcgctttcagttcttttgaagaagaagactacaaaatggcggcaatgacttggggtatgatgttaaaactgattcctgaaggcgagccacgccgtgctacggttgaaaaaagtatcaatatggcaatgtcgatgctgaaagaacaagaaagcaaacaaccggcaaaagcggaagagaaaaaataatcacgttttagtgaatttataactgatttgggcgggtttcatacccgccctaaaattgcaaaaggataaataatgttaagtaaagagacattaaaaatcggtttggtttctgtttcagaccgtgcttctagcggtgtttaccaagaccaaggcattcctgaattacaaacgtggttggaatccgcattgactgccccgtttgaagttgaaacacgtttaattccggacgaacaagctgtcattgagcaaactctaattgaattggtggatacacaccattgccatttagtattaaccaccggcggtaccggaccggcaaaacgagatgttacgccggatgcgacccttgcggtggcacatcgtgaaatgccgggctttggcgagcaaatgcgtcaagtgagcctacatttcgtaccgaccgcaattctttctcgccaagttggtgttattcgtcacgactcgctgattttaaatttaccggggcagccgaaagcgattaaagagacgctagaaggcgttaaagacgtacaaggtaacacgctagtacgaggcatttttagtgccgtgccgtactgtctgcaattattgagcgaaatttatatcgacactcaccctgaaatctgcgaaagtttccgtccgaaatcagcgagaagataatctttaaaaaccacggaacacattcgtaactcggagaactaaacaagcggttaaatttactgagaattttacattccgagtaatctgcgtttttcgtggtgatttaaaataggaacttattatgaaaaaaatcgaagcaattattaaaccattcaaactggatgatgtgcgagaagcgttaaccgatgcgggtattaccggcatgaccgccaccgaagcgaaaggctttggtcgtcaaaaaggtcacaccgagctttatcgcggtgcagaatatgcgattgattttctgccgaaaattaaattggaaatcgtggtagcggatgaccaagtggacgcttgtatcgaagcaattatcgataccgcacaaacaggtaagatcggtgacggcaaaatctttatctatgatgtcgagcgagtgattcgtatccgtaccggtgaagaaaacgaagacgccctttaaccgtctttagcgatattatccccctgtgagaggggtaataaccaactagacatactattcacattcaaataggaaaactatgaaacaaaccggaatcaaatggttgtggctaagtttagcgactattattattgatctatggaccaaatacattgtggtacaacgctttgagttatatgaaagcgtaaacgtactaccgattttcaatttaacctacgtacgcaactacggtgcggcattcagctttttggctgatcacggaggttggcagaaatatttcttcttaggattagccattgttatttcactgggtttaatcgtaatgctgtggcgtaatcaagcggtcaaaaaattggaaaattctgcgtatgcactgattatcggcggtgctatcggtaatgcgattgaccgtgcttataatggctatgtggttgatttctttgatttttattgggatatctatcattatcccgtgtttaatgtggcggacattgccattgtagtgggtgcgggattgctcatcttggaagcattcctcgacaaaaagaaaaagagtgattaaatgaatattttattagcaaacccaagaggtttctgtgccggtgtagatcgagcaatttcgattgtagaactcgctctcgaaattcacggcgcaccgatttatgtacgtcacgaagtagtacataaccgttttgtggtggacggcttaaaagccaaaggtgcggtgtttgtcgaagagttggacgaagtgccggacgatgcgattgtgattttctcggcacacggcgtatcgcaagcggttcgccaagaagcgaaacgccgcggcttaaaagtatttgatgcaacttgcccattagttactaaagtgcatatgcaagtggcacgtgccagcaaaaaaggcaccaaagcgattttaatcggacatgaaggtcatccggaagtgatcggcacgatgggacaatatgataaccaagacgccggtattttcttagtggaatcggttgaagatattgccagactgccggttagcaaccaagacgagctgacttttatgacgcaaaccacgctttcgattgacgacaccagcgatgtgattgaagcgttaaaagagaaatatccggcaattcaaggtccgcgcaaaaacgatatttgttatgcaacaaccaatcgccaacaagcggtacaagaattggcgaaacaatcacaattggtattagtggtcggctctaaaaattcttcaaactcaaatcgtttagccgaactggcttcacgtatgggtgtgccatctaaattgattgacggtccacaagatattgatccaagctggttaaatggtgtggaaaccatcggtattaccgccggcgcatcagcaccggaagttttagtacaatcggtagtggaacacttaaaaaccttaggtgtaaccggtgtgagcaacttagaaggttgtgaagaaaatatggtgtttgaagtgccgaaagaactacgtattcatgaggtgaaataatggctgaattaaatcgttttaaaattgagtgggaatgccgccgtggtatgcgcgaattagacaaaatgattatgcctttttacaaagcgcattttgatgatttaagcgaagtacagcagcaaacttttgtggcaatgctcaaatataccgatccggaattattccgctggtttatgcaccaagcccctgcgccaacgcaagaaatgaccgatttaatcgaattgattcgttctaaaatcgagcgttaatttaccctattacaagcggttgtttttggtaaaaaatttgctagaaacgaccgcttatttttttggaaagcaactataccaatgagccgtttagaacgaatctttcacgctgttttgtttgaactcttcgccattttgtttactgttatcggtatgagcctgtttacttcgcatcataccggtttactgaccggtacgattgtctcaatctcaattgtggcgatgttatggaatatgctgtttaacacggttttcgatcgtatctttaccgcccctcgagaaactcgtacagtcggattacgcatttttcacaccttagcttttgaaggtggtttactactcttcaccattccgttggtggcatatatactcgatgttgattggtggacggtgtttattatggatatcggcatgacgctttttgtgattgtgtatgccttcttctttaatcttagttacgaccatctgcgtatttggtggcttaaacgttcaaccccataaaacaacacaggcacgagtgacagtcctcgtaccaacagggcttaaccctataaaacaagcggtcaaatttgcagaaaattttgcaaatttgaccgcttatcggtttacttaatcgtcatcatgatgacggcgatgttttttataatgtccacgatggtgaccgtagtctcgatgacctactttatgtttatgatgctttttataacgatgtgcatgcgatcgtctttcatgatatcgttctgaacgatagcgctcatcacgttctctttcgattttatgcgcattccattggcttccaaccacaccgcctagcgctgcaccagcaactgttgaagtgatatcttgccccgccactgcaccggcaacaccacctagcaccgcccccacagcagtatcatgttgtgaacgacttaacgcatgtgcggttaccgatgtcgataataaggcgatcattaagcctttgatcattactgatttcataaattacctcgaatttttcgattctaaatctgtaaaaaataaaaataataagcatagcgaatcaatttgtgaggcatattttcaatattggtcttaagctcgtcaagcctagaaaagccaactgaaacaataagatagatttgtaacagcactaaaaaatttttgaacttttcgtttttgtactatccatgtgcaattaggggcatttttttgtaaagctgagaacttcatcttttgatttgcctctaacacaggcaagataaggaactgataatcatatgaaaaaaaccgtgaattgcgtagtgaaggaaagtatcactgaagcactattacgtttaatgcaaaagaaaaatttctacactatcagcattaccgaactaactaatttagcaggcgtcagccgcatttcgttttatcgcaactttgaatcaaaagaagatgtgctgattaaacatatgtacgaacgctctgttgccacctttactgatttaaatgcaaccaatgttcgagagcgtttaatcggtttatttaaagtaactgatgaattaggcgatattttggatctgctctattcacaaaacctctcacacctctttttacaatattttgcccacacaattggcgccaagccggaacaaacaaatctggaagcatttcaaaattcaatgatgatgggaatctgcttcggtgcgttagatgaatgggttaaaagaggcagaaacgaaagtcccgagcaaatggttgaacttctacaagatgtggtcaaacgttgccttgctgactaaatacttaccaaaaatttactgatattctcatttgtctcactcgcaccaaattagtggatattcaatagaatttttttgactttaaattacaaaacttgacttttctgaaaaatcaagtacattctcatatttctgcgacctagatcgaaaaagcaatgattgcgaaatgcaatatcaaccattattcgctatggttatgctttacataaacaacttgccatccatggattggtcgcagcataacaacgaggtccaaaatgaaagaaacaaatctggatgtagtacttgaacaacgttctcccgaagataaaaaacttaagctccgccaaaccttagcggaagtgaatgtcgagctcaaattgagccatttgcgtgaagaactgcacattactcaacaagaactcgcccacaaactcaatataagccaaccgtctgtcgtagcactggaaaaacgaggtaatgatatcaagttatcctccattcagcgttacattgatgcaatcggtggcaaaatccatttagcagtttccctgcctacaggtaaatccgtgatttaccgcctctaagaataaaattttctcgttaaccaagcggtttaatttcacttacatttgcaaaaattgagtgaaattaaaccgcttacttttttgctttccttctcaatcgctccagctcttatatcaacattatttatattgcatataacaaataatgattggattttatatctagagatgattaggatctaaacgatttgtcgaattatgataacgataaagttatcgctatcacaaaacttattagaaggaagttttatgtttaatattcaaaaagaaaatgtgttagaagctttcaaataccgtcgtgcaacacgtaactatgacgcttctaaaaaaatcagcgatgaagattttgcatatattttagaattagcgcgtctttcaccaagttctgtcggctctgagccgtggaaatttgtagtgattcaaaaccaagaattacgtaacaaattaaaaccggttgcatggggtatggtggcacaaatggacgcagcaagccatttagtggtgttacttgctaagaaaaatgcaagtcacgatagcgaatacttcaaaaaagcacttgaacaacgtggtttaaccgctgaagaaatggaaaaaacgttagcgttatataaacaattccacgagcaagacatcaaaatcgcaggtgatgagcgtgcattattcgactggtgttcaaaacaaacctacatcgcattaggtaatatgatgagcggtgcggcgatgattggtatcgacagctgcccaatcgaaggtttcaactatgatgcggttaaccaaattcttgctgaagccggtgcattcgatccgaatgaatacggcgtttctgtaatggcaactttcggttatcgtgccggtgacatcacaccaaaatcacgtaaaccaatcagtgaaattgtaagctggattaaataatcacaagcggtgtaaaaaagcctaatttttacaccgcctttttattggtactctaaacgcaaaaaaggaacacactatgacattcaaagtaaaaggctttgctgccttagacccgaaatctcctctcgttccacacacatttgaacgccgtgacgtacgtgcggacgatgtggaaattgatattctttactgcggcgtatgccactcagatttacatcaagcacgtaatgactggggatttgccacttatcctgtcgtaccgggtcatgaaattattggtcgtgttagccgtgtaggtgacaaagtcagtaaatttaaagtaggcgatttagtaggagtaggttgtatcgtagatagctgccgccattgccacccttgtgaacaaggcttagagcaatactgcgatcatactgcagtacaaacctattgcgatacagaccgttttggcgacaatatgccgaccttcggtggttacagcgaaaaaatcgtggtaaccgaaaacttcgtgttaagcgtaccggaaaatttagatactaaagcggttgccccattactttgcgcaggtatcactacttggtcaccattacgtcattggaacgtaggtaaaggctcaaaagtggctgttgtcggtttaggtggtttaggtcatatggcaatcaaactggcacacgcattaggtgcagaagtgacgttatttacacgctcaccgggtaaagaggaagacgctcaccgtttaggcgcaagtcgtgtggtgatatcaactgatgaagaacaaatgaaatctgttgcgaacaccttcgatgtcattattgataccgtaccttatacacacgacctcaaaccttacgtaccaacacttgcaatcagcggcacgcttgtattagtaggtttaatcggcgatcttgatccaagcatcacgaccgtaccactcgtattaggcagacgctcaatcgcaggttcaatgattggcggtattaaagaaacccaagaaatgttagatttctgcggcgagcacaatatcgtaccggacgtagaaatgatcaacattcaagacatcaaccacgcctacgaacgtatgctcaaatccgacgtgaaatatcgctttgtaattgatatgcaatcgttgaaggcgtaatttataagaggtcgtaaatggtgaaaaatttacgaccgcttgttttaaatgttaaaatacaaacttccaacgcgaaataagatataaaattgggcattttgctattttttcagtcgtaataatgccttatttcattaactaaacgaatcaaacgatcttcacgtaacgctttattttttaattcgcattcccaaataataataacgtgaaatccagaattctcaagtaatcgaatatttttagcgtctcgttctttatttctggcaattttatctttccaaaattcagtacgactagtcggtaaaccgcctttagcacaagtatggccgtgccaaaagcaaccatgtacgaaaattgccgttttatatttcggtaagagaatatcgggtactcccgcatatcgtttatcgtttttccgataacgaaaacccattgaaaataaaaacgttctaacaattatctcgggtttagtatttttacttttaaccctagacattatttcagaacgtttttgaggagagaaaatatcggtcatttattttttaagtcttcatatttgtcaataaactcattatgatacatttttgcatttgcaagtaattcggaatatgtttttacatatacatttccatcatttctatacgaacgagcttttctttctaccgatttatcttggaccaatctttctccaattaaataacaacatactttcgtacctgtttcattccctaaatgatcttcaataaatgttacataatcaagggcttgatccagttctttatcactcaatttacttttaggacgctttaattcgataatgaaaacactgtcagcaaatctttgacataaaaaatcaattctacgatcatcaatacttaaggtgtcatcaggatatttttcccgtaatagcgttgaaaaagtaacttcatccctaaaagacataatccttgggtctaacaaccaaggaaactgttttagaaaattatgaagagttggtacttctcttgcattattttgaatatagttttcaaatttattaatcgtttctaatctaacttttgcaagtttataaaattctctggcttcaataagttgccattctttcattaaagcaaccaatttttccggttcttggaaatcatcattagcaatatcatgagcaagctctttgaaggattcaaattgataagaatcttgtacaaattgcactaaacttctggctttatctggttctaatccttctgcattaacgatctgcttcattatctttttagctaatacccgctcatgtttaggcaaagttgcataccattcttcaaaattaataccgagatctcgttcaattttttcttgtttatcttgttctcgtttacttttttgaaagttatataattttttaatcattatttgaagaacttcttcaagtcttttcgtttcatccaactcccaatttaatgaacctctatccgtcgaaattacatcccctggaaaatcttcgataaaatcaacatttaaccaaccagtaatataagaataaccgaaactggttgcagacaatccgtaaaatgaatatttgtttactaattttcctcgagaaaataaagctacgcctcgcattttttcaggaatagtctctctaccgccggcaattaacttacccgttattttttccagataattttcacaagttttttcttcatcactatttagctttaattcattccaaggactttcccaagtaactaacgtatctattccctcataacgtaaatcattagtaacaggaaaaggagatttcttattatcatcgttatgataaataaacacattaaaatcttcctcattaaatacttgaaaatatgcggagagagagtgagctaaatcctttgcgtcaaacttagactttcgtttaattttcattaacttaataatcgtaccggattctttatctacagacttcttatgatctaagatttttggatgatacgttcctttttcactctcttgattttgcatttcctcccaatctaataaaaaagttgtttgcttataattttgaattgttgaaattgtaatttcattagcaatgccaaaaaacgctaattttccaatcccttttttccctataacatcccttttaccgtttttacttttttccgatttttcttcctttcttcgattacgaccaatgactaaaaacttttgattaatttcttcaaaactcatcccatgtccgttatcttcaatgataattgacttttcatcacttttatcatttaagaaaatattaacatcttctgcttcagcatcataagaattagatacaagctcagcaacgacaggtggtaaagtagaatacatttgtatacctaaatgcgtaattacattaggatcaaatttcatttctaaaatatcattagttgatgtcattttatatctccatatatttctttgaattattcacaatcgctttaccgatttgttcagcatatttaggcggaacggcattaccgattaatcgcgctatagcctcccttccgttcgccttaaacacataatctttaggaaaggattgtaaagtagctccttcacgtaaagacaaggcccgatcttcttccggatgagcaaaacgcccgttggaaatactgaaaaattttgttgtaatcgtaggcgaaggctgatcccaccataaacgaccgaatgtatctttaaagtagttatcttttccaataaagcatttaagttgtaagtcaggtctattagcgaaagctaggcgagtaccgccatctttaggcactaaactcaaacgctgcatattaatttcggataatcctgcgcaactatgtagatattcgcttacatcttggtgacctgctggtattttaggaaatccgtttttttcacccaatacgtctcgaaccgttagtactttgtcttttaattctaaaggctctaatttatcttgcgttactcgatttgcaattaaagtgaaacgtttacgactttgcggaacaccgtagttctttgtgttgtgtattccgaaatgaaccgtataccccaattcttccaatcttcgtacaaaaatatccagaccgctttcttcttgacgagtgaaaatccccgggacattttctacaacaacatatcctggaacaaaatattctacgaatcgttggaattcggacagtaggcttttagatttttccgatttttctttactggttcgaataacactccaatattgacaagggctacaaccgactaaaatcaaattatcgtcttttcgagaaatatctagagtcttttctaattctttttccgttaattcaaaaacgtttgcatgaataaaggaagctccttttatatttgtctcgtaagtttctttacaatttatttcgtaatcgatccctgcaagtattcgaatacccgcttcttgtagaccgtaactcattcccccgccaccacagaaaaaatcaacggctttcaattgtttcatcatattttcaaccatcttaaactctatatttcaactgtataacatcactatttattttttaggaaatgataaccgtatatcctgtaataaggaagctattctagacaaccagcaagattcttttctcattacttgttaaaaaattacaactgttttcttcctaaacaactttaaagccattaaacaaaattcagttatcctaaaatttcgaataaatgttaatacgctcaaaccaaccgcactttctccagtgcggtttttatctctcttcgtccaatttctttattctgctaactaagctatgatgcactgatgataaatagttatagcgagccacaatgaactttcttgcccacagtatgatttcctttgaattagacaaaataatgccgaatagccgtactttatttggtaattttgccggcgatttttataagggacgaatcgagaatttagcggtggcaagccatattcaaaacggggtaagactacaccgcttgatcgacagcacgacagatcggcgagaaaacttcctcaatccgttacttgccgaagaattggggcgatttaaagggattgtgtcggatattgtgattgaccactttctcgcgaaaaattttaaccgcttgtttggacaagaactggcacaagttgaaaccgacattttggataacattattcaacatcaacctattttcccacagggtttctcttcgctatttaattggttggcacagaaccgagccttgtctcactacactgacgttgattttttaactgaccgagtatttacaggaatggcgcaacgtatcacacgtggcgagatactacgctccgcaggagatgtgctgaaaaagcactatgtagaactggagatattagcgatacaagaatttagctacaccaaacaggaaagtctgcgtaaatatttagcgttgttgaaccagtaaacagcaaacaagcggttaaaattcacaaattttttgcaaaatttaaccgcttgttattaatgctccttacacgcccattccgtaacaattagtttcatcacggcgatgcggttcagttcgttttcctcaaactgccaatcggatttgccggtgtaatgttccattaaatattgcagaatcgtgactttttccgaacgttcttcaatcagagaaatttcgcccttgccgataatactttgatagcggaaagaataatggcaagcaatctctgccgtcaccagttcgtgtttacgatccatttgaaagcccacaatcttttgttgtttgattaaatcgatcttcttacctttttgatgaccgtgaaaataaagctctaagcgatcatcaaattgcttgaaggcgaagttgagcggcagaatgtaaaccccttgttcttcttgaaaacccaatcgacatacatcgcactggcgcataatctcaagcatttgttcataatcattcaccgctcggtctttacgtcggattttgttgtgctgcatatttttcctgtaatgtttaagtttgatattgcaaaacaagcggtcaaaattcgcaaactttttgcaaaatttaaccgcttgtaaatattactctctcgctaaaattttctgaatttccgccataatttcttggtcttgttcgagagcgatacgatacatttcttcgtttttgaaacgctcgattttcgggtcatacacttctgacataagcttcacactatggcgatctttgccgaagtacatattgccgatttcatgcactttatccgcatccagcccgagttcgcgtaacgcttgtttgccggtacgcaatgcaccgtcaaaggtctctcgcacttcaatatccgcaccggattgtaccaactcgtaaacgtgataacggtcgtaagcacgtgcgatgattttaatatgtgggttcacgctgcgtgcgtatttcacaatttctaacgtttgtttcggattatcaatcgccacaattagcatttgtgcggtttgaatacccgccgctttaagtaaatcagggtgagcaccattaccgtaataactttttacaccacgttttttcattcctgcgataagtttcggattcagctcgataatggtcgggtgatagcctgtcatttgcaataaatgattgaccacttgtccgaaacgacctaagccgaccaagataatcgggttctgttcttcaatatgatcatgcggtttgatttcgtcaattttttgcaagcgaggcacgataaatttctggctcacaataatcattaacggcgtgaagaccatcgatagcaccacaattgccgtcatattggcgtgtaccgtgtcatcaattactttttgggcgtgcgctgctgcaaacaacacaaacgcaaattcaccaccctgcgccattacgattgcacggtcgtgtgcgtctaaattgttactgccggaaaggcgagcgactaagaaaatcaccccacctttaatcaacatcattaatgccacacccgataaaatcagccctaagttgtcccacacgacatttaagtcgagcgacatcccgaccgcaaggaaaaataaaccgagcaataagcctttgaatgggtcgatatccacttctaattgatgacggaagctagatgtggaaagcaatacgccggcagcaaatgcccccattgccgctgaaaggccactcacttccattaatagcgctgagccaagcaccacgaaaagtgctacggcggtcatcatttctcggattttggtacgtgccagcattttaaagaatggatttagcaccttggttccgataataaataagaaaaccatcgcaaacacggcaatcgaaattttttgccaaatcggcgtgctagcgctttctgttgaatgaattggcgagagaaaagcgacaaccgccaataacggtacaatcaacatatcttcgaataacaggatggagaccattttacgaccacgttcagaggtcatttcgcctcgttcacttaacacttgcatcacaatcgccgtggaagtcaacacgaaacctgccgcactgacaaatgccacctgccatgaatagccgaatgccatcactaaaccggtgagcgcaatcgccgcaccaaccacctgaaagctacccaagccgaaaatatatttgcgtaagccccacaaatgcgctggctgcatttccaatccgactaaaaacaggaacattaccacaccgagttcggcaatgtgcaaaatggtatgcggatcggaaaataagcccaaaccgaacggaccaatcgctagtccccccgctaaataacctaataccgaacctaaaccgatacgcttaaaaatcggcacggcaataattgccgcacccaataacgccaccacacttgttaattgacttgctccttctgctgccataaaacctccaaactcagagacaaaaaaacaagaataaaaataacataaaatatataaatgtttgataagaattgaaaagttaaaaaaattctaattttccaaactgctaataaagtcataaaacaagcggtcgaatttcgataaaaatttgcaaaagttttaccaaattcgaccgcttgtgcttagaaacttatcggagactacgccgctaaatactcacgtaaagcggctattgatcgctgggcgtccgcaacgcccagatcatacatttgctgtaatttatgaggatctttttccaaacgacttaacggaacggtttgtgacggacgaatcacaaaaatttgttgcgcttggtttagctgaataatgcgttctaccgtttgattgtaatcttgataacgctgttgccagcgctcaattaagtgaggataaccacgataaacccacttaaacaatgccattgaactaggctttttgcgatattccaacgggcgagttaaaaccaatacgattttgtcgtagcccaaatcaaggcacttctgtaacggaatactatcggcgattccgccgtccaaatattttttgccgttaatttcgacaaactgagacacaaacggcatagctgaagtggcacgaaacaacgccatttccttaaacacgtcttgcaccttaaaatattccggttcaccggtttccacattggtaagcgtaacccaaaagtccatttgcgattgggcaaaagtggcttggtcaaacggatcatgaatagtcggcaattcatagaaagcaaaatcatgattaatcagattaccggtggtaaaccagcttttcagacttaaaaagcgcttatcattcatatattttttgttgtagcgtaatactcgcccacgctgtttagacggcagattcaccccgaataatgcccctgcggatacggtaacggctccatcaaattcaagttgttcatccagaaatacatctaatacgccggcggtaaacattcctcgcatcgcaccgccttccagcactaatcctactttcatctacttctcctcatttgcttaattattataggcaataaaaagattaggctctatattgatactataaacgaagtaaaattccacaaacaccttatggatttaagttatttacttcatttttttggatttgtgaaaatgatcacagtatttttttctgagattttgtatgcttcgcccaactactttaaccgtagctcatcataatacttttataccagagggtaactctatgaaaaaaaccgtattaagcaccttagcattagccattgcattaggcgcaggtattagtaccgcacaagcagaaacacgtatcggtgtgaccatctacaaatatgacgataactttatggcgttaatgcgtaaagaaatcgataaagaagcgaaccaattaaaagatgtgaagttattaatgaatgactcacaaaacacccaatccattcaaaacgaccaagttgacgtattgctttctaaaggcgtaaaagcattagccatcaacttggttgacccttcagcgtcaaaaaccattattgataaagcgaaaagtgaagatttaccaatcgtgttcttcaataaagacccgggtgcaaaagccgtagcaagctatgacaaagcttattacgtgggtactgatccgaaagaatccggtttaatccaaggtgatttaattgcaaaacaatggaaagcaaatccggcattcgacctaaataaagacggtaaagtgcaatacgctttattaaaaggtgaaccgggtcaccctgatgcggaagcacgtactaaatacgtggtggaaggcttagccgcacaaggaatccaaagcgaacaaatctttatggatgcggcattgtgggatgcggcacaagcaaaagataaagtggacgcttggttatccagcggtaaggcgaaagatattgaagtgattatctcgaataacgacggtatggcgttaggcgcattagaagctactaaagcgcacggtcgtaaattaccgatctttggtgtggacgcattacctgaagcattacaattaatcaaaaaaggcgaattagccggtacggtgcttaacgatgctgccggtcaaggcaaagccgtagtgcaattagcggcaaatcttgcagaaggtaaagcggcaggtgaaggcaccagctggaaaattgaggaacgtgttgtacgtattccttatgttggcgtagataaagataatttagataaatttttaaaataagtgaagttgtttaggcacgggtggatcactcgtgcctattttttagggagtgagatatgacaagtgaagtactgctcacaatgacaaatgttagtaagtctttccccggcgtaaaagcgttggataaagctaacttaaccgtaaaatcccatagcgtacacgccttaatgggcgaaaacggcgcgggtaaatccaccctgctcaaatgcttattcgggatttatgccaaagatgaaggcgaaattttatttttaggcaaaccggtaaattttaaaacctcaaaagaggcactcgaaaacgggatttcaatggttcaccaagaattgaatctcgtaaaacaagtgagcgtcatggataacctttggcttgggcgttatccgctaaaaggaccgtttgtcgatcacgataaaatgtaccgtgataccaaagcaatttttgatgaattagatattgatgtcgatccgcgcgataaagtggcgaaattgtctgtatcacaaatgcagatgattgaaatcgctaaagccttctcctacaacgctaaaattgtgattatggatgagccgacttcttcgctttctgaaaaagaagttgaacatctatttaaaatcatccaaaaattaaaagatcgtggctgcggcattatttatatctcgcacaaaatggatgaaatcttcaaaatttgtgacgaaattactatcttgcgtgacggaaaatgggtaaacaccgttgcgattaaagatacctcaatggaacaaatcgtttcaatgatggtaggtcgtgaactgactcaacgtttcccggaaaaaactaatacaccgaaagaaaccgtactcgtggtagaacatttaaccgccaaaaatcagccgtctattcaagatgtgagttttgaactacggaagggtgaagtgttagggattgccggtttggtcggcgcaaaacggactgatattgtcgaaactatttttggggtgcgtgaaaaagccggcggaactattaccttaaatggtaaagcggtaaacaaccgtaatgcatttgaagcaatcaataacggttttgcgctggttaccgaagaacgccgctcaaccggtatttatgcaaatctcagcatcgaatttaactctttgatttcaaatatgaaatcttacttaggtaaattaggtttactcagcaataaaaaaatgaaaagcgatacccaatgggtgattgatgcgatgaacgttaaaacaccgtcccatcaaaccagtatcggttcactttccggcggtaaccaacaaaaagtgattatcggccggtggttgttaacccaaccggaaattttaatgttggacgaaccgacccgaggcattgatatcggggcgaaattcgagatttaccaattaattctcgatttagccaataaagataagggaatcattatgatttcatctgaaatgccggaactattaggggtcaccgaccgaattttagtcatgagtaacgggaaagtggcgggcatcgtggaaaccgctaaaacctctcaagaagaaatcttgcagctcgctgcaaaatatttataaaagcaaggagtgatgtatgtccgctttaaaacagaatcgcaccatggatttttttaaacaaaatgcgatttattttgtgttattaattttgttaattgtcattattgcacaagacccaagtttcttaagtttacgtaacttcagtaacatcttatcgcaatcttccgtgcgtttaattattgcgttaggggttgccggtttaattgtgacgcaaggtacagacttatccgccggtcgtcaggtgggactggctgcggtgattaccgcaaccttaatgcaatcgatggaaaatatgaaccgagtattccccgatttagctgaaattccgattccggttgtgatccttgccgtatgtgctatcggcgcggttatcggtttattaaatggttttgttattgcttatcttaacgtaacgccatttatcgccaccatgggtacgatgatcatcgtttacggtatcaactcactttattatgatgcggtaggcggttcaccaattgccggttttagcgatagtttctcctcttttgcgcaaggcttcttccgcttcggtgattttaaactttcgtatatcacaatttatgcggtaatcgctacgttaattatgtggacgctttggaataaaacccgcttcggtaaaaacatttttgcgatcggcggtaacccggaagcagctcgagtttcaggggtaaacgtaccgcttaacttgatgggtatttatatgttatccggcgtgttctacgcattcggcggtatgttagaagccggtcgtatcggctcggcaaccaataacctcggctttatgtatgaaatggatgcgatcgcagcttgtgtggtaggtggcgtttcatttgccggtggtgtcggcaccattatcggcgtggtgactggggtaattatctttaccgttatcaactacggtttaacctacatcggtgtaaacccatactggcaatacattattaaaggcggcattatcgtgcttgcggtagcgattgactcactcaaatacgcgaagaaaaaataaagattgtccttgtccaagcggtgctttttgcaagattttttgcaaatcgtaccgcttttttattgcctaaagcggttaactaatagaccgcttatctacgtatagcacattactctaaagtaattgcgtctttgatttttttcagtgccgcattttctaattggcgtacacgttcggctgaaatgccgtatttatccgccagatcttgtaaagtggctttgtcttcatccaaccaacgggttttaataatatcttggctacgttcatccaaggtcgccagcgcataagccaattgtgcagtcgcttcgcccgtatgctcttcgtcttccagttcatcggcaaagtttgagctattgtcttcaatatacattgaaggcgcataagcctcgtcatcatcttcaccggcaggcaaatcaaaacctaagtcttgaccggtcatacgagattccatttctcgtacttcttcaaccgaaacacctaaatcctccgccacttttttgatttcttcttcattaaaccaagcgagacgatttttgtttttgcgtagattaaagaataacttacgttgtgctttggtggtcgccactttcacgatacgccaattttttaacacgtattcgtgaatttccgctttcacccaatgtactgcaaaagagactaaacgcacaccgacattcggatcaaaacgttttaccgctttcatcaagccaatattcccttcttgaatcaaatcggcaagcggcagcccgtaacccaaataaccgcgcgcaatatgaatcacgaagcgcatatgcgaaagaataagttgttttgccgcctctaaatcttcatcataataataacgttcagccagctctttttcttgttcggcactgagaatcgggtattgatttgccatacgaatatagctgtcgagattcccttgcggaaccggcattccaccttgcactaaagcagggtgcatcgcctcactcggctcgttttctagcacttctacttcatccggctcaataatttctgcatcttctatctcgtgttcgtcaaattttctcatcttatttctcattggctagtcatgacccgtacattataacagcgttagaatgatccggcgtggatttcttacgaaagcattggacgacaataaaaaagcggagttcccgcctgagaaatccgctttttaagtatatgaatttatttaagctttaatggttttttcttcatgttttgctaacactaaataacccaccgcagaaaacacggaaagcgcagcaattactacataagaccagaaccaaccgaagttatccgccataatcggcataatccagtttgcgcccatattaccgagtaaataggctgtcacaccaacaaagccgatcgccgtaccggcaacatttaacggcacaaaattgatggtgagaatattcactattaattgcggaccgtaaatcaacgctcccaaaataccgcaaatcaccaacaataacggataattcggcgtaccgcttgcggcaacatattcataagcgaaaacaatacccgccataataaataagccgattgcccccatttttgccattttattcggatatttaaccgctagccacgcaaacaccaatgaccccggaatcgccacccattctaaaacagaaatcgccatatgcgattcggcatcgcccattttcgccacttcatgcaaataaatcggcatccagtcttctacgccgaaacgaataaaatagagcgccacatttaccgccgccaccagcaataatgccggatttaaaaacacatatttccaaattaattgccaatagctcagactattcttttcttcttcggttgccacattggattcgcccgcttcaccatacatagtacgtaacgaatctaacccctcaccttcaggtgtgtctccaccgaatttccaacaaaacagtgcaaaacatagcactaaaacagcaggcactaagaacgccattaacacattaccgctggaaggcacaataaagcccatggtggtcatggttgcaatcatcatcggtaacaatgcagaccccatattttgcgaaatattccaaccggcaattgccgcgccacgggttttgttcggatagtaattggcaatcatactttgcgatgccggcgctaatgccccttgcaccacaccgcataacaccaataacaccgcaagcgtaataattgaggtatggtagaaaccgatcgtaatacaaattaccgcacttgccgccaagcaaatagcgaataacttacgcaaactcacacggtcgcccaatgcccccatataaaattttgccaagccataggaaatggtcagacaggacagtaacatcgcaatatccgctttttcccagccgttggtcaccataatggacttcgacataagtttaaaattattacgcactaaatacgcacagacatagccgagaaatgccacaataaaaatcattttttggcgtttaagaaaagtagcgaacttttccggctctttttgttggtatgcgaaagtcataatgactccttatcaaaagaaaaatgattaactgcgcgaaattacaataaatcggagtctatttgtcaaaataaaaaagtgaaatattcgaactactccgcaaattaatttaccaagcggtcgaatttgcaaaactttttgcaaaatcaaccgctttccattagaattgcaagacttttggggctgattctggattcgacgggattagcgaagtccaaggtgcacgtcgaggtgcggtaggcctcgtaaacaaaccgcaaaaaaatagtcgcaaacgacgaacaatacgctttagcagcttaataacctgctcatagccttatcgcctcagcttccgctcgtaagacgagggcaacgataagtcacccaaaacgagatcgtgtggacgccgccgtttgaggatcgaaacactaaattgaatcaaactagcttatttcttgcgtgtctgtccgctggagataagtgaaactaaagaccagactaaacgtgtagtgctgaagatggagtaatttcggacgggggttcaaatccccccagctccaccaaaacacagttcgatagagttctatcaaatacgaaaaagccttgaaaataaacgttttcaaggcttttttgttcctatgtagtccaatgtaaaacaatcacatccaacaaattaagtacctaactggtataatggcattatcgttaggtacttaaacgtaaatgttaagtacctagcctctcgtaaatacttgtgataggagcatttatggcaaaagttaaaccttacaaaacaggggggcccttttttacatttattttgatatataactcaatttgatagtatttatatatgttaaggggttatcctagataactaggggacattcgaattcagtcagaataacccctatgagaaacagccgtttaagccactataaacaaaataaactcattgaactatttgttgcagacgttacagcacggacagcgtaaaggtaaaatctaaattttcattatatgcacctaataaaaaattttttgcaaaacgactacacttttaccctttcagtacctctactaacgccttaaacagaggtgtgttttgacggcggtttggatagtaaagatgatagccttcataactcattgcgtagtcatttaaaacctctactacttccccacgttctagctcttttgccattcgatctttaggcattaaagctaaacctaaatgggaaagacaggcttttttcaccagaaaattattattaacgaccaatcttcccgaaggggtaaatttaatcacctcttttgttttaggagaacgaaattcccagacaaacacgccttcagaagtcggcatacgtacacataaacatttatgtttgactaaatcgctgattgtttgaggcgtaccatgtttctctaaatattgtggggtcgccattagtgccatttgcatatcatcggaaatccgcaccgcgatcatatcttgatccacttctttacctaaacgaattcccgcatcaaaccgcccagcaacaatatcggtaaatttcatatcgctcgttagttctaatttaacttcgggatatttttccataaaaaccaacaatttatcccaaatggcatacataaaagaatgatctgcgccgttaatacgtagcgtgccgtttaaagtatctcgaaaggtgcttaatgcattcacattgtcttcaatactttcaaatagcggataaagtcgtttaaaaagctgttctcccgcttcagtcgttgcaacacttctcgtggttcgattaaacagtttaattttgagctgttcttccaatttacgcattgagtggcttaacgccgatgtggaaacgcccaaacgtgccgccgctttggtaaaactgcctgtttgcgctacgataataaaactacgcaattcgttcatattgtcaatcatctcaaaattccttgattgttgaattttgttcaaaagcgtatcaaattatcccctactaatcaaaacaatcttgctcatctataatgcactcattcaaatcaaacaggagtaaaaaaatgaaatcagtgaaattaaacaacggaattgaaatgccaatggttggctttggtgtgttccaagtgagcgatgaagacactgaaaaagcggttttggcagcgttaaaagcaggctatcgtttattagatacagcagcggtttatggcaacgaggcaggcgttgggcgtgcaatcaaagcaagcggtattccacgggaagaaattttcgttacgacaaaattatggattcagcgtgaaaacggctacgaaaataccaaaaaagcgttggaagattcactaaaccgcttaggtttggattatgtggatttatatttaatgcaccaaccgtttggcgatgtacacgagcaatggcgtgcgatggaagatttatataaagctggcaaagcccgtgcgattggcgtgagcaacttccatatggatcgcttaatggatttaatcacttgccacgacattgtgcctgcggtaaaccaaatcgaaacgcacccattctatcaacgtgatgcggaaatcgctttccataaagaactcggcatcgtgcaacaagcgtgggcaccgcttgcagaaggtaaatttgagattttcagcaacccgattttaacccaaattgcccaaaaacacggcaaatcggtggcacaagtggtcttgcgttggctcaatcaacgtggcgtggcaattattccgaaatcggtcaaagtagaacgaatgattgaaaaccgtgcgatttttgattttacccttgatgaacaagatttagcccaaatcgccacactcaaccgtgatgaaatcatcttcaatcatcgtgatccgaaaatggtgaaatggttggcggaacaccgcggataataggcaagcggtcggtttatgaaaaaacattgcaaaaaccgaccgcacttttcccccaaaggagcaaataatgaaaccaacaaaatctaaactttttccacttttattactttcagcctctatttcaatgacgacaatgagctacgccgaaacgcaagttcaggcaggcaataatattgcggtggtgcaaactcaagcaggtgcagtgcaaggttatgtgcaaaatagcgtggtaacttataaaggcgtgccttatgccaccgccgagcgttttatgccgccgcaaaaagtggcgaactggcaaggggaaaaattagccttaacttatggtgaagtctgtccgcaagtgccgatgggcggacgttcgttcttcttcacaggccctgaaatgacggaaggcgaaagctgcttaaatcttaatgtttggtcgccttcggtgtcagacggcaaaaagcgggcggtgatggtgtggatccacggtggtggttttcagtcgggtgcatctaacgatttaaacagctatgacggtgcaaacttagcacgcacaggcgatgtggtggtcgtgtcggtcaatcatcgtttgaacgctatgggctttttggacttgtccgcttatggtgagcaatataaaaactcggcgaacttgggaatgcaagatttagtcgcatcacttgaatgggttaaagaaaatatcgctcaatttggcggcgatccgaataatgttacgattttcggcgaaagcggtggcggtgcgaaagtattgactttaatggcaatgccgtctgtaaaaggtttgtttcataaagctgttgtacaaagcggtgcagtggaaaaaatgggaatgacattaacctcccaaaaagtaagtcgccgtgtagcggaacttacactagcaaatttaggcgtaaaatcaaccgcacttgataagctcaataagtttacaccagcgcaaattaatgaagcggcaaccaaagctaatttacaaaccgcaaaagagttaggtttaaccgatttatacaaccgaaatacagctttatcttgggcgccaacgcttgacggtagcattattccacaacaacctgtaggcgaaaaataccctgaaatcgccaaagatattccgttgctgatcggttcaaatttaacggaatgggaaagttttccactgcaaatggatttgcaaaattcacaaaaaagcaaccgctttacttggactgaaagtgaaacaatggatcgcttaaaagccaaatatggcaacaaaaccgatgaaatcgtggcggcgttccgtgcggcttatccaaaccgaatgattgctgatgctttatatgtggacagtttcctgcgtacgccagccttaaaaaccgcacgcttaaaagcggatcaacaaggtgcgcctgtgtataactatattttcagttgggatacgccagtgtttaacagtgtgccgatgagttatcacacctccgaaatcgcttttgtgttcaataacatagagcgtatggcacaggcgacaggtggtggcaaagatgctcaagcccttgccgataaaatgagccgtgcgtggacaaacttcgctaaaacaggcaacccaaacgccgaaggtttaccgcaatgggacgcttacactcgtgaaaatggcaaggtgatgatttttgataatcagcctgaagtgaaacaacatcacgatgaaaaattgcaacgcttattagccccgaattataacttttaaggaataatccaatgaaaaaatctgcaaaattatccttaattttgaccgcttgtgcgatggcggtgcaaagtttcgccgctccgctttccattgaacagcaaggcagttttgccgtgggtggcacggtgaaaaccagtagcggcacttatcaaccgctgcctgaaatcgccaaaggcaaagaaagcaataactttatggacgtatttagtgcgtccattcaggcaggcggacaaacattgcacggcgaccacgctagcgtgttctaccaaattccaaccaatccacgctcttatccgttggtgtttttacacggcgcagggcaatctatgcggacttggcagaccacaccggacggtcgagaaggtttccaaaatatctttttacgcaaaaactaccctgtttatttagtggatcaaccacgccgtggctggtcgggacgtagcacggtggacgcagaaatcaaagctacaccggacgatcaattctggtttgcccaattccgtatcggcacttacccgaatttcaatcaagacgttgcgttcccacaagacgaacagtcgcttaaccaatttttccgccaaatgaccccaaacacaggcgcatttgacgcaaaagtcatcagcgacagcctagatcaactgtttaaccgcattggcaacggcgttttggttacccactcgcaaggaggtattgtcggctggttagtcggtatgcaaagtgataaagtcaaaggcattgtggcgtatgaaccgggcaacttcccattccctgaaggagaagtgccaccgaccattaccagtaaattcggcgacatcaaacctgcggtcgccagccaagcggactttgaaaaactgacccaaatgccgattgtgatctacttcggcgatttcatcagcgacaactcctccaacaaccaaggcgaagaccaatggcgcatccgcctaagcctcgccaaacaatgggctgaagtcgtgaacaaacacggtggtaaagtagaagtgatcgaactgccgaaagtcggtatcaaaggcaacacccatttccctatgtctgatactaataatgcacaagtagcagagcatttggcggagtggttgaaggagaagggattggataagtaaggatttgatgccatctggagtacgccacttggattaaaaaatagagcaattattggaataccaagaaggaaagtattatgaaattaggtattgttggtacaggtatgattgtgcaagatttaatgcatattcgttcacatcttcctatcaaaaaatgggctatttatggtcgaaatcaagaaaaaacattggaattagcacaaaaatatcaaatttctgattatttttttgattatgcagagatgctgcagtctgatatggatacgttatacatcgctctgcctaatcatctgcactttagctttgcaaaacaagcacttaaagcaggtaaacacattattttagaaaaaccagtgacatcaaattatcaagaatttcagcaattaagagcattagctaaggctcaagataaaattttaatcgaagcggttacggtgcattatttgcctgcttatctcaaaattaaacagcaactctcagcattaggtaaaatcaaaattgtgagtttaaattatagccaatactcttcccgatatgaccgctttaaaatgggggaaattcttcctgcttttgcccctgagaaatcaggtggggcattgatggacttaaatgtctataacttgcattttacagtgggtttatttggtaaaccacaatcttgtttttatgctgcaaatattgaacgcaatatcgataccagcggcattatgttgttagattatccaacatttaaggttgtttgtattggcgctaaagattgtaatgcaccagtgatgttatctattcaaggcgatcagggttgtattaccgtcccgatgccggcaaatgcgatgaactactttgagtttgtggataaccgagggcaaaagcaggcatttcaatttgagcaacaacatagaatgttttatgaatttcaacagtttatacagataattgatcatcaagatagaaaagtggcagaacaaatgcttgatgtcagtgaagcggtctgtcagctaatggagcaagcaagaaaacagcaagggatcatatttggctgtgagaaaaaagatcatttctaatgataacaagggggggaatataagcccccctttacacgttattttttgaaaattattcaataatctaagcttatactatttatccaaatacatagaaacctctccgcactttgttgaatttaattcaataccctattcacttttccctatctaatcaaaacaatcttttttctctatactgccctcattcaatcaatacgaggaaatcccaatgaaaaaatcatttaagaaaaccctactttcaggtttatttatctcaacattatttttaggagcaaacgcgatggcagcagattacaaacaaaatccctttactttaacctatgacggagcgattacggaaaacgtgcaaggcaaagtgaatattcaacctgtgaaatatcaactcaacggtttgaccattgcagcaaatgtttataccccagcgaattttgactcaagcaaaaaatatccggcaatcgtagtggcgcacccgaacggtggcgtgaaagagcaagtggcgggcttgtatgcgcagaaattggcggaacaaggttatgtgaccattgcctttgatgcggcatatcaaggcggtagtggtggcgagccgcgttatgtggataaaccggctaaccgcattgaagatattcgtggtgcagcggattttatcagccaatttaaaggggtagatgcaaaccgtatcggcttgctaggtatttgcggtggcggtggttactctattaaagccgcggaaaccgacaaacgctttcaatcggtggcaactatttccttgtttaacagcggagatgcgcgtcgcaacggttttatgcgctcgcaaaccaacaacattcaagaacgtttgaaacaggcatcagatgcccgtgcgcaagaggcggctggcggtgaaattctttatacaccagcttttgccgcaggaatgacacctgaacaagtagcggcgttgccttatgatctgtatcgtcgtatcgtcaaggttatgaatattacgcgcaaacccacgcccacccgaattcgcaaaccaattttaccgtgagcagtttgttggatttgatggtgtttgatgtgaatactaatgtggaacttatcaatcaaccgttgttgatgatcgcaggtgaaaaagcggacagtttgtatatgactgaagaagtgtttgccaacgccaaaggcacgcaaaataaagagttgtttatcgtgccgaatgcgaaacatattgaaacctactggaaacctgaatatgtgaaacaaatcagcgaaaaactgacaggtttctttggtaagaatttatagttgtaaaatttataattgtaggggcgaaacatctttcgccccaatttcccgattgtttcagggcgaaaaatatttcgcccctacagagaacactctatgaaaaaaacgttgttattttccaccgcacttgctttcgccacgtcatcggcttttgcggaacaaaccattacgccttatacgcaacatcaatggacggtcgcaccgagcgagcatttttcaggggcagcacgttttactcggctgcctgaaatcccgaacagccctgacggttcggcgattgtggaatttcaggcaggtgctattaccgattggcacagccattcgcaagggcaatacttaattgttaccgaaggcgaaggacgcacgcaggaatggggcaagccgatccaaatcatcaaaaaaggcgatgtaatttggtgtccgccgaacgtgaaacattggcacggtgcgagtgagtacagcaaaatgtcgcatatcgccatcagcccgaacgccaaagaaaataaagccacttggttagaaaaagtggaactgccgaaaaccgatcccaaagccgatttgcaaaaaatcagccaaaacacaccgcttgcaaataagcaacttgccattgtgccgattgcgttccattccgcccgaggcgatttagatcatctaaaaccagccattgaacaaggcttggcaagcggtttaacggtgaatgaattacgtgagattttcgctcatcaatacgcctatgcaggctttccgcgtgctttaaacggcttactgaccttacaaaacgtactgaaagaacgcggcgaaaaaggtattcaagatccacaaggtaatccgccaacgcaagccgaaccgaccgattattacgccttaggtacgcacacgctcaacaccctaagcggtcgggataattccgctgtgttgtggaattttgacggtgtagattacgccctaaaagcccatttattcggctatttgttcagccgtgataatttgaatcccgtaaaccgtgaattggttacggtcagcacccttgccagccttgaaaccgtgcagaatcaactgcgctcgcatttaggcattttgaaaaatctaggcttaaatgaaacagaattaaaacgagtgatggataaaatccgccaacaaaacccaacagctgcggataggggggagagcgtgttgaaagacgtgtttaaggtgcaataatgcgtaggggctaatcacattagccccaaaacaatcataggaacatcagggcgaatgtaattctcccctacaaatggattttaaattttgtgtagtttacaaagtgcggtcaaaaccaccgcacttttttattccccacagctcattattgaatttcattcaataccccattcatttttccctatctaatcaacacaatctttccgacctataatgttttcaacttaatttaatcggagaaaaacaatgatttcgttagttgctgcgcctgttggcgtgttggtgggaatggggattgcgttgcagacggggataaattcggtgttgcgtaaaaatgttgtgtcgccattgttgtcgtcttttgtatcttttggctttggctctatcttattgattttgctgatttttgtgcaaaatgaaccgcttgcggtttcaacagaaacattaagccaatcgccttggtggatttggttaggtggtttgttggcgatgttcgggctgacggtcaatatcttgattttccctcgtttgggcagtgtgcaaacagcgattatgccgattttagggcaagtcatcacgggcacgttgattgacacattcggctggttttcggcaccacaatatgattttaccctattgcgcttagtcggcttagcggcagtaatggtgggcattggcgtggcgattgtactgccttcgctcaaacaacgcagcctgaaaaaccgtgcagaaagttcattgttggtttggcaaattctcggcatcagcggcggcgtggcatcaggcattacgcctgcggtcaatgctgccttacgccagactttacattccaccagctttgcggtcttcgttccctttgctatcggtacgctgttattggctttggtgatttgttgcaaagaaccaaccgcttggcgatatctcaaaaatgcgctgaaacaaccgcaaccttggtggcaatggttcggtggtttgctcggggcgatttatatcggcggtattgtgctgatcgtgccacaaatcggcacaggcggtgcgattgtaacttcgttatttggcttgttagtcggcagcttgttgattgaccaattcggcttgctcggcgcaaccaaaaaaccgattaacgccttacaaatcataggcttgctggtgttattggcgggtgtagtgattattcaaataagtaaataaggaaagcaaaatgcaaaaaataaacaaaattttagtggttggcgccacaggcagtattgggcaatatgtcgtaactgaagccctaaataaaggttatcaagttcgtgcgttggtacgtaatccaaacaaagttcagtttgataagagagttgacgtttttatcggcgatttaacccaacctgatacgttaaaaggtatttcagatggcattgatggcattattttcacccaaggcaattatgctgatcctgaaaatgtggattatcaaggggtaaaaaccattgtgaattccctcaacggtcgctataccaaactagtactgatgagtacgatttacagtattctagtcgtgaatgaactccgttttgacaatggttgtgcttggaaacgccgtactgaacgcttaattcgagcttctcatcaaccttatactattattcgccctagctggtttgactgcaatgaagcagatgaacaacagctctttatcacgcaaggcaaaacaaattactccctgaccgcaagcgatggtggtatttctcgtgtacaactagcagaaaccttagtccaggctttaacggttcccgaggcagaacataaaaccattgaattatttgccgaaaaaggcgagcggacaatgggttttaatcgtttgtttgcgacagcgattgcagatgaaccaacagaaaattttgacggaattaaagacccgaataatcgcccttttaatctagagcctgctaatgtggtacaagatttacaaagtctagcaaaaataaagcgcgcttagagggataaaaaatgaaatatttattactcattggaggacttttaatgcagcccctttctgctcaaccatttacccaaaacagtagcgtaaacgatattcttacccaaccaacatttcaagggtttgctgagcgtctgctgccttgggatgacaaaagtaatgagccaaatttacaactaaaccaaattgaacagttaatgccttatcatagccatatttcgccacaggtagtgacgacaacgctaaataaaatgctccagcgagcagaacaaggcgataccattttttacgaaatttatagcgaagtggaaaaacgccaagatccaagcaagcaacatacaggcatatttgtatttaaaggcaaaccgaatgcgccctttgcgatgattgccccaggcggtggctttgcttacgttggatcactgcatgagggctttccgattgcgcaatctattgccgaacaaggctataacgcatttgtcgtgaaatatagagcgggcatgggtggacaaatcgccaccgaagatatggctcaagcggtcgaattcgtgcaaaaaaatgcaaaaaggttacaagtcgaccctaacggctattccgtatggggcgcctccgccggggcaagaatggcagcctatatcggctcatacggcactcaggcttttggcacaacacaaaactccaagcccaacagtgtgattatgctctacacaggacacaacgattacaaccgccaaggcgaaccagcaacctttgttgctatcggcgaacaagacggcatcgcatcaccaaatgtgatgaaacgccgtcttgaaaaactcaacgaaatgggcgtgccaacagaatttcatctttataaaaatcttgggcgcggtttcgcattaggcacgggaacaacagcagaaggctgggaaaaacaggctgttaaattttggcaacagcaacgttaatatatttacaaacggtcggataagtaaacatttttacaaattccaccgcactttcattgaattttattcataagcctatttaatttttcccatctaatcagttaaatccctttttcttataataatctccattcaatcattacgaggaaaaatagatgaaattaaaaaagacattacttcttagtgcgattttatccacgaccacaacattatctgctcaagccaaaaacttgattatctacttctctcaacctgaaaactacacagccgatcaattagtggacggtgtctcaggggcgagtaagctgattaaaaacggcgaaatgctgggcgcaaatgaatatttggcgaaagaaattcagaaaaacacaggcgcggaattattccgtttggaaacggtgcaaagctatccggccactcatcagccgttgctagattttgcgcaaaatgaacagcgtcaaaatatcaagccagcgttgaaatcgctgcctaatttagcggacgtggacacggtatttttggtctatccgatttggtggtatcaaatgccgatgccgctttattctttgcttgaacaagtggattttagcggaaaaaatatcgtgcctgtggtcggtcacggcggtagtcgcttgggcggaacggataaagttattcagcaacttcaaccccaagccaaagtgaagaaaagttttgaggcgtatttacataaaacggtcagagcagagcctgaagtagaaaaacggttggcgaagttcttaactgaaaatggttataacaaataatttgtagggacacactgagtgtgtccatcttgttatattgccttttacggacacacgccgtgtgtccctacattgattattatgaagaaaaaatatctcttccaactcgctcaagatttggttctcacggcaattttgctttcgctttttggttatcatctttatgaagaaatcacgcacgaatggctcggtttagtcttttttgccttgattatctcacatctttcgctgaatatctggtggctcaaaaagctattttcaggcagctataacggatatcgcattttgcaaagtgcggttaatttggcaacgtttttgttatttttaaccgcttgtatcagtggcattatgctttctaaacatctgtttgcagaaatgccgttccactctaccaccgattttatgcgaaaaattcatatgaccagcactcattggctgcaaattttcgcaggcgtccatttggggttacattggaaagcgattgcgaatttattagcaaacggctaccgtttagatcttgaacattggctcgctcgttggcttattcctgcttgctggttgattatcgctacttgtggcattttcatttttgtacaacgagagttgttgccctatttattgctgaaagtggattttgcctatttcaattatgatgaaccacaagcggtcttttattttgacttttttgcgattttaattgcggtggcttacagcacaagatttttggtttggttaattttatttaggcaaaacaatgcaacaagttaaaactatcaacagtattttattactcattattttatcggcattgatggcatttacttcgctttcaacggatatttatctgcctgcgatgccacaaatgacccaagatttaggcggtcaagcagaattaacggttacgggatttttgattggctttgctttagcacagttgctttggggcccgattagcgaccgtatcggacgtaaaataccgctttatatgggtatggttttatttgtgattggctcggtaggctgtgcgatgtcggagacaattgggcaaattgttttttggcgtgtatttcaggcattcggtgcttgtactgcaccgatgttggctcgcgcaatggtgcgtgatttgtttgacaaaacacgcgccgtgcaattgatgttcacactgatgattattatggtggcagcgccgattgcagggcctttgattggtggacaactgctcaaagtcagctcgtggcatacaattttttatttgttggcagccattgggacgcttatccgcaaattgaactgattttactgacggatgacagtatcgcagatttaatggatggttcaattgatattgctatacgtgctgccgaaccagcccctaatagccaattgatcgtccgttaccttactcaatggcgactttgtctatgtgcttcccccgcatatttagctgaaaatcctattcgtacgccaacggatttattagcacaaaaatggctgaaatataacgatagcgtatttaataatgcttttagcaatctaaatttggggcaatttcgtagcagtaaaattctacactgcccaacgattcttgcagcgagaaccttggctatttcaggcttcggactcaccttccaacttgaaggtgaaattgcctcagcaattaaaaaagaagaattggaaatagtactgccgcatattcaaatgccgtactacaatctatatgccgtcactgctcatcgtaagcaatccgccaaaatggaatgtgttttgaaattattaaaagaaagtttttaacaaaaaatagtccaaatactccagcaaatctcacaaaaaaaccctagctctttcgagctggggctttttgtttatataagatttaatgttataacttactcaaatccactaacgcatcacgggtgatgtcgctgattttttggttgctggtaagggtcatggcaacgtgcatttctttcttgaagatatctaacatattttctacaccggctttgcctgctgcgccaagagcgtaaacaaacgcacgtccaagcatcgtagcatccgcacctaatgcgagcatacgtacaatatctaagccgttacgaatacctgaatcagcaagaattttaatatcgcctttcaccgcatcagcaattgaaggtaatgcttttgctgtagataatgtaccgtctagctggcgaccaccgtgatttgaaaccacaataccatccgcaccgaaacgtaccgcatctttcgcatcttccggatctaaaatgcctttgatcaccattggaccatcccagaaatcacgaatccattccagatctttccacgaaattgacgggtcgaagttctcgcctaaccacacgacgtaatcatctaaacctaccgctttaccggtataagctgaaacgttaccaagtgaatgtggttttcctctaagaccaacatcccacgcccagaacggatgcgttaccgcttgtaatgcacggcgaatttctttgtaatcgccactcatacccgaatgacggtcacgataacgagcacctggtgtcggcatatccacggtaaagactaaggttgaacaacctgccgctttggcacgttctaacacgtgtttcataaaaccgcggtcttttaacacataaagttggaaccacattggacgtttaattgcggcggtcacttcttcaatcggacaaattgataccgtagaaagcgtgaacggaatgcctttattttccgctgcctgtgccgcctgtacttcaccacggcgagcatacataccacaagcacctaccggtgcaagcaccgccggcattgccagcttttcaccaaataattcaatttcggtatcaagcttcgacatatcttttaacacacgttgacgtaatgctagatcggcaagatcagtcacattgcgctctagggtacgctcagcaaacgaaccgccgtccgcataatgaaacataaacggaggaactcgacggcgtgctgcttcacgataatcattggctgatgaaataatcatttttacctctttattctaaatattatggccttaattaaaatgcgaatggttaacatttagattctagatcaaaaatgttagagaagatataaaatgatgtgaattttttgtaaaaatgcgccgaagatcacacaaattctcgaaatgcgttggaaagtagggaaaaaaagcggtcaattttggtgatttttttgcaaattgcaaaagtcacacaaaaattgaccgcttatccgttaattgagggtgagtttcagacttgaggcaaagcgtgctttaagctgtgtataaagttccggctcattgcgtaacgctttattgaaagaaggcatcatttgttcaagtttagtctgccattctggcaactcatcaacaaagcagcgacaaatcacatctaacattgcttttaccgaagtggaggcgcccggagatgcgccaagcagcaccgcaagcgaaccgtcttgagcgtgaatcacttccgtaccgaaacgcatatcgttttgacgaatcacctgtacccgctgaccggcaactaacaaatcccaatcttcacttttcgcattcggcataaactctcgtaactccgccatacgttgttctttggttaacatcgcttgtttcaccaaataattggctagtggtaagtttttaacgccggcaaccatcaccgagctaaaattcgccggacgaatagaggtaattaagtcgaaatggctgccttgttttaagaatttagtcgtaaaaccggcaaaaggcccgaacaataatgtttgcttaccattgataaaacggctatctaagtgaggcacggacattggcggcgcccctactttcgctttgccatacactttagcctgatgctgggcaatcacttgcggattgttacacaccataaataaaccgctaaccggaaagccgccaatacttttcgcctcggcaatgccggatttctgtaacaaatgcaaactaccgccaccacagccgataaacacaaatttactacgatgtttacgtagctgatttgaagcgtcaatcacggaaatttcccattcgccattcggtaagcggaccaaatctgagacttgatgatttaagtttagctccgcaccttgcgaagctaaataagcgaatagtttacgagttaatgccccgaaattgacatcggtgcctcccgccatataactggcggcaaccggctggttagtgggacgatccgccatcatcaacggcatccattgtgctaattgctccggcgcttggctaaattgcatctcggcaaaaaaatgatgttgggttaatgcttgatagcgttttttcagaaacgcaacatccgcctcgccctgcacgaaactgatatgtggaatcggctgaataaattgctgcggctgactaatttttcccgtttcaaccaagtaactccaaagctgtaacgacaactggaaatcttcgaaaattttcaacgcgcgttcggtttcaatttcaccattcgcttgctgtgcggtgtaattcagctcgcataatgctgcatgaccggtgcctgcattgtgccattcatttgagctttctaagcctactgccgataatttttcaaagacactgatggtcttgtgaggtgcaagttcttttaacaacgtacctaaggttccgctcataatcccagccccaattaaagtgacatccgaaaacgaggaaacggcagaaggcgagttactcataacattcctttattaaattattgttaagtttttgtgaaattataccgtgaaataggtatcaaaaatgtgagccagatcacatttttataaactctatgtagaaatgaggcaaaataaaagcggtctctttcgtgcaaaattttgcacaaaaatgaccgcttataaagggttaatacgttatagatcgtcaatcaagctattcgcctttttcggttgatagcgtagatttaattgtgccggtacgctagtctgcccttgtggggtttgcactttcgccgccggaatgaagatcaagcggatgctgtcgtcatcaaacaccataaaccatttttgatcggttggtaacacttgccctaatttgatattgccggaaatttgtgttggttcaccgtatttctgacgtaagccttggctgacacgatctcgttcatgcgccgccagcactagattgattaattctaacttctgatcggcaaaacgaataatggcttttatcggctgttcggcaaacttaaactgattacagcgccaaacattattcgcttcaagttcttcccacacgctctgacataatttgctcttacgcacttcatcaattgaactgccaaattttagatctttatagccttctgccgccaaaacatttaaagagaataggctgattaataacattagatattttttcattggaatcctcagtaagcggtcaaatttgcaaaaaattttacaaaatcaaccgcttgtctattagggctataccctatttacattcaaagctggtagctttgttttcgtctccgccaatataagtcgcaattttcggatatggacacagcggcatttctttcgctttatttgacatctcaggtccagcttttgcaagaataaaatcaggcgctttgccctcatccgtccattgctctaacgccgtaagcgggtcgaaattctccgttgccggccccataccgcaatggttcatacccggcaccataaacacccgagcaaaaccttgtacgtcttgcatatttgcctgcaattggttataccaatcacgtaaatcatgtgcggagaataccgggtcagacacgccttcaaagataatcatcttgccgcctttcgcttggaagtaagataaatccgtttcatcggcatcatgtacccctgcgatttcagctgttttggcaacatctttatcaaaatcgaatgtgagcgtatcaaacatcggattatgcggtgtcataaaatattgcgctaaactttgtacgcccatcataaaattgatggcattcggttcagccgtttgcgaagaaccgtgtttccacactcgccagccattggtattaagccctgcgtcataaggccaagaagcatatacgttttcaccacggctattttgcgcaccaccaaaaatcgcatttaataatgctaccttttgctctgctcgttcgcctaattctgctgttaccatttccggtttaaagtcgcactgttcccaagcgttaatgatgccgtccgctaagccgtctttggcatcacactgtttcaatacgccttttaccaccacatctaaatccgcttgcgtcagcgcattggcaacaattttttcgcctttttcattggttggggcatatttcaagaaatgttggttatcccacgcttccgccacagcagctctcgataaacgaaaacccgggttgccggctaccacaccgtcaaactcttgcggataacgcatcgccgcttgcatcgcctctcgtccgccattcgaacagcccatgaagaagctcttgctcggctttgtttgatacatttgttcgatcagttgtttagcgactacagttaccttaccggtggaagccaacgcatagttaaaacgagccaattgatcttcagaaaatgagatatctcgtgaaccaccaccgtgaccgctatcggtactcaccaccgcataaccacgagaaagagccggtaaagcatccgaaccacgtaccggtgttttaccaattgcaggggaaacgatgccatttgtgccgccaccgccttgaaataagaattttttattccattgttccggtaagcggagttggaaactaatcgcatacggtttgccgtttaccccgatgcgtttttcgatttcaccggtgacaatacaatgcgcaccagcggtaaccggcttagcactcgcaccactcatcgccgcattcttatcttggggtaattcaccggctggcaaccattctgctttgataatctgcgtatcgtaaatcttcgcttcttttaatgcagcacattgctgtgcagcggacgaaggagtaggagtcgtagcatatgccatttgacttatgccgatcagcgctatcgcactggaaattgccgtgagtttgagcataggttcacttccttatcatcatgtcatcaaaataattgccgtctaataataccggcctttaaaagcgttaattgccgccagtccgaagaaaagaccaaataagaaatcgccaaaaccatagctggcaaaaaagcaaaacatcagcatagattgtccggcaagtgcatctaatttttcgggctgagttgccagccaatatgcccaagcggcggcatacaacattttttccaaacaaaaaattaatactaagtgaggcgttagccaaaagcgacgagcgaccgaccaataagccaagccccataaaataatcgcaatttgaccaagccaagagaaaacgatcggatcattttccattaaggtgggattggtgaaaaactgagtaaaacctaaaataccgacaagattatataaccctgccaaaataaagccctgaatcgcagactgtttacttaacacgaaaactctccataaataaatctattccgcatacccctatatggcaaactaaggatatgcaagttcgcattctaagactattttgcgaaatttcatacaatctatggtgcattgttatacgaatatgtaataaaaaagcggtccgatttgcaaaaaattcgacaactcggaccgcttgttgacggttagtgctgctgtgaatagaaatgttctttattcaccagtgcctgaagttgaggtaacagctgcacaatcaaacgcaattgttgtgttaacaccaaggctaatctgtcttctccggcttgatttgcaatttcaaattgatttaacgcctgatctatgtccgctagctgttgctcaatatgcgcaccgctagctttcgcataagtcatttcatctaaaaccttcacgacttttttaccttggctaaagaaaatggcggaaaaatcaatatgatgattcagttcatgactttctacccgataagcacccaatgcggaaatataacccaacaacgtataagttacccccaatagggtcggggcaaaatgcagcgcattttgatatttttgcggctcgctgtgcatatttgaaatcaccgcactcaacgctgaaatatgattatgtacgtctcggcgtgccactcgatagccaagctgatcgttataaccgaattgcagctgcgccaaaatatggcgtaaatattgcccgcttgctttcagcgtattctgtagattttgatgtaaatttaaatatttccagtccggataaataaacgaaaccgccaaccacgcaattgccgtgcctaatagtgtatcgaacaagcgaggcaataacgcattttgtgcgcctaagcccgccacatctaggctcacaaacaccaacagcgtaataaaaaaggtggaagagccgtaattgcttaccctaaaaaagtaatacaaactgccggttaaggtaattagccctaattgtgcttccaaactcggtgaaaaatattggaaacaatagccgacaaccaccccgagcattgttccaatcactcgctgaattaaacgttttttggtggcggaataattcggctgacaaacaaaaatcgcagtcagcaaaatccagtagcctttgttatctaagccggataaaaacaccagtaaactacaagcgaataccactaacgataaacgtaacgcatgacgaaatagctgtgaagaaagcgtacattggctgcgaattgccgaaaacatattgcgtaaacctgagacattttccgccgttaagcgggcggatttggcaaaatctttgcgtaaattatctactgatgtctgttgctcaatttggcttaattgcccttcaatattgcgtaagttctcggcaattgatagccaacgatgcgcactatgtagccctcttgcctgatgataattcaatgaattcaacaaaccttgtagcgctttctcgccccgcacactgtgttgatagctctctcgatgacgcagcgctgaagcgattcgttggcaagctatcgcctgaagttccatcactcgctgaaaccggaacattaaatcgctattgctgagttgttgaaaaagttcatggtattgataatgactggaacttgcgcgttctaaaatatcttgtgcagtaaagtaatagcgcaataaacggcgggtgcgaacatggcgatgttgcccttgtaaacgataaaacagtgaaactcgagtttggtcgaaagccgccatcacttgctgatttgcctttgccaacgccaattgcttagccggcaaatcatcatcgtccggatcaaaatattctgattttgcctgtaaataagcggctaacgcatcatacgctttcgctaagttttcctgcaccaaacgattcggaaaacataaatgcacgacaatactgaccagcccatataacagcgcaccggctaaaatcattaacggactgccgtaccaactatcgtctgcgctgtaggttaggcaagtataaaccgacacaattaacgtgccgaaagcaatcgtactataacgctgcccaatcgcccccaacatcactaatgcaaaagtactaaccattgccaccggcaaaaacaaccaacctacactgagcgaccactgcgcactcaaagtggataacgaaaaagcgactaaactcagcgctaaattctttactctgccggttaaactgctatctaaatctactaaaccgccggcaattacccccagcaccaatggcatagcaagatgtgacatctgtaattgccacaccacaaccgaaacaaggtttatcgcaataaagatagggaacgttttaataatattttccgacaaccagtcggtttgaatctttttgaataggcttttcataggctacaagcggtcgaatttatgcaaaagtttgcaaattttaaagcaaattcaaccgcttgcaaaagagaatggcgagatatttctttgtgcattacctaagcggtgaagattttaaaaatttgcgcaaataatcacgccttttgcattgactaacggaggataatggctagaatcagataaatcactcttaatataaaggacccatcctaatgaacttatacaacatcaaacatcccgaagaacaagttaattttgcacaaggcgtgcgccaaggtttaggtaaagatcagggcttatttttccctgaagtgttaccaaaatttgacgatatcgaggcgttactcgatttacctttagttgagcgcagtcaaaaaattcttacggcactgattggtgaagagcttccgcaagaaacggtaaatgcgatggtaaaaaatgcgtttaccttcccggcaccgctcacaaaagtgaatgacgacatttatgcacttgagctgttccacggcccgacattggcgtttaaagacttcggcggtcgttttatggcacaagcactggcaagcgtgcgtggtgacggcaaaattaccattttaaccgcaacctcaggcgacaccggcgcagcagttgcacacgcattctacggtttagaaaatatcaatgtggtgatcctttatccaaaaggcaaaatcagcccgttacaagaaaaattattctgtaccttaggtggtaacattcgtaccgttgcgatcgaatcggactttgacgcttgccaagcgttagtaaaacaagcgtttgacgatgccgaattacgtcaagcgatcggcttaaactcagcaaactcaatcaatatcagccgtttattagcgcaagtttgttattattttgaagcggtagcgcaattaccgaaagaaaaacgttcagatgttgtggtttctgtgccaagcggtaacttcggtaacttaacagcaggtttaatcgcaaaaaccttaggtttaccaatcaaacgttttatcgcatcaactaatgcgaacgacaccgtgccacgttatttaaaatcaggcaaatgggaaccgaatgcgacggttgcgaccctgtcaaatgcaatggacgtaagccgcccgaacaactggccacgagtggaagaattatttaaacgcaacggctgggcgctaaccgatttaggttcggcggcattaaacgatgcggaaaccgaagcggcattaaaaacacaatatgcggaaggttacttatgcgaaccgcacggtgcaatcgcttaccaagtgttaaaagatcagcttcaagcaggtgaaaccggtattttcctctgcaccgctcacccagcaaaattcaaagaatcggtagagcgcattttagagatcgaattaccactaccggaagcgttagataaacacaataaaatggaattgttatctgacaccatgccggcagatttcgcaaaattacgtgaatatttattagcaggtaactaatctatttagcttaaacaagcggtaagtttctgaatgaattttgtcattcagacttaccgtttttttatggagaaaatatgaataagtggttcaaaaatctaatctcatatagtgaatttcattgtaataaaatgccaaactggttaaaggttatttttgctgcaatgatttcaggagcaattctattaaacccaaaatcttttgtagaattattagatttaaattttgaggacgttaaaacacttaatagcttttggacaatatttactttaattgcttctgcaccagtcgcttttattatttggcattttcgagatcaaaatatatctcaacaaattgaaaatgctcgtaaggatactaacttaaaagaatttcagaaattagagaatcctgactggttaattacgtttgagtaaaaagatctttattatcaagagtattatgatagcccccacatcccgacggatgttgataattaattgaaatataaaagcctcccactgaagtgggagtaagatacataaagagccacagcgtggctcaacaggctcgaagagccccctaaccacgtacggctcgtgcgtggttatatgctcagctagagctgaaatgaaaaccacaagcggtcaattcttcaataacacaagcaaaaataaaggcactcgacagagtcgagcgccatcagaaaaagagcttctcagctcaatcaacatttagctaatcgcttgatttcgtctgttttgcaatacaaacactaaaacgagtaacaacgcacaagctaatgagataatgaataacgtgctgaagaaaccgttccatttgaattgttcgataatcaatgataacggtaaaccggcaattgccgcaccaatataggcaaataaactcacaaaaccagttgatgcgccagatgcatatttatgtgagttttccgctgccgccatcgcaattaagaattgtggtccaaagataaaaaagcccatcaagaaaaataaactcgacataatgaatttatcatcacttggaatcaaccataaccccaaagccaccgaaataattcctaacacataaataatgttcatttgtgtgcggttacctttaaagaacttatcggaaccccaaccggcaaataatgcccctaaaaagcccccgatttcaaagaatgcgataaccgtattcgcttgcaataaatcataatgatgggtctcggttaaatataaattaccccagtcattaataccggttctgacgatataaaccaaaccataagaaatcgccaacgcccaaatgattttatttttaaagacgtattgtttgagaatttcccatgtggttaagcctaagccgtcactttcatgtttttgttccgcaatatcattacgccactcccctacggtcggcagccccattgaagctggtctgtctcgcaataaaacacacaaaccaatcccgacaacaaccgcaatcacaccaggaataatcattccgtaacgccagccccaggctaaagttgccgcccctgcgagtaacggaatcaccgctccgcctaaattatgcgacgtattccaaatcgcccaccataaaccacgctcattacgagaataccaagtatttaaaatttttgagcatggcggccagccccagccttggaagaacgcattaatcatccacaacgtaacgaacataaaaatggaagaactcatcccaaagaagatattcaccaagccggttgccattaagcctaatcccataaaatatctcggattagaacgatctccgatgacaccggataaaaacttagatacaccgtaggtcaaataaaacgccgtccccatcataccgatatccgctttttgcagccccaaatcagtcaacattgccggcatcacaaaattaaaacctttacgggtaaaatagaaaactgcataaccgacataactgaccaacatcaactgtatccgccaataacgataggttttatcgatctcctcttttgttttggtcacaggaagatccggcgcttctttaaaaatattcatttgatactcccaatcagaaaatttactcatccgaccggactatatatgaaaattcacgctaaaaaagtgaccgctatcacattttaataatgtgcgagaacagtatttacagctatttgatttcgctaaaggttttcaccaagagccacagcgtggattaggaaattccactgtgactagagcaaaaacagcaagcggtcacattcccctaatattttgtaaatttttaggaaaatttgaccgcttgttttgacattacacgatagcgcccatctcccgacaggtgccggtaattattttagaaaggaatccatcaagtcttttgaaatcggcataagacctagctttagccccatcggtttaaaaacctgattaatcgtttctatactatagtttcctttatcattttcgatattagaaagagtttgccgagaaactttcgctaatttcagataatcttgctggtttattcccaatgcttccactcttaatcgacgcagtgcttgcccttggctaatctcaccttttaagagctgtactataatcgtttcacggattaattgtcgttcaatgccattcactttagagcgcgtcggtgaggcatttttatgttgaatcgtcataccagcccccaacgttgtaacttctcaggtaagtaatcaaaaccaatggcgggaaaatctaaaatgcttttcggaacacctcgcttcgtaagtctagattttaaatctactaattgggtcgcaagcattcttaattctcttaacaatatatctggttcaataaggtcagataaactgtcagctattttatcaaagcgatattctccggcgaactcttgagagttatctccatttttagcccaagtggtcgttctgataatgccttccggatctgcccgcatcggagcaaaatcatagataggggatagccaaatacgattatcatcacgtaaaaatgcagtatttctgccatgattatcactatttccaaaagcaatattcaacaaatccctttttacccattcaataacaaaatgccggttatcaaaatcattagaaaattgcgaagctgaaataacattgagtaagttgcgaatagtctgctcatgatcaagatttccaccatatttttgcaacatagaataaaccgattccatagcatatcgctcccattttccatctttgaacttcatatcgaatctaggtagccataaagacggataacgttccccttcttctaatttcattagatcagtatctatagttgaaaaccctaatgcacgcagctcatgataataatgatattcagctcttaaaatatcacagtccaactctgaataattcccacgaggatatttcactaaataagccgtatcgcaatctaaacctaattgcaaattatcaatccaaacttgtttatcttggcgtttaagtaataactttggtgcttctcccccagccccggtcgctccgcctacaatagctcctgtctgatttgcatattctaaaaaatcactctgcctgttttgtaccacatttaatggaaaataacgctcactttgtatttctggcacagcctctttaactcgaacattgccgataggggatattgcgccattttttagtaataagtaattttgatgagaaatagataggtgcttgatatcaagagcttccagccaataacgccgactcgctccggcaggaataatatcggcaagtgtagtcatcagcttatcagcatgatcaataaacacatttacaggataattaattgatatggatctggcattcgcttgcccaaaaaaatcgacggcatagtccgttaaatattccatgctctctaattcatactgagcattgaaataaagctccgccatatctcgccataaattatcaacataggtctgcaatgttagttttttaattttgattgatatatcactcataacttcacctttttggcttattttgtatgatatattatacaaaataaacttatggaacaagctataatctaagagaaacaagctgcttgcggttacatattactaagttctaaggataggaaacacaaaaaatacagttccacagcgtggctcaacaggctcgaagagccccctaaccacatacggctcgtgcgtggttatatgcccggggctggagtaaaaacaacaaacagtcaaatccccctaatattttgtaaattttaaggaaatttgaccgcttgtttgcgacaaaaatatcattttgatatactttgtccaacatacttgctatgcctatgactgagttttcttagttacgcacaaatttgcaggttttttttacacggaagatagaaaatggggcaatttaataaacctgcaaaatccaatcaagagcttatacaacaatggaaaacaagaggtttgattgtacctgatgaagctcgtgcggaacgttatttggaacatattagctattatcgtttttccgcttataccattccttttcaacaactcaacaatccaaatcatcacttcaagccaaatactacatttgacgatattcttaatctatacatctttgaccgtgaattacgtttgcttgtattagatgcgattgaacgtatttaagtctctgtccgtacacaaatcagcaatgtaatgggaacacaagctcaaaatcctttttggtatatgcaagaaagctatttcaaaaaggatttcaatatttatcgcttactcgctcagcttgaaaaacaactggctgaagaacagcaacgcttagagcgtgatgaaaaacatattcagaaacgctacaaaaataataatatcgatgaacaagaaagagatcgcttattaaataatgttcgtaaagaaaatttcttacgccactatctcactcagtacaatacaccgaaattattaccctcgtggatgatgattgaaatgctaacttggggcgaacttagtcatttatatgcggggctatcagaaaaacatcaaaaaccgattgccaaaaatttaggcgtacaagcgcctattttagaatcttggttaaaagttttaaatgatgttcgcaatatctgtgctcatcacagccgattatggaatagagaatttgggcgcattattaaaaccccaacgagtcaaaatacccaatggcttttatcagccattagcttaaataatactcatattaacgcagaaaaacgcctttatccgattttagtcgcaattcaagtactactttataccatcagcccaaattcaacatgggcaaaacgcttgaaggaattgttagatagttatcctgacattcagaaagaatatatgggtattccacaaaattgggaattagatagcttttgggataaggctttgagataaaaaatgagccacaacgtggctcaacaggctcgaagagcctcctaaccacgtacggctcgtacgtggtagtgaataacaacaagcggtcaaattcccttaaaaacttacaaaatatttaggaaatttaaccgcttgttgtacttagaatagtaaaactcatttctgttcagttccgctagagctactatttttgtgctcaattcgtattaaaaatcgtttcgctgaattgaaatgaatattgactaacctaaagtataagtcatttatcaggtaaaaatattttagatttaaatttctaagcattttttgagcttgaatatatgtttcataatgtcttttatacaaatccctctgtaatttatactcggagataagattaatatctttaatattcaaaagtttatctaattcattatcatcatacctatatttgtttttaggtatttcaaagtcttctaataatgttaaatatcctgatttctgcaatatatcagagaaacattgatcgaattctctattgtttataagaaatgattctacatcctgcagagtcaaaaattcagcatttgctaacttggaacactcatcaattaaaaagtttgtacttttcttttgaacttctaaaaaattttcactttttgcaaactcaatttcttcttgtgttgctaaatttatacaatcatttacacattcaagctcttgactattttcaagatcagcgggtgtacaaatttcagcctcctgaactaaatttattcccgcatctttaaatgctaaagctactaactttgaacaaaattgtttacgatcatcatcagtaataaaagaaatcttagttccaattgccaataatgtagaatatggtgttccaattttactccttacactagaaactatcctatcaatataaggagtaatatcttttttataccttaatactttaacatcactaggttgtttatatagcgtcctctttatattattggaatgaacgccatcagacaacgcttcaatacaagaaccttgactccaacaaattttagcatgtgagtattggctgtttgttgcaagttttataccattcgaataccatgaatccccagattctaatataatatccccttttttcagtttagcaatgtccaagatatatagcttttcatcttctttaaatgttattttttgttttaccataaatatattttcattcccttatgaggcttttacttattctaataaaaacatgagataaatattaacaaaatgtaaaaagtaaatactattaaatacagaatcaaataaggacaacaaaaagacaaccaccttccagcagttgccttttcttttattaacttacgcttggctatttaagtgccactctcgcatttctaaacaatctcatccacgccccatcttcggtccagtcttctggatgccatgagttgctgactgcgcggtaaacacgttccgggtgtggcatcatgatagctacacgtccgtctgtgtttgagattgcggtgatgccgtttaccgagccgttcgggttagccgggtaaacttcggtcggttgtaagttgttatcgatatattgtgcgatcacaagtttctgttcggttaagccggcaagttgttgtgccgatttgaattctacttgaccttcaccgtgtgaaacggcaatcggcatatgtgaacccgccataccttggaaccaatggctgttggtttcgttgattttcactaaaccaacacgtgcttcaaagcgttccgacttgttacgcacgaaacgaggccagttttctgtacctgggataatttccgcaaggtttgaaaccatttggcaaccgttacacacacctaatgcaagcgtattcgggttggcaaagaattggctgaactgttcacgcaacattgggttgaataaaattgatttcgcccaaccaccgcctgcaccgagtacgtcaccgtaagagaaaccgccacacgccactaacgcattgaaatctttaaggtttcttctacccgccattaagtctgacatatgtacgtcaatcgcattaaagccggcacggtcgaatgccgccgccatttcgtaatgactatttacgccctgttcacgcaagatagcaatagtcggtttcacacctttattgataaacggtgcggtaatatcttcgttaacatcataggttaagaaggttgataaacctttgttgttcgggtcttttttggtttcaaactcttgatccgcacattccggattatcacgtaaacgttgcatttggtgggttaattctgcccaaattccacgtaattccgaacgtttttcgttaagaagtttgaggctgccacggctaatcacaaaacgatcgtcttcgtgtaccgtacctaaatctttggttaagcccaataagttatgtgcatttaacacttcacgtacacgcgctaaatccgcatcttttacttgaataaccgcaccaagttcttcgttgaacaatactgctaaatcatcatcacctaacgctgaaatatcaatctctacgccacagttgccggcaaacgccatttccgcaagcgtggtaattaaaccaccgtctgaacggtcgtggtaagcaagcaatttgtcttccgccactaaagtctgcattgcattaaagaagtttttgaggctgtctacattcacaacgtccgccggtttgtcaccgagttgtttgtaaacttgcgctaatgcggttgcacctaaacggtttttaccttcacccaagtcgattaataataggcttgataagcctttatcggtacgtaattgtggggtaacggttttacgcacatcttccacacgagcgaatgccgaaatcactaatgaaagtggtgcagttaccgatttttgctcgccattttcttcccacgtagtgcgcattgacattgagtctttacctaccggaatcgtaatgcctaacgccgggcaaagttcttcaccaactgcttttaccgcttcataaagaccggcatcttcaccttcgtgacctgctgccgacatccagtttgccgaaagtttaatacgttttaattcaccgatattggtcgccgcgatattggtgatcgattctgccactgcaaggcgtgcagacgcaccgaaatctaataaagcaaccggcgcacgttcgcccatcgacattgcttcaccgtggtagctgtctaaacttgccgtagttaccgcacagtccgctaccggaatttgccacgggccaaccatctgatctcgtgccaccataccggttaccgaacggtcaccaatggtaattaagaaggttttttctgcgacaaccggtaaacgtaacacacgatgtagtgcttcttttaattggatttgttggctatcaagcggttgattttcaaccgtttttgacgaaacatcacggtgcattttcggcgttttaccgagtaatacgttcattggtaaatcaatcgggttattgtcgaaatgatcgtccttaagcgttaaatgtttctcttcagtcgcttcaccgatcactgcaaacggcgcacgttcacgctcacataattcggtaaataatgctaatttttccggcgcaaccgctaatacataacgttcttgtgattcgttacaccaaatctctagtggtgacatacctttttcgtcacataaaattttacgtaaatcgaatttaccgccacgatcgccgtcgtggactaattccggcattgcgttagataaaccgcctgcacctacgtcgtgaataaatagaatcgggttgtcttcgcctagttgccaacagcggtcgatcacttcttggcaacggcgttccatttccgggttttcacgttgtaccgaagcaaaatctagatcttcttttgatttaccggaagccatagacgaagccgcaccgccgcctaagccgatgttcattgccggaccaccaagtacgattaatttcgcaccgaccggaatttcgcctttttgcacgtgttcggcacggatattaccgataccgcctgcgagcataatcggtttgtggtagccacgtacttcttcgccggcaaagctatttactttttcttcataggtacggaaatagcctaataatgccggacgaccaaattcattgttaaatgccgcaccgcctaatgggccttcgatcataatatcgagtgccgaagcgatacgattcggttttgaaagcgggttttcccacggctgttcaaagtttggaatcacaaggttagacaccgagaaaccggttaaacctgcttttggttttgcaccgcgaccggttgcaccttcgtcacgaatttcaccgcctgaaccggttgctgcgcccgggaatggcgagatcgcagtcgggtggttatgggtttccactttcattaagatatgtgcatcttcttggtgcgcacggtattgaccgtcttgatccgggaaccaacgaccgactttcgaaccttccattaccgccgcattatctttataagctgaaagcacgtaatcaggcgttttctcgaaggtgtttttaatcattttgaataatgatttttcttgtttttgaccatcaatcgtccaatccgcattaaagattttgtgacggcagtgttctgagttcgcttgtgcaaacatataaagttcgatgtcgttcgggttacgatttaaagcagtgaaattttccactaaataatcaatttcatcatccgctaacgctaaacctaagttcacgttcgcttcttctaacgctttacgaccgccatttaaaatatctacggtggtaaatggcttcggctcctgttgagcaaataaatttgccgcttgcgcttcgttatctaacaccgtttctaacatacggtcgtgtaataaaccttttaaggtttcgatttgtgctgctgtcggctctgcgctgaattcaaaatagtaagctaaaccacgttcgatacgatttaccgcttgtaagccgcagttgtgtgcaatatcggtcgcttttgaagaccatgaagagatggtaccgatacgaggggtcacaattaagcaaaaaccggtcggctcgtgttcggcaagagtcggaccgtaatgtaaaagctctttaatttcagcggtttgtgctgcgctaagttcagcatttaaatcgacaaaatgcacatattccgcatagaccgattttaccggtaacgcattttgttggaatttagtttggaattggttaagacgaaattcagagagggcaggagagccacgaaaggtttgtacagtcattgttgattccgtatttgagaaataaaaaaattctctgccattatagcggataacgcaaacgtttgcattgcaaaattttactcaaataacacgaaaatcggattttatttccatagaaattttaagaacgttctcttgaaatttttcagattaaaaatataatgcaaatcatttttattattataacaatgtttttatatgctaaataagttttcattattgctcagcttgagcttttttttattaggttgcactcaaaaatcactttcagaacaacaactacattcacttggcaacattatcgatttaaaaactcaacaatcgctttccctatcagaattactacaacgcttacccacttacacttatgtattgatcggtgaagagcatgaccaacccgttcaccatcaaatcgaaacttacttggtgcaaaaattagagcaaaaacgaccgcttgcggcggtggtgctggaaatgctctcagttgatcaacaagcgcaaatcagtcacttgcaacagtcacaaacaccgttatttgccgaagaaattccggcacaaatcggttggaagcactgggattggcatcaatatcaagatttaatcattagccgtttgtcttcaacgacaccgttaattgccgctaatttaactgaaactgaagtcaaaaccttatatgccggagcacagccgttacgaggctcaatttctgtgacaccccaagttcaaacacagttggcgcaactgattcaggcacatcacacgttgcccacagatattttagaaaaaacggtaaccgtacagcaatttcgtgaccgccgcatggcggaaatgctggtaaaaaatacgcaaaattcaaccgcttatgccctcttggtggcgggtaataatcacgtacgcaaagaccttggcgtaccactccatttacaagactttgataagaaaaataaagcaaaaacgatttcaattatgctcaagagccagtattcggaagctaaagccgtcacgctacagcaagccgactacgtttggtttactgagtaatttttataacatctataattaaggagaatgaatgagattaaagcgtttaaatcaactattgcttggcagtttagccggcgttacttctctacccggtatagcggcggaagaaaatatgaccttggatccggtttatgtcttagaaaaaaatcaaacgaacgctaattttgaatcatacggtaaagccggtgcgacaagcagccgtggtgtcggcgaaaatgcaatgcaaaatctggatagcgtggtgcgttcgatcgccggcgcttatacgcaaatcgacccaggtcaaggtgcggtaagcgtgaatattcgcaacatgaccggtttagggcgtgtgaatatgatggtggacggcataccgcaaacccaattaggtacttcggcaaacggcagcggtaaattccacgaaggaaacgggccgatgagccaattcggggcgttaatcgaccaaaactttttgacacgtgtggatgtttctaaagggcattcggacggtgctgctggggtgaacgcattaatgggcagtgccaattttaaaacgatcgatgcggaagacgtgcttttggaaaaccgaaaagtcggcgcattaactaaactgaatatcggttctaacggtttaggtcgcaacggaatgctcgcagttgcggcaaaagaaaattttgcacaatcaggcagtctcagcggtttatttgcgctgagcaagcacaaattatcgcaaaattataaacgaggtgatggttcttcttctgaacaaaccaattatttgagcggactcgaccagcgacctcgttcttatttagccaaaatcgcattaaaaccggaacaaaacagcgaattaaaagtctctcgccgtgtttatcataacaacattgccgggcgagaaattgacagttacaccaatgcgctcgaagcaaaatacgatgcccatccgtggttaaatttacatttactcgcttctaacagcagaacatcgcaggtttataaccaaggcgctacactctggactttaagtgatgcggcaacgttaaaccgttctaacacatttgatatacacaataatgcaaaatttgattttgggcatagtaacttagatatcgcacttggtttgaacttctttaacaataaatacgtgcgtcacttaccgcttaatgaaaataataacagcggcgcagtagccaatagtgcttttgcaccgcagggcaaacaaaaaattaaatcattctactggaacactatgctggaaacaggcatttttaccctgaaaaccggcgcaagccattcacattaccgcttaaccggcgataaaccggaatgtgatacggatgatgcgatctattgtgttccctcttggcgtttaaatattaatcgcaagtacagttctgctgatccatcagtaaatttatccgcaaaagtgaccgcttggttagagccattccttgaatatacagagacgactcgtgcgccgaatgtacaagagatgtttgatactaaccgtaacggcttaagtgttaatccgttcttacgcccagaaagtgcgaaaactaagcaagccggttttaatatcactcaagataaagtattcactgaaaacgatatgttaggtttaaaagtggtttattttaattcacatattaccgactatattttcaaagagtctttttacggttgcggcaaccatttatgcaacgacttaaatacatccgatggttcgctgcaaacacaactttatgtcaatgcgccaaacaaagtaaaaagcaaaggctgggaaatcgagctcaattacgacgcgggacagttctttactaatttttcctatactcgtagtgcaaccaccgctccaacatccgttggtgcaattattctcggcggattcggtacggaatcttatacggtacaaccgaaagatcacgctacattagaactcggaacacgcttattggataaaaaattaacgcttgcaacccatttgaaatacaccggtaaagcgcatcgtgtacatattgaaggcgttgattccgacgataacattctgatcgaaaaactgccgaaaatcccgttaattgtcgatttttatgccaactataaattgaaccgacatgtcaccttaaaagccggcatacagaacctgatgaataaaaactatttagacgcactgaactcgtacaactcttctactcatgaagattatgatgatgataccggactgtataaattcagtaataccgcacgtggtagaacctacaccgcaggtgcggaaattcgtttctaagtgcggaacaagcaggagaacaacatgaaactggtaaaatttttggcttttttaaccgcttgtatcggactgaatccggcgctggcacaagaacgtatcgtcagtatcggcggtgatgtcactgaaattatttacgcattaggcgcagaacaagcacttgtcgggcgagacagtaccagcatcgcaccgcttgccgcacagcagttaccggatgttggttatatgcgccaactaaatgcagaaggcattctggctctcaaaccgaccaaggtgattagctccgaagtcgcacaaccttctgccgtatttgagcagcttaaaagcgctggaattacgattgaacgagtaccgtttgaatattcaccggaaagcgttattcataaaattcagctcattggaaaattggtaaacaaaccacaacaagcggttaaattagccgaaaaatttacaaatgagctaaaagctgtctccagttcaccattaaatgtgcgcgtattatttattcttaatcatgccggttcaaattatatggctgccggacaaaataccgtagcagataccgccattcgcttaatcggcgccaccaatgcgatgcaaaacagtgtacgtttttcaccgatttcacaagaaggtgtgattgccgctcgtccggatttgttagtgctgacgaaaatgagtttggaaagtttaggctcaatagacaaactctgggagttacccggtatgtcgctaacccctgcagcgaaaaagcaaaatgtgattgtggtagatgatttagccgtactcggttttagcctgacaacaccgaccgaattattaaaaatgcgtcaagccgccgaacaggtgcgacatgactaaaacgatttggttagttgctctcggcttcgcactgttatgtagcgctattcttgcagccaaccttggcgctctctcgattacttggcgtgatttatggcaacttacttttgatgatagccaatggcaaatttggctcaacatccgactgcctcgcattttacttgctattttagtcggtgcggggctagcgattgccggtacgttatttcaaggtttgtttcacaatccgatggcggatccggcattaatcggcgtaaatagcggtgcatctttagcagtggcgctatttatcttgctgccaaatattctgccggaacaatggctattgtacggcacaatgttggtcgcctttagcggcagtatattggttgctacactgatttattggttgggatatcaaggacaagcttcggttaataagctattgctagcgggaattgccgttaacgccctttgtttttccttggttgggattttgacctatgtgagcaatgaccaacaattacgccaatttagtctatggaccatgggcagtctcggacaagcgcaatggcaaccgctgatagttgcaagttgtgtgatgattccgaccgcttgttttgccttaatgctcgcccgctcactcaatttactgcagctcagcgaggaagaagcgcattatttaggcgtaaatgtcgtgcgcttaaaaaaagcgttagttttaagcggtgcgttattagtcggttgtgcggtagccgtcagcggtgtaataggttttatcggtttggtgattccacatttagtacgttttaaattcggtgccgatcatcgttgggtaatccctgcctccgctatatgtggtgcaatcctattattatgggcggatactttagctcgtaccatagttgcaccggcggaaattccagtaggaatgctaaccagctttctcggcgcaccctactttttatggttggtaattaaatataaggaaggcagatgatttgcaaaaaatccgcagaatttgaccgcttatccgaggtattaagcgccaaacaattggcttatcggattgatgggcactctattttacaatcggtcaatctgtcacttaaatccggtgaaattagtgtgttaatcggcaccaatggcgcaggaaaatctacgctgttgcgattacttgccggttatctgccgccaaccacaggtaacattcagctcaaccagcaaaatttagctggttttcgaccgcttgcattagcgcatcagcgagcggtgatgcagcaacatagccaaataaactttccgtttttagcggaagaagtcatccgaatgggcagctatcaacgccatattagtgagacggatatagagcaagttgtgatggcaaccgaatgccaatcattgctgaaccaacagtatcgtgcgttatccggtggcgaacagcagcggattcaactggcgagagctttattgcaactctggcagccggatatgcagggtaaaatcttgtttttagacgagccgacctccgcctttgatttataccatcaacaagcctgtttgcgtttattacgcaagctctgtgatgaacgaggcttaacggtttgtgccattctgcatgatctcaatcttgctgcgctttatgccgatcagctgatgttattggctgaaggaacaattcaggtgcaaggcagcccgcaagcggtcataaatcaggcaaatattgcaaaatggtatcgttcggaagtggcgatcgtttctcactgtattcattcaaccccacaagtaatgctcttacgttaaaaaattgtaacgaacaagtaacattaaaattgcacataaacggaattttttaagtatttaaaaattccgtttatgctgtttctttcacagtaaattagattgcaatttatattaattaggcggaaaataataaacatatttctgaaatgccgtttcagaaatgatgtaaactcaatttcatcttaattttcatttataggattattagtatgggtctttttgaacaaactaaccctaatcgtcgtcgttacggtttagcagtatttatcggtattatcgccggcattatttccgcattcgtaaaatggggtgcagaacatccattcccaccacgtagcccgatcgatttattccaagcagcgtgtccacaacctgttttagatgcgttaaattcaggttcattagcgatggaaggtgcattagcacaatgttcacgtgcggttttaaacccaccggcagttttcttacgtgattacattggtatcgacccttataacaccgtggcatttacttttgcggatcacccgtttaactcaatcggtgtaacacacatgattttctcattagtgttcgctatcggttactgcttagtggcggaagtgttcccaaaaattaaattctggcaaggtatcggtgcaggtatcatcgcgaatatctgtgtacactacatcacattcccggcattaggcttaacaccaccggtagcggaatggcctttatatgaacacatttctgaattagtcggtcatatcttctggttctggacaattgaggtaattcgtcgtgatttacgtaaccgtattaccaaagagccggatgcggaaattcctttagatcaaccgcatcgctaatcgaaacacttgtttcaaccataaagccacccactggggtggctttttcataacaaaaaattataaagaatagcttcttatactttccatttccgatggattcgatcgaaaatcttttccagttttttaagcatttttgtcttaacctcacctactacttactatgaattggtcttacgttgttaatgcgattccacgctttattgacgcagctatcattaccctccagctttcgttttgggggattttgctgtcgttagttttcggcttattgatcgcgattgttaccgcttatcaagttaaaccgttttacggattaactcgtggttatattgaattatctcgtaatactcctctgcttattcaactcttctttctttattacggcttaccgaaaattggcattaaatgggacggttttacctgcggtattattgcgttagtttttcttggggcaagctatatggcggaagcgttacgtgccggtttacttgccgtgccgaaagggcaaaccgaagcagcaaaagcaatcgggttaaatcgttttcaggtgtttcgctatgtcatttttccgcaagcttgggcggtatccattccggctatcggcgcaaatgttctgtttttaattaaagaaacatcggtcatcagtgcagttgccgtagcagaattaatgtttgtgaccaaagatattatcggtatggattacaaaaccaatgaagccttgttcttattattcgccagctatttagtgattttattaccgatttcgctgttagctcgccactttgaaaataaagctcggggtgcaaaatatggggtttgattggttattcgaagggcaaaatgccgcaagactcgcacaaggcttatggctaaccgcccagatttcgtttatttcggtcggtttctccttggtattcggtacgctattcggcttattgatgcgagccaataatgtttttgtacgtgccgtttgtcgtttttatttggaaactattcggattgtaccgattctagtttggctatttgcgctctacttcggactatctacttggtttaatctgcatatcagcggtttttgggtatgtatttgggtatttaccttatggggtgttgccgaaatgggcgatttggtacgaggtgcgttagcctcgattgaaaaacatcaaatcgaatccgcaaaagcattaggtctaaatcgttggcaaatttttcaatatatcgaattaccacaaggtacacgccgagtattaccgggggcgattaatctgtttacccgtatggtaaaaaccagttcgctcgccgccttaatcggcgtgatcgaaatggttaaagtcgggcaacaaatcattgagaatgcgttattgacgaaccctagcgcctctttttttgtctatggattaatctttattttatattttctgatttgttacccgttgtcactgcttgcaacacgcttagaacacaaatgggagagctaaatggcgttactttctatccgtaatttacagaaaaaatatggcgaaacggtcgcaattcccaatttagatttggatttagccaaaggtgaagtggtggtaattttaggcccgtccggctgtggcaaaagcacgttattacgttgtgtaaacggcttggaagaaaaacaaggcggcagcattgtgatgcaagatgttggcaaattcggcaaagatttaagctgggaagcctctcgtcaaaaagtcggtatggtgttccaaagctatgaattattcgctcatttaaatgtgatcgagaacattttattaggcccgcttaaagcgcaaaaacgctcacgccaagaagtggaggcgcaagcggataaattactcgctcgtgttggtttactcgatcgaaaaaacgccttccctcgagaattatccggcggacaaaagcaacgtattgcgattgtgcgtgccttatgtatgaatccggaagtgattttactcgatgaaattactgcggcacttgatccggaaatggtacgagaagtgcttgatgtcgtgttggaattagcggaagatggaatgtcaatgttaattgttactcacgaaatgcgctttgccgaaaaagtggcagatcgggttgtctttatggataaaggcgtgattatcgaacaagcgccaccgcatcaattctttacacagccacaaaccgagcgagccaaacaattcttaagcggtatggcttattaatttgcagtattcaagcggtcaaattttgctaaaattttacaaaatacggcttctagccgagcaacgattttaaacaggagcattttatgaaactgaacacaacattaaaaacattactggcaactgctattgccgcttttgccttaacggcgtgtgacaatgggaatagcacacaatcttcctctcaagatagcgttgcacaaattaaacaaaacggtgttattcgtatcggcgtattcggcgataaaccgccattcggttatgttgatgctgagggtaaaaaccaaggctttgatgtcgaaattgctaaagaaattgctaatgatttactcggtagctcggataaagtggagtttgtgttaactgaagcggcaaaccgtgtcgaatatttaaaatcgaataaagttgatctaattttagctaactttactaaaacgccggagcgtgccgaagtggtggattttgccgcaccttatatgaatgtggcactaggtgttgtatcacccaaaggggcgttaattaccgaccttaaacagttggaaggtaaaactttattagtcaataaagggacgactgccgatgcctatttcaccaaaaatcaccctgagatcaatctgttaaaattcgaccaaaacacagaaacctttgacgcgcttaaagacggtcgtggtgtagccttagcccacgataatgcgttagtttgggcgtgggcgaaagaaaacccgacctttgacgtagcaatcggtagcgtaggtcctgcagaacaaattgctccggcagtacaaaaaggtaatcaagcactgttagatgtgatcaacaaagaaattgccgaattaaaagcaaatggcaaactaaaagcggcttatgagaaaaccttagtgcctgtttacggtgataaacctgaattgcttgcacaataatccgttccctttacaaaagggcccgaagaaagtgtctgtttcttcgggctttttaattggctaaaatttactttatcggtactagagagtaaactctatgttttgtaaaagattatttacgcatcgatttaaacaaagttagctatggcaaaatcccttattttctcacgtggaattttaaaaatcccgcaccttaatgctttcttacatgacagtgagattattgcttttcctcatctaggaaccgcccctctagtggacaatgtcatcggctggggattacgcccttctacccaaaaagctcgagattatgcgcaaaaacatggcttactttatatcgcattagaggacggatttctacgctcgcttggtttaggtgtaatgggatatccgccgttttcgatagtttatgatgatgtcggtatttattatgacacgactcgaccatctcgtttagaagcactgattttacactcgcagcttacgccggaacaaatgtgtgctgccgagcgagccatcagtttaattcagcagcaccaattatccaaatacaatcacaatgttgatttcgatgtgcccttagataccgcagcacctatcgttttggttatagaccaaacattcggtgatatggcggtaaaatttggcagtgcaggcgaagaacagtttagacagatgttagaggctgcaatccgtgagaaccctcaagcacaaatttgggtaaagactcatcctgacgtaattagcggtaagaaaaaaggctatttaatcgatttacatagctacggtaatcgtatccgtttatttgccgaggacgttaatccgctttcgctgcttaaacaagtcgataaagtttattgtgttacctctcaaatggggtttgaggcattattactcggaaaacaagtgatcacatttggcgtaccatggtttgccggctggggcgtaacagacgatagacatccagatattgaaattttaaaacaggcacaacgccgcaaaaaccgatcgtttattcagttatttgctgcagcttatttgcaatatagtcgttatatcaacccgaataacggcaagatcggtacaatttttgatgtaatagactacctaagcaaaactaaagcattaaatcaacgtctaagcggaagtctttattgcatcgggatgtcattatggaaacaagcggtgattaaaccgttttttgatttacccttatgtaaattacattttgtgcgttcgctaaaaaaacttgaaaatcgaccgcttgcatcggatgcaaaattgttgatttggagccaaggtaaaccggaaattcttgcctttgcagccaaacaccagttaccgatattacgtatggaagacggttttattcgttcggtcgggctaggctcaaacttagttgcgccattatcattggtagttgatgatttaggcatttatttcaatgcgcaaacgccatctcgcttagaagagattctgcaatatcaggaatttagcgagcaagatttagcactagccaaacaattacgacaacgcctgattcaagctaatatcggtaagtacaatgttggtaataccggtttccgcttatcagttaccgataaaaaaacgattttggtgccaggccaagttgaagacgacgcttctattcgtttcggttctccgcaacttaagcgcaatgttgatttgctcgaaaaagtcagagaattgaatccggatgcctacattatttataaaccgcatccggatgtggtcagtggtaatcgacaagggctggtagttcacgaacaagcggtcaaatttgccgatgaaattgtagaaaatgccaatattttagattgtattaatcaagttgatgaggttcatacaatgacctctctggctggatttgaggcgctattacgagggaaaatcgtgcattgttacggcttaccgttttattccaattggggattaacgcaagatcatatccctcttacaagacgtacgcgtcaattacgtcttgaagaattaattgctgcggtattagtttattatccgcaatatgtcgatcctgaaaagagagtcatgattgacgctaaccaagcaattgcgattcttcagcaacaaaaacaaaaattagcaaacagcgggattaaacgcccttggattgctaaacaattcggtaagttaaaacaactttaccgaaccttaaaatattaaaaataaaattctcaaagagtatttaacgatgatcaaccattatttagatgatttgattgagcaatcaaatcggattttgctattgcaaggtccgataggcgctttcttcacccaattatcggaatggttacaaactcaaaatcgcagtgtatttaaaattaacttaaatgccggtgatgaatttttttatccgaatagcattgctaatacctttgcttatcgcgataccttagaaaattttcatcaatatttaaccgacttttgccaaacgcataacattgatagcgtggtatgttttggtgataaccgtaaatatcacaaattggctaaaacggtttgtcagcatttaaatatcgcattttgggcttttgaagaaggttacttccgtccggattacgtcacgtttgaaaaaaccggggtaaacgcttattcacccattccaaagcaggcagattatttccgagcgttcgaacacttatcggagccaaacaaagcacaaagtgtagccaaaggtttctgcccgatggcaaaactggccatccaatattacgtgtcggcatattatcgccgtcatcaatatccggaatatcgccaccatcgtttattaaatgtgtggtactacgtaaaattatggatggtttcagggattaaacggctgcactattatatgcacgatcgcaatttttctaagcgtgttgagcaaggcgaattcggtgagttttttattttgccgttacaagtttatgatgatagccaaattttagtgcatagcgattatcctagcgtagctgcagtgttacgggaagtgttgtcatcttttgccaccaaagcaccgaaacatttaaatttaatcgtaaaacatcatccgatggatcgtggctttattgattacggtaaagtgattgatgaatatatggaacaatatcctgatctgaaaaagcgcatttactatattcacgatgtgccaatgccggttttcttgcgccacgggaaaggaatggttacgctaaatagtaccagcggtatttcagcgttattacacaatatgccggtcaaaaccttaggtcgagccaattatgattttgccgggctaacctatcaaggcaatctagacgacttttggagcaatccagaaaaaccggatgatggattatttcatgcttatcgtaaattccatctgtataaaacgcatattaacggtagcttctataacaaggtaattctgcgttatccatacaaccaaaagtagctgacaagcggttatttttcgagacttttttacaaataaaaaagactgcgtaatttgttttacgtagtcttttttgatcatacgaaaagttaaaaaatcacttctaaacgcacaaaggtattaataaaatggttacgatctttgtctttatcgttataaaaactgatttccggttgaataaatacccaattgcggaaaatggattgacgatagttaatgaacggcccgtaagtattgaatttggagtgatctttatcaaaacgtccccccataaaaataccgtagcttagacgtttaagtggtgcaaaattatgctgacgatataagctattaccccaaccggtttcttcatccacatcgtgcgtatattgtaggaaagtatgattcataatgaaggtgttttcactatcaatataacgattttctaaattggtacggaggtaatgcttactattggtaccataacgataaatttgttctaaacgagtaccgaagttatcggtcatctcccacgttttacttagacgtaaacgaccaaagatatcaccgcccgaacgtaaaccgccgtccaaatcactttcaatccctaaacgtttaatttcatttgaccaacgtaaaccgatagaggcgttatcgttacgagcttggcggctgtcataattacgatcacgaggcaggttacggtaattttgtccgacatgatttttatcgcgcgcttggttttccaaatcctcatcaccgaataccacgctgacgtgttttttcagtaccggtaatctgattttgcctcgtacacgaggtttataagaaaaacgatcgtgtttattccattgattgtctaacatcacacgtaaacttgccgatgccggtttacttggatccgtttcacccagccaatcgttaataccgtttgaccaatcgtgtaatttcgaacgaatcgaactgcgttgttgatccgcccaagtattttcagcatcatttgtttcattcgcaacagaggaaacagcaaatgttgtaaataatgcgatataagtaagtttaaaatatttcatgtgagttatctttatcaaggaatttgcccgtatcataatccaaatgagtaagtgattcaaaaaatacctttcgtttaaaaaacaaaaaagcggtcgatttgcaaaattttgttacaaatcaaccgcttgtatgctttaacgcaatactaaacattacgcccaatatttatcaatttcagcacgaatcgcttccgcagtttgtttacctttttcacccactaaagcgcgaccggcaatgaaagctttcgcatttttgatttctttaaataagtgaatttcttccggtacaataccaccggtaatcgataattctaagccgagtgcagaaagttgtttcattagttccacgtcttccgccgtccaacccttacctgctaattccgcatcgcgagaacggtggtaaatcgcttgttttacgcctaattcaacccattctttcgcatctttttctactgtccagttgccgtaaatttcgatttggatttctttcttcacttttaattccggatgtgccacattgaaatcatccgccactttcttacacgccgctttagttgctggatgtgctgctgctgaaacagttaaccagtctgcgcccgcttcaaatgccattttcgctaaaatcgccccaccgtccgtggtttttaagtcacatacgataatatggttcgggtgtaacgcacgtaaagttgaaaccgctttcatcccttccgcacaggcaagaatcgtaccgcactcaataatttctactacactttccgcctgttttgcatctgcaaccgctttttctaaacttaatgaatctaatgcaatttgaagtaatggttttgacatattttgttccttttacgaatttttaaattgttctttattcctctctcccgcaagcaggagagagaccgcttgttgaagcgtttagcgaaacaagcagagagaggaaatttctagccagctaacgcctgatcaatcaccgcataaacatcttctttagtttggcaacgtaagattttggctaaatcgactcccgtatcactgtccggatcatccaatacttgggtaatttccattaaaccttccatatgtttatccgaatcactaccggctaaggtgacaaataccgaaacaggctcatcttcgccatcaaaataaaccggctcttttaaagtcactaaggcgaacgaggttttaatcacaccttcttccggacgagaatgcggcatcgctaaacccggtgcaagaatgatatacggtcccattttttcaatattttcaataatactggtgtaataacgaggttcaatcgcgcctgatttttctagaacatccgtgcctaatttaatcgctgctttccaatctgccgcactttgatttaaaaggattgagttattttcgataagcgattcttttaacatagctttacttccttcaagttggatagctttaaatcaaggtaaccacctcccttcttggaaggtggccttgagggttattgatattttttgataagagccaataactcttcaccaaaggtattcggatttaacatattttgtacgcctaatactgagatatgatcatttgccacaatctcattttgtaagtgtttagaacatacgatgatatctaccgaaccgactttacctttatggtcggttaccgcacatgaatccatcacatttggaataccgcgtttatcaaggtattgtttaattttcattttcatcatcattgatgaaccttgacccgagccacataccgctaagatacgcaccgcttttacatcaccttccgcattgccttctgtagcttgagctggttcagcttcttgttcagccggttcaccgaaaccgtacaattggtctacagttttgccttctgctttcgctcttgcttcgtcagcacgtaattgtttgcccgcaaatgccatatatacaagcgctaacacgatacatacgaaggttgcaccggtcgggctaaagaacataccttggataatcggtgggaataataacgcccagtccgccatacccatccagccgttaaagcctgcaccaccttctgtgctggtaattaagcttactacccatgcagaaccaagcacttcaataatacccatcacgaaacagattttcattaccgctttccaaccaccgaaatggtttgcgaatacaccgattgtcgcattagagaagaacatcgggataaagcccggaataattaataccgcagctgaagcgtcaccgccaccgaattgttgataagcaattaatgcgcctactgcaacaaactgaccgatagcaccccacatgaaaccgaataccacagcatttggcgagaatgcataagttgccgcacagtcaatcgctaatactgcatttggaattaaacgttcggaaatccctttaaatgattcagataattccgctacgaacatacgtacaccaagtacgataacttggattgccaccgcaaattttaagccggtttcaaagatgtaaatcgtccagtgcgttttacctgccatttgttgtaggttatctaaaccgaatgacattaggataataccgaagaacactgtcatcacgatcgcggttgcagagatactgtcgtggaaaatatgtaaccatttaggtaagttgagtttatcaaccgtttcttcttttttacctaatttcggtgcaacttttgctgctaaccaagatgcgaattgttgttggtgaccgatagagaaacccgcaccgccggtaatttgttgagttgcttggtacatcatattagagaagataccccaatagagcgccataatgattgcagtatatacgaccacttcccacggttttgagccaagtacccagaacactaccgcaactaagcctgcttgttggaacataatatgaccggtaagcataatggtacgaataccggtaaagtgtctgaataatacaagtaggatattaaggaataaggctaaaattactgcataacccacatacgcataagcgtcacccatggtactcattgtcgcttgccaacttgtatatgggtcaatcaccgcacctttaaggttatggtatttagataaaccttcgataaccggtttaaagttttgcacaagcgtacctgaaccgacttgtaccaacataaaaccgacgatcgttttaatggtacctttaagaatggtagttgaatctttttttaggaaaatgtaaccgatacaagcgacaagaccgagtaacagcggtgctttcgaaagaatctggtcattgattgccataaagatactcattactgtatccatagtgagcctctctttttatgttgagtaagaatgatgagatttggaagatctcgttatttttagattggttaagttaaagattaaaaaaatataggcatatctatacctacagaacaaatgataaacagttatcgcacctcaaaaaagattatttttgattatttgtgagcaagatcacattttatttttcattttcgtgattttcgtgttcatttgttaaaaatatgtataatccttttttctcccctctcgtcacaaacacaaataacctattgattttattagaaagtaatcgtttgttaagtttcaaaaaaacacaagataaatgagaagaattcctatccatgcagaatcgacgaaaaaattagaggtagatcacattttttaaaaaaagcgttttacaaaaaaatatgattatttatgattgcacttgattaaatatttcatcttttccttattatacaaactaggagtttactatggcgaacgttaatgaaatcacacgtgaaagttggattctttctaccttcccggaatggggtacttggctaaacgaagaaattgaagaagaagtggtaccggaagataacttcgcaatgtggtggctaggttgcgtaggcgtgtggattaaaacacctgcaggtgcaaacatttgtatggacttatggtgtagtcgtggtaagtctactaaaaaagtaaaagatatggtgcgtggtcaccaaatggcaaatatggcgggtgtacgtaaattacaaccgaacctacgtgcgcaaccgatggtattagacccgtttgcaattaacgaagtagatttcattcttgcgtctcactatcacagcgaccatattgatgtaaacgttgcagccgctatcgtaaacaatcctaagttaaatcacgtgaaatttgttggcccatggcactgcggtgaattatggaaaaaatggggtgtgccggaagatcgtatcattgtggtaaaaccgggtgacattgtaaaaattaaagacgtagaaattcacgcattagattcattcgaccgtacttgtttagtaactttaccggtagaaggcgcagaagaacgtggcggcgaattaaaaggtttatgtccgtctgacgaagaaatgggtcgtaaagcagtgaactatgtattcaaaactccgggcggtaacatttatcacggtgcagactcacactattcaatccaatttgcaaaacacggtaaagaattcgatattgatgtagcgttaaataactatggtgaaaacccagtgggtattgcagataaaatgacttctatcgacttactccgtatggcggaatgtttacgtgcaaaagtgattattccggtacaccacgacatttggacaaactttatggcaagtacgcaagaaatcattgatttatggcgtatgcgtaaagatcgcttacaatataaattccatccgtttatttgggaagttggtggtaaatatgtttatccgcgcgataaagacttaattgagtaccaccacccacgtggctttgatgattgcttcgagcaagaaccaaatattcaatttaaatctatgctttaattgaagttaagccactcttaattcgaattaggagtggcttctttagtaattgttcatgatttaaaacgtgataagaatgaaaagggaaatagtcatgaatgaaagttttagacataaaaaattattagccatgttagaagcaagacaaatgctttctaccttggaaattatgaatcttttaaatatttcgccggcaaccgccagacgagatattaataaattaagcgaacagaaaaaattacgcaaggtgcgtaacggtgcggaagcaatcggcacacagcattcgttagaaaaagataaaccaattaataattttgaagaaaagcgccgcattgccgaagcggcaagcaagttatgtcgagaaggcgatagcgtacttctcacctgcggctcgactatgcaattacttggacaagcgttatgcggtcaaaaattgcaaattattaccaattttctaccgcttgcgaattatctgattgagcatcaacacgaagatatcgtgatcatgggcggacaatacaataaaaacaaaaaaattaccctatcgctcaatcaacaaaatgaatttacttatgcggcaaatattatgtttaccagcggtaaaggctttactcaagaaggtttatttaaaaccgatatgattattgctaattccgaagcgcaaatgtcatcgaaggcgaataaatacgtggtattgctggatagcaccaagctcggcacagaaatcggtatgttattcaaagacattcgccacattgatttgctgatcaccggcaaagaagctgatccaaaaattatccaaacaattagagataaagggttggaagttattctggcatagcaacatttaattatattcataaaaacaagcggttaaatttacctgattttttaccaaaagcatcattcaaaccaggggatgaatatgagaaaacataaactcggtatctatgaaaaagcattgccaaaacatatttcttggcaagacaggctttctattgctaaagcatgcggttttgattttgtggaaatgtctgttgatgaaacggatgaacgcttggcccgcttagattggacaaaagaacaacgtatagaattagtgaaagcgctcatcaataccggtgtaacaattccatcaatgtgtttgtccggtcatcgccgcttcccgttcggttctcgtgatgaagccactcgtcaaaaagcctatgaaatcatggaaaaggcaatccaacttgcagtggatttaggtattcgcaccattcaattagccggctacgatgtgtattacgaagaacaagacgaaggcacaatcgaacgtttccaacaaggcttagaatgggcgaccgaactagcggcaagtaaccaagttactctcgcagtcgagattatggatactaagtttatgagttcgattaaacgttggaaaaaatgggacgaaattatcaaatcaccatggtttaccgtctatccggatatcggcaacgtttcggcttggaatgatgatattgaagcggaatttgccttaggcatcgataaaatctcggcgattcatttaaaagacacgtataaagtgaccgaaacgtgtaaaggacaattccgtgatgtgccgttcggtgacggctgtgttgactttaaaggtttctttgaaattctcgccaaattaaattatcgcggtgcgttcttgattgaaatgtggacggaaaaagcggaagagccaattgcagaaattattaatgctcgccgttggattgaacaaaaaatgaaagagggtggtttccaatgttaacagaattatctccaaaattattggcaatgcgtgatcgtgtatttaaagcgaatctggaattaccaaaatacaaattagtgactttcacttggggtaacgtgagtgaaattgatcgtgaaaccggttatgttgcaattaaaccttccggtgtggaatatgaaacaatgaagccagaagatatcgtatttgtcgatttgcaaggtaacaaagtattcggcgataaaaaaccttcgtctgataccgcgacccatttagagttttatcgccaattcccgaatatcggtggcgtagtacatacccattcacgccatgcaaccgcatgggcgcaagccggtgaagatattcttgccttaggcacaacacaaggtgattacttctatggttcggtgccttgtacacgccgtatgacaccggaagaaattgccggcgagtacgaattagaaaccggtaaagtggtggtagaaaccttccgtaaacgtggtattaatccggatatggtaccgggcgtattagtccactcacacgggcctttcacttggggtaaagatgcgcatgatgcggtacataattcggtagtgttagaagaagtggcgtatatgaacttcgttagccaccaaatccgtccgaatatcggttcaatgcaacaagaattgcttgataaacattacctccgcaaacacggtgcgaatgcgtattacggtcaataagctttgttgaaattgtgtgtgtttaagcggtcaaatttgcagaattttttgcaaatttgaccgctttttgatcggctatttctgaattaaatagcgtaaaattggcccattttgttccacgcttaataaactataaccgtgatttttaacatctacgggaatattattaatcgattgagcgcaatcacttaacacttccaatacttcacctgattttaacgtcggcatcgtttccaatgttgcaattgccggatacggacaaggttcaccgagcatatctaaagtgtaatccggtgtaatttccgaagggtgtttatcttgttgttgaattactgtaaaagccataatattttccttatttctcaatcacggcaagcattatgccgttgtatcaccttgaattgcagcaaggcgagcttttgccttacgcagaaagcgtttttcccaccaaactacaaacactaaacaagcaatcattaagccataattgagtaataaacccgagataggcccgaatgatttcaataaattgattttttcataatctaatgccaataccggtgcgagactatcccaccaatatgccagcaaggttgagccggccacattaccgacacctacccacataaaatggacctgcccttccatcgctcgatacatccaaccggtttcacagccgccggcaagcacaataccgaaaccgaacaacaaaccaccgatgactgcatttggccccgcccacataattttcggatttgctcccaactgaatatagctaaacacacagatagtactcaccaacatcccatagataatcgccttacccatataagcacggccggttgcccataagtcacgaaaggcggaagtaaaacaaatttgcgcccgctcaattagcaaaccgaatcccaatccgaataacattgcaaaacctaatttaattgaactttgcatcacataaaaagaagcaatcaaccaaatggcaaagatcaacataccgaatctaaaacggtgtttagcttgctgaggatccgcgtgctctactttgcccgcgccttttttgagtttcaacggcggacgaaatatcggcagtaaggtaaattttacccctgcataagagccgatagcggtggttaatgtgaaaaaccaggcatgtaatgaaaactgaggaataccggtaaacaacgaagccaaattacagcccatggctaaacgtgctccaaaaccggctaatgcgccgccgatcaaggcttgtacaatacgaatccgattttgcggcatccgaatcttgatattatttgcccagagcgctgcggcaatacagccggcaaacatccccagaatcatcaacccgtcaatacggctgaaaatcgtaccgtctaaaccaataattttgtaatagccccagtctgagacatttacccccatagactctagaatctctccaccccaacgagtgaattctcctgtcacggcccaatatgtgccagtcagcccaaaataataggcagaaaggatacccgcagcaataaccgccgcagtcggattccaaaatctaatcaggtaatcttgtttgaattgttgccatatttctaacataaaatttcctaaatagaatatgaagaaaggcaagcaggtataacgatgaataaatagaattgcgcctaaaagcgatgattgaatttgctcatttcctatacacaaaacttgcgatataaataaatgatgtcaaaagacgtataaattctaatctttttaattccgttgtcaatttaggcgtaaaaaagccccgagcttattttgctcggggcttggttttcatataacaagcggtcaaattccgccatttttttgcaaattataggatatctaataattccacttcgaaaattaaggttgcaaacggaggaattgatgcacctgcgccacgctcaccgtatgctaactcttgtggaatagttaaacgccattttgaaccaactgtcattaattgtaacgcttcagtccaacctttaattacgccgccaaccgggaattctgccggagtaccacgttttacagaactgtcgaacaccgtaccatcaattaaagaaccggtataatgtacacgcactgtgctgtcagccgttggttttgcaccagtgccttcagttaatacttcatactgtaaaccagactcagtaactacaacgccttttgctttcttgttttcttctaagaatgctttgttgtccgcttcaatggctttaaatgcttccgcttgcgccgcttctgcacgagcgcctaactcttgtaacgctttagtcacttcgttaaggtcaattgccggtgggttttgatttaatacatcgttgataccacgtgcaaccgcttcggcatctacttccataccgctacctaataattgttgaccgatttgtaaaccaataccgtagccaccttttgcttctgtgctttctaaagcaactgcgttgaaatctaatgccatttgttgtttccttttttgttaaaaaatataaagacgttcaatgttatgggggtaatttttgaaaatacaagcctgataacaaagaaagcggtcaaatttggcaaattttttgctaaatccgaccgcttgattcgtattgagtttaaattagaaagttaaatacggtgcaactttttgaatggttgcttcaccgataccagaaatgtttgataattccgctacatttttgattttgccaaccttattacggtaatcaataatcgcttgcgctttcgcttcaccaatgccacttaatgtttgtagtgttttcgcatccgctgtattcacatttacttttgccgatgcgggcacttttgcggctgccgattttgttgcggccactttttcagcagcacttgctttcactgccgttgttttctctgctgcttgcgctttaaccgctttcactttttctttagcgtttgttttcacgtcatctaatgcattcgctttgctcgctttagacgtttttaacgcttctttagcgttggttactttatccgtcgcagatgcttttactttcgctaagttttcttttgtcgcagtcactttatcagttacttgcgttttagcggttgctaatgtttcttttgctgtcggcgctttgtttgctaccgaactttttacttgtgtaacttgattagttaccgcacttttagcattgtcttttactgaagttaatgggtttgccgtctctgcgaatgaagtcgtagaaactgccattgctacgcctaaagctagaagagtttttaatgatttcataatttgcttcctataaaagttacggatatacaaaaggggaaagtcgagaggtctgctcaacttaaactgaattctaagactgaatgcaaaaatattagttcaagtttattagccgaccgaatgaatattgtacagcattttgcctaaaattttgttctaataataaccttttcgcctatcattaagataagcgattaaatgagtgtgacaggataaaaataatgaatataaataacgaattatcacaagcgattttagctaccgtgcaacaagaagttgtaccggcattaggttgtactgaaccggtttctttggctttggcatctgcggtagcacgtcaatatttaggcgcattaccggatagaatcgaagctaaggtttcgccgaatttaatgaagaacggaatgggtgtaaccgtcccaggaacaggtacggtcggcttaacgatggcggcggcaattggtgcaattggtggcgatccgaacggtggtttagaagtcttaaaacatattactaccgagcaagtagaacttgctaaacagatgattaacgagcagaaaattgaagtcagtatttctgacactgaacatattctctattccgaagcggctttgtttaaagccgatcagcaggtaaaagtacgtatcgcagctcaccataccaatgtgatttatattgagaaaaacggcgacttgctgttttccaaaccctgcgtagtggaaagcgaaaatgcagagaatgtctttgcaaatctgaccgcaaaagatatttatgatttttccttaaatattgcactagaaaagattcgctttattcaacaggcggcgattttaaatagcgcgctttcacaggaaggactgaatcaagattacggcttacatatcggacgtaccttgcaaaaacaaatcggcaaagggttaattagcgatgatttgctcaatcgtatcgtgattgaaaccaccgccgccagcgatgcacgaatgggcggagcaaatttaccggcgatgagtaattccggttcgggtaaccaagggattactgcgacaatgccggttgtcgttgtcgctcgccatttagccgctagcgaagaacagctcactcgagccttgttcctttcgcatttaatggcgatttacatccatagtaaattaccaaaactttctgcgttatgtgccgtaaccacggcagcaatgggcagctgcgccggtgtagcatggttattaaccggtaaatttgaagcgatcagtatggcgatcagcagtatgatcggcgatatcagcggcattatttgtgacggtgcagcaaatagctgtgcgatgaaggtttcaacgagtgtgagttccagttataaatcaattttaatggcgttggatgatacccaagtgactggcaacgaagggattgttgaacatcaaatcgaccgttctatcaacaacctttgtgcgatcgcttctcgtagtatgcagtacaccgatcgtcaagtgatcgaaataatggtgagtaaacctaaaacgctctaaacatcttctcataaaatcatagcgctaatcttattacattagcgctatgctcttaacgtcgaatcgcacaatcaaaattacaaattatatacagttctatattaacttttgacaattattgaaaaaagcgattcataattgagcaattgtaagttttgaaatataatctatagactctttttttgatcgatacagggttctcaaaacggatgcttagaattatcaataaaattgtctcatcttcactttcaatagcgtttttaggagcgcttagttggtcagccgcttattcctatggatgggcacaagcttatttctacggattttcgtggtggtatgttgatgttggtgccggcaatgtcgctcgtagcttaggttatgtgctctatgtcactttagttctttgttccacctatttaatcggattgttcttattagtaaaagccaaaccgtatctcagtcattcttgtatcaaaatggtacgtgcaggtattttatgtgcggtaaccttcttacccattttaatcgttagtaccttaattaccggtaaaatctatcaactggcagtgatatcttatttctgtactgtcttcatttctacgtttttattcagcaacccgattaaccgtcatatcggtaacattaatattcatacggcaattaactttttccaaagccacaaaaactatgtgatgatttttacctacgcatacttcgtgttatttgcttttctggtcggttacttacgccctcactttaaaacacgttttaatatgctcgaggtagatcataagatgtactatgtactagctaaatataacaagacctttatattgtctaaagaactaaaaattgataacgatgatttttatctctatgaattagtgccgaaccaattaggacacgttcaaatggtttgtattaatcacccgttttaaacgataaataaaaaagcggttagattctgcaaaaattttgcaaaatttaaccgcttgttcaataaattacattagtttttcattgattgaaccggtgccggaattcgtccgccacgatttacaaacacttcgcacgaaccttctttaaccggcataatcggcgcatagccgagtaagccaccaaattccacgctttcgccaacgtctttgccagttaccggaataatacgaactgctgtggttttgctgttgatcataccgatagccgcttcatcggcaatgatgccggaaatagtgtgtgccggtgttttacccggtacggctatcatatctaaaccgaccgaacaaactgccgtcatcgcttctagtttatctaaggttaaaataccgctctctgcggctgcgatcataccttcgtcttccgaaaccggaataaatgcaccacttaaaccgccgaccgagctagatgccatcataccgccttttttcactgcatcatttaacaatgctaacgctgctgtcgtgccgtgtgtaccgcatacacttaagcccattgcttctaaaatacgagcaacggaatcaccgattgccggtgttggtgcgagcgataagtctaagataccaaacggaatattcagcatttttgacgcttcttgaccgattaattcaccgacacgggtgattttaaacgcggttttcttcactacttcagccacttcggttagtgttgtcgcatttgaattttctaacgcttctttcaccacacccgggccggaaacgcccacgttaataatcgcatccgcttcacctgaaccgtggaatgcgcccgccataaacggattatcttccaccgcattacagaacaccacgattttggcacaaccaaaaccttctggggtaatgtcagcagtacgtttaatcatttcgccggcgagttttaccgcatccatattaattccggcacgggttgagccgatattaatagagctacatacgatatcggtagttttcattgcttccggaatcgagcgaattaaaacttcatcggaaggtgacatgcctttttgcactaacgcagaaaatccgccaataaaagagacaccgatcgcttttgctgctcggtcgagtgtttgtgcaatagaaacataagaatccgctttagttgctgctgcaatttgtgcgataggggtgacagaaatacgttgattaacgataggtacgccatatttggcagaaaggattttggcagtttcgactaagtctttgccgatggtggtaattttttgataaatattttggtttaattggtcgatatcagcactgatacaatcgtgtaaatcgataccgatggtaatggttcgcacgtcaaaattttggtcggcgaccatttttatcgtttcaataatttcgctggattgaatactcatttcgccactcccttaaatacggtgcattgctttgaaaatttcttcgttttgaatacgaatatctaacgcaagttttttactttcttgtgtgaaaaattcggctaattgtgggaatgatttttcacattttgttgtatccaccaaaatcaccatggtgaaaaagtcatccattaattgttggctgatattcacgatattaatttgattttccgctaagattttcgatacatcgtacacgatacctacacggtcttttccaataacagtaatcactgaattgctcattgttgcttcctcgagtttgcatattattaaataggaagaatgagtatagcgctgtttcaattttttgactagataaattgcgcaaacgtttgcgcaattaaaataaaaaaccacggcagaaattccgtggttaatgtttaaactaaatcgaataataaaaattcaacatcgttatccgtctcaatcgtcaataattgctcagcacggatccctaacgcatcactggtttcaacttttgtaccgtttacgcttaattgacctctcactacttgtaaccaatatgaacggttgctatccaattcaatttgcgcactttggtttgcagaatactgataacgccaaagtttcatatcttgataaatcttaaatgaaccttgttcggcagtcggcgataaaattaacgtaccaccttcacgatcggcaaatttatcttggctgtaacgaggcgttacgtctttttgattcgggataatccagatttgataaagatgtagcgtatcttctaagtccggattcatttccgaatggaaaatccccgtacctgccgacataatttgaaattcgcccgctttaacctcggtttgattccccatactatccttgtgagcgacacgcccgttaagtacataagtgaggatttccatattatcgtgtgggtgcataccgaagccacgtgccggtgcaataaaatcttcattaatcacacgtaaatgtgaaaaatggatatgcttcggatcataataattggcaaaagaaaaagtatgataactttctaaccaatcaaatgaaccgtcgcctcgctcgtttgcttttctaacttgtaacattttaaattccttatacatttgctattttttgcggaaattagaccgcttatgaacggcgagcattttaatgttatttttaacggtaaataaatatataatttattgaataactatttactattagttaataatattcttattgcaaatgaatttcagaatcattaataggatatatctattatgtaatgcattttgattagttttaactattaaaaccaatcacacttatcagtgataacaattagacagcaacataactttcactcataattcacccagttaaatgatgaaaaagaaaacaataggagtataaattatgacaaataaaacgattactttcccagtattaaaattaaacactcaaacacaagaattaagtgcagatatcaataaaaatgcctctcataccgttcccggtttaaccgtttctaccggtcacttaatcgctgatgcgctacaaatgcgtttacaaggtttaaatgaattatccatgatcttaaaacacgcacactggaatgttgttggaccaaattttatttcggtacacgaaatgttagacagccaagtggatgaagtacgtgattttgttgatgaaattgcggagcgtatggcagcattaggcgttgcaccgaatggtttatcgggtaatttagttgcaacacgtcaaacgcctgaatatccgctaggccgtgccacagcacaagatcatttaaaaatggttgatttatattactcacacaatatcgaagcgcatcgtgtggtacttgagcataacggtcatttagatccgattagcgaagatttattagtcgcacaaactcgagcattggaaaaattacaatggtttatccgtgcgcacttagataacggcagcggtaatatctaattaaaaattgaacaaatccctctaagtaagcggctagttgttgcaatatgcaaacaattagccgcttttttatgacctacctctcattctgaaatcaagccaatttacatctccaattttttagagtatggtatttcttagtattttagtaaggtattaatatactgactaaaatcaatatcaacacaacttaactaaaatggagcttcaatatggctgaacaaatcgtgccttcaaatgatgcaattctaaaagcagtacaagatactctcgtgatttcaaccaccgatttacaaggtgtgattacctatgcgaacgatttattttgcaaacttaccggtttttcacgtgaggaattaatcggtcaaccgcataacatcgtacgccatccggcagtcgcaaaagaagtttataaagagatgtgggataccattcaagcagggaaaatctggacaggtatcgtgccgaactgcggaaaaggcggcgttgtttatgtggtagatacgacagttcaaccgatgtttgatgaagcgggtaatattaccggctatattagcgtgcgtcgcgtgattaacgacttaatggataatttcgaagccgttgaattatcaaaagaaatttacgacgaattctacgataaataatttgctaaagcgtacgcaatctcttctgcgtacgctttttagttcaggagaagatttaatgcaatctatttctcatgtccatattgcttacggttcagaatcaggtaatgcagaacaactcgctcagcagcttgcacaacaaccctttctacaaccatatcagccaactatcgcaacgctaaacgagacagaactcactcacttagatccacaaagcctgttattaatcattactagttcgtttggtgacggtgaaccgccagagaatgcggaagatttcattgaaaatttccttgcaaattcgaccgcttatcaaggacgttacgccatttttggtttgggtgatgtcagttatgataagttttgcggttatagtcgcaagctcgatcaattctttcaaacgcaacaattacctgcattgattgaacgagtggatgccgacctaaactatcaggaaatttttaaactctggctcccgttactcgagcaagcgctgaataaaccggaagctgcgccactaacacataaactctccgtgaaagtgtatgatgaaaaccaaacctatgcggcacaagtgttagagattcagcgattagcgcagtccgagccggcggtttatcacctacgcttatcgcttgaaaatagcggcattttttaccaagccggcgatttaatttatgtgcaagttcaacagcaggatgatttactcaatatgttcgtccaatggtttggcgatgacaatgcggcacagcaattacgccataaagagttgcgcctattaactaaaaacgcattaagagagctggcaaaaatttgttcgaatcatgcgttaaaagagttacttaaaattgccaataaaaaagcgcttgaacaatatctttacgggcatgatttactcgatgtattgcgtgattttgacccgcaaaaaatcatctcgcttgctgatctgcaagctattttgccgaatcttaccgctcgcgcctactccattagctcttgcggtaaaacgcatccggaatatgtcgacttatgtattcgccaagtacaataccagcttgctgaccgccaatattacggtacggcaagctgtcatttggcacaattacaagcgggtgattttgtacaaatctttgcaaaagcaaatcctcacttccatttgccggaaaatgataaaccgattgtgatgattggctccggcaccggcattgcgccttatatcggcttcttacaaaatcttgcagcacaaacatccgctcgtcaaacgtatctgttcttcggcgaacggtatgcagcgaaagattttctataccaaaccgaattggaaaactatctgaaagccggcacactgacccagcttttcaccgcattttctcgtgatcaagcggaaaaattctatgtacaagatgcattggcacaacaagccgcattaatttggcaattaattgagcaaggcgcttatttctacgtatgcggcagcaaaacgatgagtaaagcgattgatgaaacgttattgaatgttgcggcacaggttggaaatcagccgaatatcgatgcgtttaataatattgttgcacagcttgtggcggataaacgtttgttccgagacgtgtactagccggtaaaataaacaagcggtcaaatttgcaaaaaatcttacaaattgaaccgcttgttatatttacccatagacgcaaagtatccgctacggaatatcatgcccttgcgaggccacataaacgttgatccattcctcttcactaagagtaatatccaatgcccttactgcattttcaactcgagcaatctgtccggaaccaataatcggcataatcttcgccggatgtgctaaaagccaagcgtagctcaaaacgtccaatcgttgttcaccatatttttcaccaattgttctcaatgcttttgccacttgtaggcttcgttggtcttgattaaaaattttaccacctgcaagtggtgaccaagccattggacgaatccgtttttccaataagaaatctagcgagccgtcatcaaacggtgctaactgcaagggggaaatttcaatttgattggttactaacggtagggaaagataagattgcaacattgagaacttagccggcgtgtaattcgatacgccaaaatggcgcacttttccggcttgatgtaaatcttcaaacgcacgggcaatttgttccggatcggcacaaggcgagaggcggtgaatcaataaaacatccagataatcactattgagttgttgcaaagaacgttctgccgaccaaacgatatgttcataactgttatcgtagtggtgtgttttgatagccggtaacgtttggttcgggtataaaattccgcactttgtaattaacgtcagtttctcacgcaaagacttatccagcgccaatgctttgccaaattgtccttcggatgtaaaaccgccgtaacacgcagcgtggtctaacgtatcaatcccgagttctaacccctgctgcacaaagcgtaacagctcctgcggtgttttctgccattcatttaatcgccaaaatccttgaatcaagcggctaaatctcagtgtcggtgtgagttgaatatattgcatagcggctcctatcactcttgtttaaataacagtcagtgtacgcccgcgcatttatttattctatgcttttgatatatccatttagataaaaaaatacctttagcgtattacaaaccgctaaaggtatttatatgtaagagccattggttctctaagcattacagcaataatgccgaaccccatttaataatatcgaagaagaatttgttatcattcgttgcaacaccgtcgccgcttttcgcatcggtttttacttcttcaaccattccgctcttatactgacctttgactacagccaagtcatctttggcttgagcacgtagaatttggcactgtttattgctcatcttttcgatatcagccggcgaatttttaaatttcttaaattgatattgtgcatagcccatagacttctcatcgccttgcacgatcttcacgtattgttcgccaattacttcttccaacggatagaagaacacatactgtgaatgaatgtaagcatcttctttagaaaaatgcgcttgctgaatacgtgtcagattcggataaatacactgagaagcttgttcgcttaatgctacccaacgttgtgcgtccttatccgataacacataatcggcattcgcaaattcacccggaaatgcttcttgttgtaccgatttacctgagaatgaacagcctacggtcaacactgtcattccgactaacataattttttttaacatggctaaccttgaattaaatctaaataaaggtggctgattgtagcatttatcaataaatgcgcaaacaagcggtcaaatttacctatttttttgcacatttaacacaaagccctctacaaagagagggctttatctatatggcactattatttaactaattcgcctttcgcctgtaaatctgcatgatatgaagaacgaacaaacggaccgcaagcagcgtgttcgaagcccattttttccgcttcactacggaacatatcaaactcttccggcggtacataacgttctacttttaagtgatgacgactcggttgcaaatattgaccgatagtcaacatcgttacgccatgatcacgtaaatcctgcattacttctaaaatttcttcgttggtttcaccaagacctaccattaaacctgatttagtcggaatacccgggaattcttgtttgaagattttaagtaactcaagcgaccatttatagtctgcacccggacgcacttcacggtataaacgtggcacgttctcaaggttatggttaaacacatccggcggattttgctttaaaattgcaaccgcttgttctacacggccacggaagtccggtactaaaatttccactttacattccggatttaatgctttgatttcacgtacagtggcagcaaaatgcgccgcaccgcgatcagctaagtcatcacggtcaaccgaagtaattaccacatattttagcttcatatcttgtacggtttccgccactttacgcggttcttccggatctaacggtaacggtttaccgtgtgcaacgtcacagaacggacaacgacgagtacaaattgcgcccataatcataaaagttgccgtaccgtggttaaaacattcgtgcaagttcgggcaagacgcttcttcacacacagaatgtaagccgtggcggcgcataccgtgcttgatactatcaatttttgccgaagccgccggtaatttaattttcatccaacttggttttggtaataactcttggtcagggtcaatattacgcacttggattacagaagttttggctgcgtcgcgatatttaacgccacgctccattttaaatgcttccatttttgtaggcttagtgcctgtagcagttgtcattaagttctatccttttctatgcaattttaaagggcggagataaaccccgcccctacacagatcttacaattctgataatctttttattaacgggcaaatgccttacgaacattatttgttaacaatttgttgatcattataccctaaaatgttgcaaaagtgagctactaatttaggggcaactaaatcacattgcgcttctgcttccacaatataatctttcaattgcgccatttccaatccggcatagccgcacggattaatatttctaaacggcgttaaatccatattcacattaaatgccaagccatgaaacgagcgaccttggcgaatacgtaaccctaacgaacaaattttcttaccgtcaatatacacgcccggtgcatccggttttggataaccttcaatcccataatccgctaatgttttaaccacacattgctccaaagcggtcaccaaatctcgcaccgaaacctctttaccttgcgcttttaaacgtttgatatcaatcagcacatacataatctgctgcccttcgccgtggtaagtaatttgtccgccacggtcggtttgcaccacaggaatattggtcggattaagtaaatgttccggtttaccggcagaaccttgggtaaatactgccggatgctggacgagccagatttcatctgcagtattttcatcgcgagaatcggtgaaatcttgcattttgtgccagatttcttcatacggttgcacgccaagttggcgaatgatgagttgattcattagattatctccgtccggaaaaagggttcttataaaaccattctcacgccggcaattttagcaagctcagtataaagcgtttcaacttgatcaatatgttcggcaataatatcaattgaaaccgagttataagtcccttttgagctacgttgctgacgtgggttgtaatcgccttttgcgtgaatttgcgttaccgccactacgtcatccactaaatcttcacgatgtgtacccaccactttaaatgtaaatgaacatgggaattctaataaatcttttaattttgcttggggtaaatcttgtaggtttactgttcttgattgtgtcatatttatatccttctctcttttgctattaagaccaagcggtatgattttgcaaattttttgcgaaatcacaccgcttgttaatttgtcgcctgaatatgggggcgattttgaatattacaagctaacaaaaattagtcgaataaactcttaaccgttaatacaacccagtcccatgctttgccgaaaatacccgcttctggcacatcttgtagcacttgtaaatcactgcttgcaacatctttgccatctaattgataaataactttaccgattacctgccctttcgctaatggcgcttcaaggtttttacgctcaagttcataacgagcttttaactccgaagccttaccttttggcacggtcacaaaactgtcttgaactgaaccaagctggactttatccgcttcaccataataaacactttgttcggaaaccgcttgaccagccggcagagatttaattgtctcaaagtttgcgaagccccattgtaacaattttttgctttcgacttcacgacccttataagtttctacacccattaccaccgaaatcaaacgcgtattgctgttggtcgctgaagcgactaagttatagcccgcttggctagtatgaccggttttcataccgtccacattcatcgttttgtcccacaataaaccgttacggtttggctgtggttttttaatgttgtatttaaattctttttctgcgtaaatcttatattcttccggctgatcacgaataatatgcgcaccgataattgccatatcacgtgctgaagaatattggtttggctcatctaagccgtgtacagttgtaaagtgggtatttttaagaccaaactgctgtgcaaatttattcatttggtcgataaaggcttgctgtgaacctgacgtatgttccgctaatgccaccgctgcatcattacccgatacgataatcaaaccacgcattaaatccgcaaccgatacttgcgtatttaaatctaaaaacattaatgatgagcctgggaatttttgtgcccaagaattctcagtcaccgtcaccatatcgctgtttttcactttaccttgtttaagcgcgtcacctaccacataacttgtcatcattttagttaacgatgccggatattggcgctgatcaggatttaaacttgctaaaacattgcccgagttataatccattaagatataactttgcgcatttaattgcggtgccgaaataccgaaatccacatttgcgtcagcaacggcaaattgggagaaagctaaagcacaaaggcctactgatttaaataatgtttttttcatataaaagcatccaatccttcaggaaatgacaggttatataacgtaagcaagggtttgttgattgctcaacaaaccctaatgcaagaaaagctaaacgattaaccatcttctcttactgcttgagtatttttcttgtttttatttagcactgctaatttgacgtgagccgttccgctattgtgcattcctaattggcgcgctgccgctttagataaatccactacgcgagcgtgtgcataaggcccccgatcatttactcgtaccacaactgaacgtccgttacgcatattggtcacttccactaaagtgccaaacggcaacgttttgtgtgctgcggtcatcgctgaattgctaaacctttcgccgtttgcggtacggcggccgttaaatttatctgcatagtagcttgcgatgccagactgataatggctacgtgcagtatttttatgtaattctttaagcgatctgcttttaactagtgcgattttattcgctctcgcttttgccactaaagcggcgtgttttactgatttttgtgcagttttagcaattaaatacttctttactgcgctaggttttgcgtgtttggttgctgcaacagaattcaatgatccgaatgttaagaatccagctaacaacagggttaccattttacttaatcgcataagttttcctcatttagatatcgtactgtgtaacgatgtgttttgcccacaaaacaggattatcttgtggtggctgtttatctttcttttgatagataactgctcttgtatgtgctttttgataccgcaaaaaagcaaaggttcagactttataaatcagtctgtaaagtctgactaaagtttgctgtaaggattatttgtgtacgcacgcttacgatgaacataagcggacatcattaatccgaacgcagccattagggttacataggaggttcccccatagctaaacagcggtaagggtacaccaactaccggtaaaataccactcaccataccaatgtttacaaaaacataaacaaagaatagcagtgatgtaccgcctgaaatcaagcgtccgaaagcgccgtccgacttagcgccgataaccaatcctctagcaataataaataaataaatcgctaataagatcaatataccaatcatgccgtgttcttcgctcaacacggcaaaaataaagtccgtatgcggttcgggtaagaattccaactgcgattgagtaccttccatccaacctttaccgttaatcccgcccgaaccgatcgcaattttcgactgaataatatgataaccggcaccaagcgggtctttttccgggtcaattaaagtcattacacgggttttctgataatcgtgcatcagaaaaaaccacataataggaatgaatcccgtcaagaagaccacgccggcactaattaatttccaacttaatccggctaaaaacagcacgaaaataccggcggcacatactaaaatcgaagtacctaagtccggctgcgccgccactaataaggttggcacgataattatgcccaatgcaataaaggtatcttttaaacttggcggtaaagcacgttttgccaaataagtcgccaccatcaacggtacggaaagcttagcgatttctgatggttggaaacgtacaaaacccaaattcagccaacgttgcgcccctttactggtctcgccgaccaaatccaccaagatcagcatcacaatacagactaagtagagataaggcgagactcgctcataaaaacgaggcggaatcattgccataaaaaacatgactcccaaaccaagcgtcacttgaatcactcggttagagaacatccgctcacttccgccactggcactatataacactaacagcccgtaaccggtgatggataacagacctagcaatagccataagtcgagagaaaaaattttccagaaaagttttttaaagccactattcattgtgagtatttccttgctcgcttataagcggttgaatttgctcaatattttgcgaaggttgttccgacgttccgatcggttcttttagcgttttgcttaatgcaaaatccatcacttggcgcgccaccggtgcggcatttgaaccgccaccgcccgcattttctaaaataatcgccaccgaaactttcggatcttcatatggtgcataactaataaaccacgcatggtcgtgtagttcttttttcaacgcattcttattgtatttaccaccgtttaagttaaatacctgcgccgtaccgcttttacctgcggcacgataaaacgaaccgccggctttgcgtccggtaccgtttgccgcattcactacattgtacattccgaattttgccacttgccaaaaacgctccggcacgcctttaatatcttcatatttaagcgggtctttatacggttcgactttatcgctgctgatcacttccatcattaaatgcggcgtattaacacgaccgttattaattaatatcgcttgtgcttttgccacttgtaacggtgttgcaatccagtaaccttgaccgatccctaccggaatggtatcaccttgtacccaaggctttttatgacggcgttgtttccactcacgattcggatacacaccggcggattcttcaaaaatatcaatccccgttttctgcccaaaaccgaatttacgcatccattccgacattttttcaataccggtatcatacgcaagttgatagaagaacgtatcggaagactcggcaatcgctttattcacattggttgaaccgtgaccgcctttcttccaatctcgataacgttgtgtggtaccgggtaatacccaaaatcccggatcgtaaatcgccccataaggcgtaattttgccttccgccaatcccatcaccgcataaaacggttttaccgtagaagccggaggataagtcccttgcgtggcacggctatataacggacgggcaggatcttccaataatcgtttataatccgcccccgagacgccgccgacaaataagttattgtcatagctcgggttggttaccatcgccaatacactgctgtcacgagggtcaagcactacgaccgagcctttttggttgcccaacaaattctgaatatattgttgtaactcaacatcaatggttaagcgaatactactgcccgccacacccggctgatcacgcaatttgcgaatcactttgcctcggttattgatttctacctcttcaaaaccggtttgtccgtgtaattggtcttcgtaatatttttcgatgcccaattttccaatatcgtgagatccggcataattaccgaatttaccctcttcctcgagctttttcttatctttttcgttgattttcgccacatatccaataatatgagttagcgtttctccataaggataattacgtttgtagtacgcctgtacgtctaaacttgggaaacgatattggtttaccgcaaaacgtgccatttgctcttcgtttaaattgccctttaataaaatcggcgtataacgagaggtacgttttttctctttacggaatgcttccacatcttcatcggttagcccaaccacatcacgcaattcaactaaggtttcttccaggttttccgttttctcaggaatgatataaagcccgaaataggtaatattttcggctaatactttaccgttgcggtcataaatcaaaccgcgggtaggcggaaccgggagcaatttgatacggttgccgttggaacgagtttggtaatcgtcataattcacaatctgtaaatgatacaaattggttaataacacgcccgtaagcgccaataccccaataaatgcgactaatgcacgacgagcaaacagattgctctccgcttgcccatctcgcactttctcacgaggctttggattggttaattttccgagtttaccaaacattgtttatctcattttgttctagagcgaacggaacaagcggtcaaaattttagcattttttaccatgtccattcgagatcaagctattctcgatgataagggtgatttgttgtcagtgaccacgcacgatataaactttccgctacgatcactcgcaccattgggtgcggtaaggttagaggtgaaagcgaccaactttgttccgctgctgctttacattccggcgaaagtccttccggcccgccaatcaacaagcacacatctcgtccgtcatttttccatgcttccaattggctcgccaattgttcggttgtccaaggtttgcccggaatatccaacgtcacaactttgcctttaccggcagccgctaacatcgctttgccttcttgctctaaaatgcgtttaatatccgcattcttaccacgtttaccggcaggaatctcaatcagttcaaaaggcatatctttcgggaaacggcgttggtattcttcgaaaccgaccttcacccaatccggcattttttgtccgaccgcaattaattgtattttcattgtgctaccacaaaaatgacagttatgcccaaagtttttctaattgatacatttcacgggcatccgcttgtaataaatgcacgatcgcttgaccgaaatcgaccacgatccaatccgccaccgctttaccttcttcgccaaatacttcaaagcccgcttgttttgcttctgcgcttaaacgatctgcggttgaagccacgtgacgtaccgaagtaccggttgcgataatcatagtatcggtaatgctcgatttaccacgcacatcaatcgctaaaatatctttcgcttttaaatcatctaaagtttttgttaaaaattcgactaaattttgttccacgttcagttctctttcaaatttactaaaatacaaatgttaaattttaacacaaattcgttgcaatataacaaatagacaaaagtaaagcggtcgtatttgcaaatttttttacaaatacgaccgcttgtatttaaccggcttagagctgtgccatttgttctaataactgaggcgatttatccaccatacgaagcaacagtaccgcttgtggattcggtttggttttgccttgctcccacccttgataagtccgcacggaagtatgcaatttatgcgcaaaaaccgcttgcgacagatttaatttttctcgaatcaatttaacttcagacgggctaagttctactggttcaggcttttctaataccgtggttcgcagggtgattttgccttggatatgtttttcataagcatcaagcccttccattaaatcatcaaaaagttttcccattactactccttatctctaattcaacaatacgcttcactttattcgctaacatattgcgttccgtattagataaatctgattgttcatctttaccatatgcggtaaccaacaaaatttttgaataattcacaatatgataataaattacccttgctccacctctcttacctttatttcgttgcatatctgcaattctaattttgcgtaagccgttcgtaccttggattaaatctcctttattaggattttctaatagctcattctgaaaatgtctatattcttcatcactaaggtgcttttgtctatatcgctcaaaaggtggtaattctacaaaaactaacttcactgtttcctcactatacgcttaaagcgtatgattttcaaccaatgaaagatagcttataaatgtttggttaatatacaactttattatttttcttttgcgatcaagatcgaaaatccacttcattcgtctcaaaaaataaggctagtgaaaactcactagcctttttactcttcttaagccattaatttttttaagcgatatagctcatccaacgcttggcggggggtgagttcatcggggtctatgctcattaatgctttttccagttcgctttgttgtaccgcaagcggttgaatttgcgggacttcttgcaaatccgcgctgaataagagatcgccttgcggattatcgtgcgcttctttggtttgtaatgaaatttcttccaaatgcgctaaacgctgtttcgccaattgaatcacctgtttcggcacaccggcaagcgccgctactgccaaaccgtaacttttacttgccgcaccttcttgtacgctgtgcataaacacgatggaatcctgatgttctcgggcatctaaatgcacgttcgctacaccttttaactgacttggtaaactggtcagctcaaaatagtgcgtcgcaaataaggtaagcgattgggttttcttggctagccattcggcacacgcccacgccagcgataaaccgtcataagttgaagtaccacgcccgatttcatcgatcagcactaagctgttttcggttgcctgatgcagaatattcgccatttcggtcatttccaccataaaagtcgaacggcctgaggctaaatcatcacttgcgccgatacgggtaaaaattcggtctaatgcgccgatttccgcactatccgccggaacaaaactgccgatatacgccattagactgatcaatgcaatttgacgcatataggtacttttaccgcccatattcgggccggttaccaccaataaatgacgttgtgcgtttaagaataccggattagcaataaacggatcctttaacacttgctccaccaccggatggcgaccgcctttgatattcacacctcgttgtaagctgaaagtcgggcgcacatagttcaaactttccgctcgctcggcaagattggtcagtacgtctaattcggataacgccattgccgctaattgcatttcgcccaaacgaggcataagtaaatcgaacaactcatcataaagttgcttttctaacgccaatgacgcaccttttgctttcagaaccttatcttcataggttttcagctcaggaataatatagcgctcggcatttttcagggtttggcggcgtacgtagtgcatcggggctttatgcgcttgcccttggctaatttgaatatagtagccgtgtaccgcattaaagccgattttaagcgtatcaataccggttgcttctctttctcgaatttcgaggttttccaaatattgcgttgcaccggcagaaagctctcgccattcgtccaactccgcattgtaaccttctgcaatcacaccgccgtcacgaattaattgtggaggcgtttcaataatcgcacgctcaagcagtgcgtgtaattcgctgaaatcgcctatttgtgccacaagtgcatcaagcgaagcggtcaaatttttcgcattttttgcaatatcaggcaattgagccaaggcggtgcgcaaacgagttaaatcacgtgggcgagccgagcgcaatgcaacacgagcaaggattcgctccatatcaccgacattttggagtaacggctgaagcagttcgatacgttgctctttttgtaaagtgtcaattatatcttgacgctttttcaacttttctaggtcacgaatcggttgatgaatccaacgtttcagcaaacggctgcccattggcgtaacacatttatctaaaactgccgctaacgtattttccgttccgccggctaaattctgggtcagttctaagttacggcgagttgccgcatccagcaaaatagtgtcactattttgcgccaaatgaatactgttgatatgtggtaaggcggtacgttgtgtttcttgtgcatagtgtaaaacacaacccgccgcacataatgctacgactgctttttctactccgaaaccggctaaactttgcgtaccgaattggcgatttaataaattaatcgccgtgactaactcaaactcccacaccggacggcggcgtaaacctttataattatttagaatttcagcagcagaaaagtcttccgcatagagaatctccgccggttgtaagcgttgtaattcagcagcgagcgcttctttatttggtaattcggtaattaaaaaacgcccggaagtcatatctagcgtggcaatcgcaaacacgcctttttcttcataaatcgcagcgactaaattgtcctgacgttccggtaataacgcttcatcacttacggtaccgggggtaacgatacgtaccactttacgttcaaccggccctttgctcgttgctggatcgccaatctgctcacaaatcgccaccgattcgcccaatgcgaccaatttagctaaatagccttctaccgcatgataaggcacgcccgccatcggaatcggctcgcctgccgatgcacctcgtttggtcaaagaaatatctaacaacgccgccgcttttttggcatcgtcataaaacaactcgtaaaaatcgcccatacgatagaacaacaaaatatcaggattttgcgctttaagttgcaaatattgcgccatcatcggcgtgtgtttagaaagatcttgagtcatggcttcgcagttaagttagtcaaaattggcagttagtgtaacagattgagggagtggaaaaaactgcggagcataaaaggaatgattaagggaatgatcagataaatgaaacaagcggtctaaatttgcaaaatttttgctaatttaaaccgcttgtcataaggtttaatccgcacgaatttgatgtaagaagcgtttagtgcgttcgtgttgcggattttggaaaagctgtgccggcgagccttgctcgacaatttcaccgccgtccatcacgaccactacatccgctacatctaatgcgaacttgatttcgtgcgtaaccaccaccattgtccagccttctagcgccaactctttcatggtattcaacacgtcttgcactaattccggatcaagcgccgaagtcggttcgtcaaataacatcaattctggttgaatcgctaacgcacgtgcaatgccgacacgctgttgctgaccgccggataattggaacgggtaaagctgtgctttatcggataaaccaacttttgccaataatttctcagcttccgctttagcttgttctggctttttgccttgcacaaataccgggccttccatcacattttctaatgcggttttgtgtggaaataagttgtaattttggaacaccatacctgatttacggcgtaaggcaagaatctgttttttgatattttttgccgaaaaatccacgcttaacggctctgaaccgtcaaacgtgattgtgccttgctccggcatttccagcgcatttaaacagcgtaaaaacgtagttttaccggaaccggacggcccgagaatcaccactacctgaccttttttaatttccagatcaatgccacgtaaaatcgtgttgtcgccaaaggttttatgaatattgctaattttgatcattttgttttccgtggttagccattatttcgccacaaagcggttaaagcggcgttcgagttttgcttgaatcaagaaaagcacccagcagaaacaccagtaaattaaacctgcttcaatatataccggcaagaagtcgtaagacatattcgccatttgttgtgcgacacggaacatttccgttaccgttaccacagaagccaatgaagtatctttaaacaaaccgataaaagtattgcttaacggcggtacagccacgcgaatcgcttgcggggcaataatacggcggaaggtttgcatataggtcataccgatggtataaccggcttcccattgtcctttcggcacggaagaaattgccgcacgcacggtttccgaaccgtatgcaccgatattcagcgagaaaccgataatcgccgccggaatcggatcaatatacacaccgatcgccggtaagccgtaaaacaccaccgagatttgcaccaacatcggcgtgcctcggataatcgagatatacactttcacaatcgcaagagcaatgcgatgcaacataccatttactggggtaactcggatcaacgccacgccgaccgcaatcgccataccgataataaaagaagcgattgctaacggaatggaaaccaagaccgccgcttcgaccattgggaagaaagcatccatcaccagtttcacacgagcctcatccataaatggaatttgcagtaataaattttctaacacaaactatcctaataaaaattgatttaatgaaattctaagggatatagatagaaatgtatacgtctagacgtctaaataatctaaaaagaaaaacaagcggtctaaatttgctaaaaatttgcagatttagaccgcttgcttcaaagcgtctgaacgtattgagttatttcacactaatatcacgaccaaagaattgttcgccgagctttttcaacgtaccgtctttttgtaactcaacaattgccgcactaattttgtttaacgcttcttggttacctttgttcgtcactaaaccggcacccactttttcaggtgattcccaaacaatttttaaacctgatttcgggtttttcttcagataatccaataacgcaagattgtcgttgaaagttgcatccgcacgtttttgttgaatgagcaataagccttgcgccataccgtcaatcggcacaatgttcgcaccgttatcacgcgctaattcgccgtagtttgagcttaatgtttgagcggtttttacgcctttaacatccgatgcctgctggattttttcttcatcgttgcgcaccactaacgccgcaccagaccagctatacgcttccgatttatcaaaagtcgcttgacgctccggtgtggttaagcccacttggtttgccactaaatcgaaacgatccgcttttaaaccggctaacattgcgtcccattgcgtttctttaaactcaactttaacgcctaatttttctgcaaccgcacgagttacttccacatcataaccggttaatttaccgcttgcatcatgataagtgaacggtgcataagtcccttcagtaccgactgtaatcgtacctttggcattaattctttcgagtaacgtttctttagcaaacgaagttgctgatgtcgcaagtgcaatcgcagaaaccgcaatcactgataattgttttaacatagtaggaaccctcttaattcgagaaaattaatagataaaatatatgatgttgtgtttttttcgaattattagagaaatttatgcaggcttcaaataactaaatggaataataattagctaaatgttgtaaggatgttaatttgaacgaattggatgtaaaacaagcggtcgaattttcataaaattttgcaaaaaagtaaccgcttgtaatcaagactagacgagatatgcgccgcaacaatgtttaaattttttagccgaaccgcagacgcaattctgtttttgcgaaggcagcggcaccgttgggtcaacaaaataccagcggttatttactaacacaaacagtgacaattcgtggtgtgcttctacgccgttttcagtatcaaataatgctttaaactcaaccagactgtggattttactgatattcggcttgtgagagagaatttctaatcccgcccatttggtgctttcaccccacgctttcatcgctacctgatccaaaaatttctgctggctaggaacggtggtctccacaatataatcaatattgaccagagtataagccgcatagcgtgaacgcattaacagctccgccgttgccggataagcttgcttgagatgaaacggttggcaacattctacataatgcttacccgactgacacggacaagcggttaaattttctgacatttttgcattcctctttttaggcacgatattgtaacgatgaaacaaatgaaatacagcaaaaatcccatccctctaaaaagaaaagagcacatttaatcatgtgctcttctgttagaaaatctaattagtgcaattcctctcgagtaggaatcgaactttgtgcgcccatacgggtgactgaaatcgaagaggctttgtgggcgaacattaccgcatctcgcatagacttgccttctaataaagcaaccgccagtgcgccgttaaaggtatcgccggcggcggtggtgtctaccggtgtgactttaaagccggcaataatttcgccgttgccgttttcacttaaaaacgcccctttcgatcccaaagtaattaacacggtttgaatacctttttgatggaacacattcgccgcttgtttggcggtttgttcatcgaccacttgaacgcctgtcagtaaggcagtttcggtttcatttggggtaatcatatcgatattcgctaaaatttcgtccgagagcggctgtgccggtgccggatttaaaatcacttgggtgtgatgagctttcgcaatttttagcgctttttcgaccgcttgtaacggcgtttctagctgaaccagtaggcaatccgcactttcaatcgtggcttgatgttgtgccaccacgctttcatctagctttgcattcgcaccggcggaaatcacaatgctgttttcgcctgaatccgccacttgaatcatcgcaatgccggtcatttgatcagccacttcaacaatgtgttcgggattaatgccgtcttgcacaaacgcttgtttcattgctcgcccaatatcatcagcgccgatacaagcgataaaatctacatcaactaatgatgcatctcgcacacgagccgctgctaccgcttggttcgcccctttgccaccataagcaatatgataatgaccgcctttcagcgtttcgcccgcttttgggaaataagggactcgaataacatgatccgcatttacgctgcccaacacacaaagttttttcataactacctcaaaccgacctcacacaaacctagcgatgccggaaccgtcaaaataacggatccggagccaaaattactgactaattacttttaacggtacagggattttcgcttcgactttttcgcctttaagtaatttatccgcagtttccacacctaactcaccgattttatccggttgttgtgcgatggttgccgccagttttccgccttttaccgctttcactgcatcatccgtaccatcaaagccgacaacgataatatctttacctgccgctttaatcgcacgtaatgcgcctaatgccatttcatcattttgtgcaaataccgcttttgctgcaccgtggcttgccagtaagttttcagttacgtttaagcctttagtacggtcaaaatccgccggttggctggccaatacttcaaattggtttgccgctaccgcttgtttaaagccttcaccacgctcacgagccgcggaggtaccggtaataccttccaattgaataactttggcatttttaccgactttctccgcgataaaatcgcccgccattttaccgccggcaacattatcggaagcgatgtggctcaccacttcacctttattcgcaccacggtctaaagtgattaccggaatatttttcttattcgcaatcgccaccgcattaccaaccgcttccgaatctgtcgggttaatcagtaatactttcgcaccgcgcactgtgagatcttccacgttcgctaattcttttgccgggtcattttgggaatctaacaccactaatttgtaaccgaggtctttggcttttttctccgcaccttcttttaaggtaacgaagaacgggttatccagcgtagataccgctaacgccaatgtgtcttgcgccattgcttttgcaccgaatgccaaacctagagcaagtgctaaagaagttaattttttcataggaatctccttttgagagtaggttacgcttttttacggccaaggaagttatccaaaataaccgctgctaaaattactaacgcttttgcgacaagctgatagtaagagtcaatatctaataaatttaaggcattactgaggaagccgataattaacgcaccgattaatgtgccgataatacgacctttaccgcccattaaactggttccaccaactacaactgcagcaatcgcatcaagttcataaccggtaccggcggtcggttgtgccgaacctaaacgagaggtgacaattaaacctgctagtgctgctaacacgccgctgactgcaaacacaaacagtttgattttattcacgttgataccggaaagtgcggttgccgattcgttacagccaagcgcataaatataacgaccgatacgagtttgggtcagaataaaccaaccgatagcaaataagataaacattaaccaaaccggcaccggcacaccgaataattcgccggtaccaatctcggcaaagtaatcggcattgtcggaaaaaccggtagaaatcgggcgaccttccatataaatcatggtgacacctcgcaataacaacatagtgattaacgttgccataaaggcttgtactttaccgaaggcgactaatgcaccgtttaacaagccgattgccgcaccgaataacaataccgccggtaccactaaataaatcgagagatctaaaccgattaaagttgccgctaccgctccagtgagtgctaagaccgaaccgaccgaaaggtcaatgcctgcaattaaaatcacaaacgtcataccgatcgcaataatcgcattcactgacgtttggcgtaaaatattcaataagttatcgacactaaaaaaattcggatttaaaaatgacaccaccgcaattaatgcgagtaatgcaatgatagaacgttgttctatcaggaatttttttagattaaatgctttgttcatattgattccttttgcaaaattcttgctaaatttgaccgcttgtaaaagcgcctaacttatttgccgattgcggcggataataatttttcttgggttgcttccgtgcgagaaaactcgccacgaatgtcgccttctcgcattacaataatgcgatcggacatccctaatacttccggcatatcgcttgagactaaaataatactcaaaccttcagctttgaatttattaatcagctgatagatttcttttttcgcccctacgtccacacctcgggtcggttcatctaaaatcaacacgttcggacgtgtcattaagcctttggcaatcgccactttttgctgattaccgccggataattcgccgataatcttatccggacttggggttttgatattaaacagatcgataaaatccaccacggtcatattctctttttcgtggttaatacgtccccaattcgataaatattccaaagcggtcagcgacatattttctttgaccgacatacctaaaattaagccgtcgcctttacggtcttccgaaatatagacaataccgttatttaagccgtcttggctggagcggttatcaatcgttttgccgtctaatagcacttcgccggcggttttcggtaatgcgccgtacaataccttcatcagctcggtacgccctgcgcccatcaaaccggaaacacctaaaatttcgcctttatgcaattcaaacgaaacgttattcacaccgctacctgataaatttttaaccgataaacaaacctcgccgatcggattatcaatatgcggatattgatcttctaacttacgcccaaccatcatctcaattaaacgatcttcggttaaatccgccactgtactttcaccgataaattgaccgtcacgtaatacggttacatcatcacaaatttggaagatctcttttaaacggtgagaaatataaacaatgcctcgtccttccgctttgagttctcgaattacactaaacaatgcttcggtttcggtatcggtcagcgcatcggttggttcgtccatcacaatcacctgtgattcaaaactcaaggccttggcgatttccaccatttgtaattcgccgatcgataattcgtttgctgcttggcgactggaatgttttaccccgagacacgccaacaagcggtcggattcctcatacatcttgcgccaatcaataccgccccaagcattggtaaattcacgcccgaggaaaatattttccgcaatcgacaagttacccaaaatatttagttcttgatgaataatgcttaaaccggcttcttgcgaggcttttggattggcaaagctgaccgctttaccaaggtattcaatcgtaccggcatcacgctgataaataccggtcaaaattttcatcagtgtcgatttgcccgcaccgttctcgcccattagcgccattgctctgcccgcataaacatttaaacaggcattttttaacgcttgcacaccaggaaaggctttatcaattccgctgattttcaacaaggttttcatagtttcctcgctctagaacggtacgcctgagtaaagaatcacattcgcatacggcgaacattcaccggtacgcaccaccgctttcgcttgattactacgttgcttaaattcactgtgcgccacgtattccacctcaattctacgcccttgctcttgctcaagttcatcaataatttcaattaactgctgttcaatggtcgggttaaattgtttaatttcttccgccaataaaatacgttcgacaaagagttcagttagcaccacttccaaagtagataaaaaacttggcacacctttagtaagggctaaatcaacacattgttgttcagaaggaatcggtaagccggcgtcacaaatggttaagccgtccgtatgccctaggctggcaatcacaccggaaagttgtgcatttaataccgctgtttttttcatatttcctccttttaggttactttttattttatcgaaacgtttcgatgagtaaaaaatagaaaaaatcacgaaaaaaagcaaacgtttcttgtcggatttgagaggtctatcacaaattttttaaaaggaacggcgaacgacaagttcgggggtaagttcgatttcttgataggctttatccggctgatgaatacgggcaatcaactgttccaccgcattttttgccaaacgggctttgggttgatgaatcgtagaaagcggcggagcgagatattgtgctaattcgatattatcgtaaccgatcaccgcaatatcttgcggaatacgcaaaccggcttgccaagcggcttgatatacgccaatggcaatgctatcgctcatcgcaaaaatcgcttgagggcgagaattcagcgccaataatcggcttgcacattccaaaccggcttgataatcaaaatgaccttcaactatccattcggaacgaatttgcaaatttgcctctaaaatcgcccgcttgtaaccttgtaaacggtttaatgtatgggatttcgattgttcgccggtaatcaccgcaatctcggtatagccggcatcaattaacgcttttgtcgcaagataaccgcctaattccgaattttcatgcactttgtccgcttttagcgcctgttgccaccagtcaatcaccaccatcggtaattgaatatttgccatcacgctttcatctaaatcttgcggttcggaacacatcaataataaaccgtccacttgtttgcgtaacaagcgggctaaatgttgttccaaattggtactgttaccgtcagtgtttaccaaaattaaatgatagttatgttgctcgcaataacgctcaacatgacgcaccacttccgcaaaaaacgggttactgctggtggtaactaacatgccgattgtgttggtttcttttactttcaggctgcgagccaccaatgaaggcgtgtaattgagttccgccaccactttttcgatccgctggcgaatttcgtcactcacaaaacgtgagttattgatcacgtgggagacggtggaagtggaaacgcccgcaatccgagctatatctttcattgttgccataaaattgccttcataggtgtttacaaaatagggttttgcaaaattttgctaaaatcttaccgcttgtcattttgcaaataaaacataaaatcatactttccgttaaaatagcgacatacttcacaaaatttaatcctatgagcaaacataaacgcccgactttacaagatattgccgaacatttaggcattaccaaaatgacaattagtcgctatttacgcaatccggcttcggtggcggaagataccggtaaacgaatcgccgttgcgattgaacaattcggttatattccgaatcgtgcaccggatattctgtccaatgcaaaaagtaaagcgattggcgtgttgctgccgtctttaaccaatcaggtatttgccgatgtgttaaaagggattgaaagtgtaactgatgctgccggttatcaaaccatgctcgcccactacggctatagcgaacaaaaagaagaacaacgcattgaatcactcctttcttatcatgtggatggattgatcttatcggaaaatcaccatagtgagcgtacgctcaaaatgttaagtgtcgcaaaaatccctgtgattgagattatggataccagtgaaaaagggcaacaacaagcggttggttttgacaatatttttgctgctcaagccatggttgaaaccatgatcaaacgtggttgccgccaagtggtttatttttcggcaagaatggataaacgtactcgtttaaaaatgcgtggttacgaacttgccatgcaaaagcataaactaacgccttacactattgcaacagaagaatcctcttcatttacgttaggtgctcgtcaattacacattgcgttagaaaaatatccgaatatcgacggtattttctgcaccaatgacgatttggcgattggcgcactgttcgaatgccaacgcctaggtattaaagtgccgcaacaaattgcaattgccggctttcacggacacgatgttggtcaatcgattaccccacaattggcgagcgtgataactcctcggtttgaaatcggcaaagttgccgcccagcaattactaaatcgaattaatcaccaaacgccacaagatgaaatgattaatcttggctataagattcatatcggtgaaacaatttaggcgataaaaaagcggtcaaatttcgcaaaaaatttgcagaaaatgaccgcttgttctactcaacattccgtcctatttaatcccgttatctttatcactgagcttgaattgcctgtacgcacagttgtaccacatcgtcaaaactgccactaatatcaatcgaaatcacatctggttcgtccgcttgaggaatttctaacgtatcaaactggcttttcagcatttctgttttcataaaatggcctttgcgttttttcattcgctctaaaatcagctcaaatgaaccgtgtaaatgaataaacgtcaccttttgattgccttggcgaatttgatcacgatatttctttttcaatgccgaacaaacaataattccgatttcatttttttgttctaagctaaatgcagcatcattaatccgttccaaccatgggaaacgatcttcgtcatttaacggttgtccttgacccattttgaggatattcgctctcgggtgcagatcatcgccatcaatcaatttaatgcctaaacggcgcgccacttcactgcctattgtggttttaccggtgcttgatacacccattaaaataaaactttgaccagatttcatttgagcttcctcctatttcctttcaacataacagatttttttgccttatgttacaggtaacatttaaatttgtgatgtacttcgcaaatttaaaattaattctaacaatctatttacatcgcaaacgattaaatttatgttaccagtaacaatttaatacttctgttcgaggttcttatgttaattttcattatggcggtagcgatcattgcgctattggtattgatcataaaattcaaagtacatgcgtttgtcgcattactgattgtcagtttattaactgcactggctgcaggtattccggtggataaaattctgccaactttacttagcggtttcggcaatacattggcatcagtcgccttattagtcggtttaggggcgatgattggccgtttattggaaattaccggtggggcaaaagtattagctgatacgctgatcaataaattcggcgaacaaaaagcaccattcgcattaggtgtggcggcattactcttcggtttcccgattttcttcgatgccggtctggtggtgatgttaccgattgtatttagcgtagcaaaacaattcggcggttcggtattacgttatgcctttccggttgccggtgcgtttgcggtgatgcacgcttttctaccgccacatccgggtccggtcgcttccggtgatctacttggcgtgaatatgggattaatggtgattgtcggtttaatttgcgctattccaacttggtatattggtacttacctcttcagcatgtttatcagtaaacgcattcatgtagaattaccaaaatcattcctaaatgcttcagcaattagtgaaacctcggtacaaacaccaccatcgttcagacgtgttctctttattttagtattaccgatcttcttaattttatttgataccggtttaaatacattaagtgtggctaaagtgattgacggttctgaactttgggtacaaagcctacgtttaattggcaaaacccccgtagcgttattaatcactttattactagcgattatgttattacgtggtgagcgtagctacgaacaaatcgaaagtttatgtaacaatgcattaggccctatttgttcgattattttggtaaccggtgcgggcggtatgtttggcggtgtattacgtgccagcggtatcggcgatgtcttatcttcaatgctctcggataccggtatgccgattattgtggcggcatttattattgcggtggcgatgcgtgtcgcacaaggttcagcaactgtagcattaaccactgcagcggcattaattgcaccaagtgttgcggcttcaaccgatttaagtcaatttgacctttgctttatcgtgattgcaattgcttccggtgcgacagtactttctcacgtaaatgactccggtttctggttaatgagccgcttcctagaaatggataccaaaaccacattaaaaacctggacggcattagaaacctccattggtgtagtcggttttatcattgctctgatcggtagtattttgctttaaaaatcacaagccctttgttattaacaaagggctttttttataaaaaaactgatctagatctcatatttatcattatccatttgcaaaaaagcaaacgattacatattctcgcaacaccgctaaagcggtttagcaaattaagaaattatacaaatacagaggtgaaaaatggtgcatttgatcattgccgctcatggaaaattagcccttgagttggtcaattccgcacaaatggtatatggagaaacggataatgttcatccggttatctttgtgccgggagaaggtcaagatacgctagtcgaaaaatatgaagcgattattgccacgcttcagcctaccgatagcgtcctgttcttggtcgatttatttggcggtagcccgtacaacgcagcagccagaattgtcgcaaaacgtccacaagacgatattgtgaccggtactaacctaccaatgttacttgaagttatggatgcttcagccgatgcaaaaacggcaaccgaacttgctgcaacggcaaaagaagtcggacacttaagcgttaaaactttccatactccacaaccaacatctccagttccatcagaagaagcctcttccgaagaatcctcatctcttcctgccaatttcgatccaaacggacgtatgaatatttcattaatgcgtatcgacagccgtttaattcacggtcaagtgatgacatcttgggcgaaaacggtgaaatgcgaagcaatttttgcgatcagtgatgaagtggcaaatgacgatattcgccgtgaattattgctacaaatcgttcctgaacatttaaaaggctatgtgattacggtcgataaagcgatcaaagtctggcataaccctaaatacgccgataaaaacattatttggttggtcaccaacccgtcagatatcgttcgcttaattgaaggcggcgtgaacattaaaaatgtcaatgtcggcggtatgactttccgtgaaggcgacaaacttatctctcaagcggtggcgattaaccaaaccgatttagccgccttctacaaactcctcgagttaggcgtagatatgtcgttacaacaagtggcggcaaacaaaaaagaaccgcttgataaagcacgtcttgatgcaatcaaattctaattaaggattttcttatgactagtattgaaattattttagtaaccttagtcgctgcaatctgcggtatgggttccgtacttgatgaacgccaaactcaccgcccgcttgtggcttgtaccttaatcggctgggtgttaggcgacttacaaaccggtattatcgtgggtggtacacttgaaatgttagcattaggctggatgaacgtaggcgcggcaatggcacctgatgctgcattagcatctgtgattgcagcaatcttagtgattaaaggcggtcaagataaaggtacggcaatcgctattgcaattccagtagcagctgcgggtcaagtattgactatcttcgtgcgtactttaaccatcttcttacaacataaagcggataaatttgccgaacaagcaaacttccgtggcattgagttctgtcactttgccggtctttctttacaagcgttacgtgtagcaattccaactttcttcgttgcattggtagcaggtacggatactgtaaccgaagtgttaaatgcgattcctgaagtcgtaacccgtggcttgcaaatcgctggtggctttatcgtggtggtaggttatgcgatggttatcaatatgatgcgtgccggtgcgttaatgccgttcttctttatgggctttgtgattgcatcattctcaaactacaacttagtcggtcttggtttcttaggtgcatgtttagcgatgctttacatccaattaaacccacaattcaaccaatcggtagcagcgcctcgcaccactaaaaaattagcggataacgagttagaaggtctataaggagcaaattatgtcagagaaaaaacaacttaccagtgcagatattcgagcgacttattggcgttcaactttcctcttaggatcatttaactttgaacgtatgcaatcaatgggcttctgtgtatcaatgatcccaacgattaaacgtctttacagccgtaaagaagatcaagcggcagcattaaaacgccatttagagttcttcaatacgcaaccatgggtcggttcagcaattatgggcgtaaccgcagcgatggaacaagaacgtgcgaacggtgcagcgattgacgatgcggcaattagcggggtaaaagtcggtttaatggggccgcttgctggtgtcggcgacccgattttctggggaacattacgtccggtattagccgctctcggtgcaggtttagcgattagcggtagcattttaggtccattattattctttatcggtattaacctttgtcgtgccttaactcgttggtacggtttcaaatacggttaccaaaaagggacggaaatcgtttcggatatgggcggcggccgtctgcaaaaagtcacgcaaggcgcttctattctcggtttatttgtgatgggttccttggtgtcgaagtggaccagtatcaacataccgtttgagctttctcgctataaaaacgcaatgggtaaagaagtggttaccaccgtgcaaagcgtactgaatgacttattaccggggcttgcagcgttattgcttaccttcttatgtatgtggttattacgtaagaaagtaaatgcgatgtacattatcttcgcactattcggcgtcggtattttaggctattggttaggtatcttagcttaatcatcccatacaaatgatttaccccctctttatcctagagggggtattttttataatacaagcggtcaaatttacaggaaattttgcaatggatttaaagaaagcattaaaagcgccagaacaacaatatatcaaaaacagttcgatgttagttaccgcattatttattattgctggcgttttatattacccaactgacggctacggatcggtgattgcacttgcattagcgattattgtgatgttcgggcaaaagatgttaattagtcaaactcgtaaatattttgcggagatgtatgcggcaaaacagcaatatgagcagagcaaaaacaaagattatttagaatttatccgcttgcgcggcacacaaatgttaaacgacaataaagtgctttccgagcaagcaaaacacgaaatagacacattactcaattttgtcaaacaaaatagccaataatggataagcggtcgtattcttgcaattttttgccaaaagacgaccgcttgttctttatggaaatagcttatttagtactaatgcaatgccatcctcattatttgatgccgtcacatagctcgctgcagctttaatctcatccggcgcattcgccatcgccacgccgaaacctacatactgtaacatatcaagatcattaaaattatcgccgaaggcaacgatatgttcactagtgatccctagtttttgttgcataaagcggatcgctttcgacttcgttgccttactattcatgatctctaaatattccgccttagaacgatgaatggaaagttgtggaaaaagtgatttcaataacgtttctaatcgcaaaatttcatcagcctcacccataaccaagatcttatgaacattggtaagtttttcggcttttttaaccgcttgtaaaccggtaatttccccctcttgcttggtccaataattatcaacatcattactaaaccataaggtattcgcatagtaattaatagataaatgctgaaaactttgtagttgcagatctaattgaataagatccgtttcattgatggagatactataaagaggggttagattacgatctaaaattaatgcaccgctataacatataataggctgattcgcttgaagctgttgagaataaggagtgatagctagaggcgggcgagcggagacaagaataaagggaatgttctgttgagcgatacgctgaatagcagctgccgttttaggtgttatttgatgctgattattgagcaacgtgccgtcaatatcgctaaaaacggcttgatagtgagtcgtttgcattatcttcactccatttttatttgttaactagtatgcttactatacgccttttaaatgaatttttacatcaataatttattttttcgtttgtggataactttatattttcctctttaaaacttgagatctattctagaataactttaaatttttacccttctgtggataactaagccttttatccacaattaagatcataataacattcaagatctttacacaaaaagatcttctgtaacgctatgattctattatgaaaaatagacttatcctcaaatatctaaagcactaataactataacaataaagatctctatatatagatctatattactattaacgatctgcggatccgaacttaagatcacgtttcagatccaaaattgcattttccagatcgatatgttttaaggtagaatagcgatctttttatttaggcgaaacagaatataaaacagcaaaggcaaagaatatgatttatcgtgaaatttacgatgtaattgtggttggtggaggccacgcagggacagaagcagcgcttgctcctgctcgtatgggactaaaaaccctactcttaacacataatgtagatactttaggacaaatgtcttgtaacccagcgattggtggtatcggtaaaggccatttagtaaaagagatcgatgctatgggcggtttaatggcaatagctactgaccaagcggggatccaattccgtactttaaatagctcgaaaggaccagccgtacgtgcgactcgagcacaagccgaccgtgtgctttaccgccaagctgtacgaactgcattagaaaatcagccaaatttagatattttccaacaagaagtggttgatattttagttgaaaataaccgtgcggtgggcgctgtaactaaaatggggctcacctttaaagctcgttctgtggtattaacggcaggtactttccttgccggtaaaattcatattggtttagataactatgctggtggtcgagcaggtgatcctgctgcaacgatgcttgcagatcgtttacgtgatctaaatttacgcgttgatcgtcttaaaacaggtacgccaccacgtttggatgctcgtacgatcaattttgacgtattggctaaacaacatggcgatgcagaattacctgtaatgtcatttatgggctcagttgatcttcatccgcgtcaaattccttgctatatcacacataccaatgaacaaacgcacgatttgatccgcaatagcttagatcgtagcccaatgtacactggtatcattgaagggatcggtcctcgctactgcccgtctattgaagataaagtgatgcgttttagtgatcgcaacagtcaccaaatttatctcgaaccggaaggtttaagtacaattgaagtttatccgaacgggatttcaaccagcttaccgtttgatgttcaaatgggtatcgtaaattcgatgaaaggtttggagaacactcgtattatcaaaccgggttatgcgattgagtatgattatttcgaccctcgtgatcttaaaccgactttagaaaccaaagcgattgaaggcttattctttgccggccagattaacggtacaacaggttatgaagaagcggcagcacaaggcttgttagcaggtattaatgccgcattacaggttcagggcaaagaggcatggttccctacacgtgatcttgcttataccggtgtattggttgacgatctttgcacgctcggcactaaagagccgtatcgtgtctttacctcacgtgcggaatatcgtttattgctacgtgaagataacgctgatatccgtttaaccccgattgcacaccaattaggcttgattgatgatgcacgttgggcgagatttaatcaaaaaatggaaaatatcgagcgtgagcgcgaacgtctaaaacaaatttggattcacccgcaatcggaacatttagcggcagtcaatgaattggtaagtagtccgcttacccgtgaagcaagcggtgaagacttattacgccgtccggaagtgacctatgacaaacttgtgcaagtcgctgcttttgcgcctgctttagacgataaacaagcagctgaacaagttgaaatttcgattaaataccaaggttatatcgaacatcagcaaaatgagattgaacgtcataaacgtcatgaaaatactttaattccggctgaatttgattatgacaaagttgagagcctatcaaacgaagtgcgtgcgaagctgatgcaacatcgtccggtttcgattgggcaggcaagccgtatttcaggtattacaccggctgcgatttcaattctgctggtgaatttgaaaaagcaaggtatgttgaaacgaggcgaattataatttgctgattaggaagcacggaatatacggaaattaatttaatgattattttcagtatgttccgtgttttattgtgtaaaacataaggattttgcaaaatgaaacaaaaattagaccgcttgctggtacaagctcaaattaatttgaccgatcagcagaaagagcaattggttggttttgtgcgtttattagataaatggaataaagcctataaccttacttctgtgcgcaacccggatgaaatgttagtgaagcatatcttggacagtttagtggtaagcgagcatttacagggcgaaaagtttattgatgtaggaacaggaccaggattaccggggattccgcttgcgattgcaaatcctgataaacaatttgtgttattagatagccttggcaaacgaattacctttattaaaaatgcattacgtgaattaggaattacaaatgtaacccctgttctttctcgcgtagaggaatatacggagcagacctttgatggggtgttaagccgagcttttgccagcctaaacgatatggtggattggtgttaccatttaccgaatccgcaaggtaaattttatgcgcttaaagggatttatgctgaaagtgaagtgcaagacattaaaaagccgattcagttagagcaagtgcttacactcacagttccagaattaatcggagaacgtcacttagttgtacttatgaagtgatgatggagtgccgtcaaatttgggatgtttgtattaagtgatactttttacttttggaataaaaggtattatttatatgctagttataagtcttcttattataggaaaatttccaaatttttgttgataatgtaaatagaatgtgaaaaaagaatactggcgacagcttactttttcttatgtttttctataaaaaaatgcaatgttaacctttttgtaacaaaaaaggcaaaaatcgcttttttgtgaagttttcatattttaatctattgttttgtatcgtataatctgaagaaacatttcattttttacagagggcattagcctgttggataggaaataagatgtctactgtaataaataaagccaaacaacactatataagagcattaaaaatcgagagtttacttctcctaagtacagtcggtttcttgatagtttggaaaggtgttgatggtatttcattcttgggcggtgctttatcaagttttctccctcattgtgtctttgtttattggatttttttcaaaaagactacaaaaaatcagtcaagaatgggcgcattttaccgtggtgaaggattaaaatggttaatcactattttattagtggttatgtgttttaaattacttccttctctccatattgttctgttttttgtagggtatttaatggcattattttttaataatgtcattccgtttattttaagtaaacgaactcattaattttttattctaaaaggattcattatggctggaactaccgcagaatatattagccaccacttgagttttttggcttcgggtgatggcttttgggctgtgcatttagatacgctcttcttttctcttcttgctggagttattttcctttttgtattttctaaagttgctaaaaatgcgactgccggagtaccaggaaaattacaatgcttagtggaaattattattgaatgggttgatggtttagttaaagataacttccatggacctcgtaatgtaattgctccacttgcactcactattttctgctgggtatttattatgaatgccattgacttagttccagtagatttcttacctcagttagcgaatatgttaggtattcattaccttcgtgccgtacctacagctgatatcagcgctacattaggtatgtctatttgcgtattcttcttaattctgttctataccgtaaaatcaaaaggttttagcggcttagtaaaagaatatacgttccatccgtttaatcattgggcatttattccagtaaactttattcttgaaacggtaactctacttgcaaaaccgatttctttagcattccgtttattcggtaatatgtatgcgggtgagctaatctttatccttatcgcagtaatgtatatggcggataactttgcattacaagcgttaggtattccattgcatttggtttgggctattttccatatcttagttattacgcttcaagcctttatttttatgatgctaacgattgtttatttgagtatcgcttataacaaagcggatcattaaacgaacctaaagagcggttaaattttctcaatattttgcaaaagtttgatcgcttgaattatttgtattaacaacaacctgccttcgggcgaattcctcaatcttaatggagaacattatggaatcagtaatcacagcaacaattattggtgcatcaatcttattagctttcgctgctcttggtacagctatcggctttgctatcttaggtggtaaattcttagaatcatctgctcgtcaacctgaattagcaagtagcttacaaactaagatgttcatcgtggcaggtcttttagatgctatcgcaatgatcgctgtaggtatttctttacttttcatcttcgcgaacccgttcattgatttattgaaataagtcgggtctctcttttccgttattctttgaataacttaaccgacttttaggagggcgttgtgaatttaaatgcaacactaattggtcaacttattgcattcgcactgtttgttgcgttttgtatgaaatatgtttggccaccgcttattaaagcgatcgaagagcgccaagcgaatattgctaacgctttagcatcagctgaaaaagcgagacaagaacaagcagattctaaagctgcagcggatcaagaaatcctcaaagcaaaagaagaagcacagaaaattattgatttagcaaccaaacgtcgtaatgaaattttagaatctgtacaagcagaagctgaaattgaacgtcaacgtattattgaacaaggtcgcgcagaagtagaaagcgagcgtaaacgtgttcaagaagagcttcgtcaaaaagtggctgcattggctgttgccggcgcagagaaaattgttggtcgttctgttgatcaagcagcgaacaatgacattattgataagctagttgcagaactataacaaggtggggcagatgtcagaattaagtacagtagctcgcccctacgctaaagcagcttttgattttgctttagagcaaggtcagttggataaatggcaagaaatgttacagttttcagcattagttgctgagaatgaacaggtggcggattatattaattcgtctcttgcaagcggtcagatttcggaaacttttctccaaatttgtggcgaccagcttgaccaatatgggcaaaattttattcgtgtaatggctgagaacaaacgtcttgttgtgttacctgcggtacttaatgaatttattaagttacgtgcgcaacatgaagcggtaaaagatattatcgttgtttcagcaagcgaattaagtcaagcacaaatcgataaaatcgcaagcgcgatggaaaaacgcttaaatcaaaaagtacgtttaactgttcaattagataattctctcattgccggcattattattaaatatgatgatgtagtcattgatggtagtagccgtggtcagttaaatcgcttaagccaagcgttgagcttgtaagaggaataaaaaatgcaactaaattcaactgaaattagtgaattgattaaaaaacgtattgcccaatttgatgtggtgagcgaagctcaaagcacagggacaatcgtttcagtaagcgatggtattattcgtatccatggtcttgctgatgtaatgcaaggtgaaatgatcgaattacctggcaatcgttatgctattgcgttaaacctagaacgtgattctgtaggtgcggtagtaatggggccttatgctgacttagctgaaggtatgacggttaaatgtaccggtcgtatcttagaagttccggtaggtcgcggtttattaggtcgtgtggtaaatacacttggtcaaccgatcgatggtaaaggtgaaatcgataatgacggtttctctccggttgaagttatcgcgccgggtgttatcgaccgtcaatcagtagatcaacctgtacaaaccggttataaagcggttgactcaatggttccaatcggtcgtggtcaacgtgagttaatcatcggtgaccgtcaaacaggtaaaacagcattagcaatcgatgcgatcattgcacagaaagattctggtattaaatgtatctatgtcgcaatcggtcaaaaagcatctactatcgctaacgtagtacgtaaattagaagaacatggcgcattagcaaatacaatcgttgttgtagcatcagcttctgaatctgcggcactacaataccttgcaccatactctggttgtgcaatgggtgaatatttccgtgatcgcggtgaagatgcgttaatcgtttatgatgatttatctaaacaagcggttgcttatcgtcaaatttcattattattacgtcgtccaccaggtcgtgaagctttcccaggtgacgtattctacctacactctcgtttattagagcgtgcagcacgtgtaagtgcagattatgtagagcgtttcactaacggtgcggtaaaaggtcaaactggttcattaactgcattaccgattatcgaaacacaagcgggtgacgtatcagcgttcgttccaactaacgtaatttctattactgacggtcagatcttcttagaatcaagcttatttaactcaggtatccgtcctgcggtaaacccaggtatttcggtatctcgtgtaggttctgccgcgcaaactaaagtaattaagaaattatcaggtggtatccgtaccgcattagctcagtatcgtgaattagcagcgtttgctcagtttgcttcagatttagatgatgcaacacgtaaacaactttctcatggtcagaaagtaacagaattacttaaacagaaacaatttgcgccaatgcctgtaagtgaacaagcattagttctttttgcggctgaattcggttatttagatgatgtagaacttgagcgtatcggttcattcgagtctgcattacttgcttacgcaaatagcaatcacactgattttatgaaggatttagcaaaatctggcgattataacgattcaatcaaggatcaattaaaagctatcgtagaagacttcaaaaagaacggtgcgtggtaatcacgactagcggagaaagattatggcaggtgctaaagagataagaaccaaaattgcgagtgtgaaaaatacccaaaaaatcaccaaagcaatggaaatggttgctacctctaaaatgcgtaaaacgcaagagcgtatggctgccggtcgtccttattcggaaacaatccgtaaggtgattagccatattgctaaaggaagcattggttataagcacccgtttttaactgaacgagatattaaaaaagttggttactttgtcgtatcaaccgatcgtggcttatgtggcggtcttaatatcaatttattcaaagcgactttgaatgaatttaaaacgtggaaagataaaaacgttagtgttgagcttggcttagtaggttcaaaaggtgtgagcttttaccaaagtctcggtttaaatgtgagatctcaggtaacgggcttaggtgataatcctgaaatggaacgtattgtcggtgcggttaatgaaatgattaacgcttatcgcaatggtgaagtggatgcggtttatatcgcttataaccgttttgaaaatacgatgtcgcaaaaacctgttattgcacaattacttccattacctaaactagaagatgatgaattagaaactaaaggttcatgggattatatctatgaaccaagtccacaagttttattggagagtttacttgttcgttatttagaaactcaggtatatcaagcagttgtcgataaccttgcttctgaacaagccgctcgaatggtagcaatgaaagccgcaacagataatgcgggtacattaattgatgaattacaattggtgtataacaaagctcgccaagcaagcattacaaatgaattaaacgaaattgttgcgggtgccgcagcaatttaatggagaataggtaatggcaacaggaaaaattgtacagattatcggtgcggtaatcgacgttgaattcccgcaagatgcagtaccaaaagtatatgatgccttaaaagttgaatcaggtttaacccttgaggttcaacaacaattaggtggtggacttgtgcgttgtatcgcattaggtacatcagacggtttaaaacgtggcttaaaagttgaaaatacgggtaacccgattcaagtaccagttggtacgaagactcttggtcgtattatgaacgtattaggtgagccgatcgatgaaaaaggtcctattggcgaagaagctcgttgggatattcaccgtgcagcaccaagctacgaagaacaatcaaacagcacggaattacttgaaaccggtatcaaagttatcgacttaatttgtccattcgcaaaaggtggtaaagttggtttattcggtggtgcgggtgtaggtaaaaccgttaacatgatggaattaatccgtaatatcgcaatcgaacactctggttactcagtattcgctggtgttggtgagcgtacgcgtgaaggtaatgacttctatcacgaaatgacggattctaacgtattagacaaagtatcacttgtttacggtcagatgaatgagccaccaggtaaccgtcttcgtgttgctttaacaggcttaactatggcggaaaaattccgagatgaaggtcgtgatgtattattcttcgtagataatatttaccgttataccttagctggtacagaggtatctgcattattaggtcgtatgccatctgcggtaggttatcagccgacacttgcagaagaaatgggtgtattacaagaacgtattacttcgactaaaacaggttctattacctctgttcaagcggtttacgttcctgcggatgacttaacggacccttctccggcaacaactttcgcacacttagactcaacagttgtattaagtcgtaatatcgcatctcttggtatttaccctgcggttgacccattagattcaacttctcgtcaattagatccattagttgttggtgaagaacactataatgtagcacgtggcgtacaaggtacattacaacgctataaagagttaaaagatatcatcgctattttaggtatggatgagttatctgaagacgataaattagtggttgctcgtgcacgtaagatcgaacgtttcttatcacagccattcttcgttgcggaagtatttaccggttctccaggtaaatatgtatcattaaaagatacaatccgtggcttcaaaggtatcttggaaggtgaatttgaccatatcccagaacaagcgttctatatggctggttcaattgacgaagtagtggaaagagcgagcaagatgtaattgttccctaaccccaattaggaactaaaggagaacaacatggcatctcaatttgagcttagtatcgtaagtgctgaaaaagaaatctttaatggcgatgtaattagcgttcgtgtaacgggtattgatggtgagttaggagtgtatgcaggacatacacctttattaacctcgattaaacctggtatggttaaatacacacttgaagatggtaaagaagagtttatctatgtgtctggcggctttttagaagttcagccaactatcgtgactgttcttgctgatattgcgattcgcggtgaagagttagatcaacaacgaattcttgctgcaaaacgtaaagcagaagatacattaagcaaatcaaataatgcagaactttctgcgaaactatctcgtgaaattgctaaattacgagtttatgaaatcgtaaattcaaaattagcaaatagacgttaatcaaaaaacctcagtgttttcactgaggtttttctttttttacttctttataattatttttctgcattttattaatatgattcttatatatcgttgcggtgaaaattcttagacttaaaaaaagaattaagttttattctacaattgttaataatttgttcattttgttctaaaaattagcaagcggtagatttttctaaactttttgcaaaaaagtacttgcaaggatttcatatttctctataatgcacctcacacaacgacgcactgttgtgaacgatttaaaattgattgccagtgcgtcgtttctttttgttctttaacaatttatcagacaatctgtgtgggcacttgttgattgacttaattgaaaaaatatttttgattttgaagtcttaataggtgcttaaactagaaattcatttttacttttgaagtaatatgtaaactttagctaagcagtttattgagcgattaaactttttgaattgaagagtttgatcatggctcagattgaacgctggcggcaggcttaacacatgcaagtcgaacggtagcacgaaggagcttgctccttgggtgacgagtggcggacgggtgagtaatgcttgggaatctggctcatggagggggataactacgggaaactgtagctaataccgcgtaatatcttcggattaaagtgtgggaccgcaaggccacatgccatgagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactttaagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcggggggggcgtttaccacggtatgattcatgactggggtgaagtcgtaacaaggtaaccgtaggggaacctgcggttggatcacctccttaccaagaattaagcgactgcaagtgttcacacagattgtttgatgaatgaataagcgtttgcgttagatggagagaaaagttattgaaaaataacggaatttaacgtagaataatgcgctcaaatggcaaagtggagagcatctttaaatgttgtccccatcgtctagaggcctaggacatcgccctttcacggcggtaaccggggttcgaatccccgtggggacgccatttaaagatgacttttgttgtctaaattgttctttaaaaaattggaaacaagctgaaaaactgagagattttcgaaagaaagtctgagtagttaaaaaaatcttgactgaacaaaagcagtcaagtgtttagttgaataaaatacagcattgaatggatttgaataagatttgaaaacatttgaggttgtatagttaagtgactaagcgtacacggtggatgccttggcaatcagaggcgaagaaggacgtgctaatctgcgataagcttggatgagttgataagaagcgtttaatccaagatttccgaatggggaaacccactagatgaagaatctagtatttactactgaatacataggtagtaaaggcaaaccgggagaactgaaacatctaagtaccccgaggaaaagaaatcaaccgagattctgtaagtagcggcgagcgaaagcggaagagcctgttagtgatagcagtagacacagaagaacgagctgggaagctcgactataaagggtgatagtcccgtattcgaagtgtctattgtggtactaagctaacgacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcctctttgtggggtgactgcgtaccttttgtataatgggtcagcgacttatattttgtagcgaggttaactgaataagggagccgaagggaaaccgagtcttaactgggcgttttagttgcaaggtatagacccgaaacccggtgatctagccatgggcaggttgaagattgggtaacactaattggaggaccgaaccgactaatgttgaaaaattagcggatgacttgtggctgggggtgaaaggccaatcaaaccgggagatagctggttctccccgaaatctatttaggtagagccttgagcggacaccttcgggggtagagcactgtttcggctaggggtccatcccggattaccaacccgatgcaaactgcgaataccgaagagtgatactcaggagacacacggtgggtgctaacgtccatcgtggagagggaaacaacccagaccgccagctaaggtcccaaagtactagttaagtgggaaacgaagtgggaaggcttagacagctaggatgttggcttagaagcagccaccatttaaagaaagcgtaatagctcactagtcgagtcggcctgcgcggaagatgtaacggggctaaaactagtcaccgaagctgcggcatcagtcgaaagactgttgggtaggggagcgttctgtaagcggatgaagctgaattgagaagtttggtggacgtatcagaagtgcgaatgctgacataagtaacgacaaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtataactgcgatgtggggacggagaaggttaggttatcagactgttggatgtctgtttaagccggtaggtgggaattttaggcaaatccggaattccgttaacaccgagaagtgatgacgagtctctacggagatgaagtaaccgataccacgcttccaggaaaagccactaagcttcaggttatactaaaccgtactataaaccgacacaggtggtcaggtagagaatactcaggcgcttgagagaactcgggtgaaggaactaggcaaaatagcaccgtaacttcgggagaaggtgcgccggcgtagattgtagagatttactctcgaaggttgaaccggtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagatgacacgccagtgttgttggaggcgtccttgaaataccaccctttaacgtttgatgttctaacgaagattgcggaacgcggtctcggacagtgtctggtgggtagtttgactggggcggtctcctcccaaagagtaacggaggagcacgaaggtttgctaatcacggtcggacatcgtgaggttagtgtaatggtataagcaagcttaactgcgagacagacaagtcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgttccagttgtctcgccagaggcattgctgggtagctacatgcggaagagataagtgctgaaagcatctaagcacgaaacttgcctcaagatgagttctccccgactataagtcggtaagggttgttggagactacgacgtagataggtctggtgtgtaagtggtgtgagccattgagctaacagatactaattgcccgagaggcttaactatacaacgctcaagtgtttttgagcactacactcagtagcagcttgtttcgaatttaagaagaaagaacaaagacaaagaaagaagacaaaagacatcaacagaatattctggcgaccagagtgctgtggctctacctgactccattccgaactcagaagtaaaacgcagtaacgccgatggtagtgtggggcttccccatgtgagagtagggcatcgccagattgaatttaggaccccgtagttagagatagctacggggtttttgcttttctacaactggcatgatgttgtttaatccagagccttattcttaacctcaacctcatccttatctttactttcattttctcctttctttttttcctttttgctgatttaaatagccctactaatgatttgcaaaacggcagggaaatttgaccgcttattgagaataaaaaaacggctagaaattgattctagccgtttccttattaagcggtatatattatttgttgatatggtgatcaataatttctgcccatgtaagacgataagctttccagtattgttgttccgcatgatgtttattttggcacagcggcgtccaaggtttagcgatccctgtataatgaataagtatcggtgcttgatcaccaatattcatgatatcgtcataaatatctaaacgattactttcaattaaataatagcttgcaccaaattgataattatatttttttgctaatgggaagtattgattctgtagcactaaatttaaaatatcctgatcggctaagtcagaaccgctttgctgataagtcagaattgcattttctaacctctgatctatatcagcggtttctcgccattttttattattaaacaataatactccggcattaaaatattgctctatatgtgggaaaaacttatggtagaagaagccgctattaattaaaaaatccggtgaggctgcggctaagtaatttgtcagatcttgttggtatagtgataacagagagccatttgcaattatgtcacaatcgagataaagcactttatcttgaggaataagttgaggaattaaacaacggtagtagcttgcttcggatacatattgcatagtttttaaatgcgaaaaatttgtctgttcaacttttatatctgtaatacggcaatttatcttattcaaattcagattaagagcataaaaccactgttctgaaaaatctttattgatcagataaaagtgtatgtctttatcaaaaaagcaaatagatttaattagggtaataatttgttctgcgtagttacgatccgcagcaaaagcaatatgcattgtagcggtcatttaaagggctacctgtggatgaaaggtttcactaaccttgacgaattctgtaagcgaaatggatttaaattttgtgtttaaccctctagcttcgagatcgttggctaatataaataaatgagatatttgtgaaaaaagttgaggatatttaactgctagcaagacaccgtcttgccataagactatggcatcatttgccgtaatttgagcgagtatttggtttagttcagttaactcatattgtgctttagaaaatgtataaagcatagggattccttattagaacgttagtaccttttcagcttgcgcaagaatggcaaacagctctgtttgagggatgatatttgcgttaggtaaaatccattcggcattgcttaatgctctttggttgatggattcttcacaaataaaacattcggttaaatcatatagatcaattaatttaaaggctgagatatgatctttctgtaagatgatattaggctgctgctgcgctaatagattgaatacgctgtcatttaaaaagcagatagcgatttcatcttcggcacaaaaagcgctggcagcaagtaaagtatctaagccttcacgactggttgccgttccaaaaggtggttgagtaaaaaggaatgcaagtttatattttttcatcattaaaaggttaatagtctgtctgctttgagtgccgcttggctaaattcaccaagtcctgccagtataaaaccttcggcaagattcgtttgctgggttttactggtttgatgatccacaactccccgtctttgtgctgcagaaatacaaaggtgtaagggtaaaccgtgtaattttgcgaggtgttgccatttttctaataaatttatttcatcacttgcagggtttactaaagcatttgcattgctgataccgtcttgaaagaaaaatacttgtttaatgttatgttctgcagctaataatgcttcagcaacttgataagccaaatatgccccttgtgcaccgtaaacaggcgatgttatcgcaagtacataatccattattcgttatcctgtttaatttgtcggatataaaggtaaacggtatggcgagaaatatttaagcgatcagccacttgattgatcgcatctttgatatcaaaaatacctttctcatataacgatacgacaatatggcgatttttattgttattagcaacattacgatccgccatggtttcttcaatcgtatgttcgatagtttgagcaactaaatcttccacagaactcgcaaaattaactgctgtgtcttcgtcatcttgtagcggcgcaataaaggcgcttaaaaattgtgatgccggtacatctaaattgatattaatgcaaataaaaccgataacatgttgtttgctattacggatcgccacggtgacggatttcattaatacaccgcctttagagcgcgtgaaataaggcttagagacgctatccgttttcatttgatgtaacgatttaagcgctttatcagtaagaggcgagccgattttgcgatcggtattatgcccgtttgcaatatatatggcagagttttcaaggaattctagtgaatgcaggacgatttcgcagtgttcgccgattaaggcggcaatgccgtccacaatcggaaaataagacgctagaatcgcatgatcttcttcggtaaacgtttggaattttttcatatgtatttagggactttatgtcacttttgttatggagtcatattgaggagacctaaaaagcaagcggtctaatttgcaaaaaattctacaaattagaccgcttagattcaagggttattttttcgcttcagccgctttgaaatctaataattcgatttcaaattttaaggttgagcttgccggaattttacctgcttgacgttctccgtatcctagctgaggcggtaatacgatttccatcttgccgccttttttcagcattggaatcgcttcaatccaacccggaattaattgatttaattggaattcaattggctcaccacgatcgtatgagctatcgaacaccgtaccgtccgttaatgtacctttatagtgtactttcacggtatcttcagcttttggtgattcgccggtacctgctttttcaattttgtagagtaagccagaagcggtttttttcacgccggcttttttctcatattcagcacggaatttgtttcctgcttcgatagttgctttacttttttcagcagcaattttgctttcttggcttgcaagataagtatcaagtgcttttaattgtttttgtaagtcttcatcggttaatttaccggtttttttaatcgtatcttgtacgccggctaaaattttatcttggttgtaagagaagatttctttttgtgatgcaaccacgccttcaatgtttttgcccattaatacgccgactgcgtatgaagactcatctacaaatttttgatctgctttttgttctgcaaaggtcgcttgcgatgctgcaaatacgctcgctgcgactgcaagtacagaaagtttgctttttaacatagattttccttataaataattgttaaaagaaagatagatagggtaaagtgtattcctttattagacaaccttttttattaaaaatgacgatagaacacgatcttttacaacgtatagctgaattagaaacaaaagttgctttccaagaagtgacgatagaagagctgaatcaagcgttggttcatcatcaatttgctttggataagctccaaacccaagttcgacactttgcggaaaagttgcaaggcgttcaatcaagtaatgttgcctcattagcggaagaaactcccccaccgcattattaggttatgaacttattcattagttcggattctaatcgcacatagtttttatgaggtaattttactaagtatgttatttaagaatttagtgaagtggagtgttggtttagcaatatctatcttggcgttaactgtttttgcttcttcggtacaagcggttgaaaatgcgcaaaaaaatgcaaaaaatgaaccgctttttaaagatgggaaaggctattactcttataagaaaccaataaggattgagctacctaaagatggtcgcgtattaattcaatatttctttaaatatgattgtgccatttgtttaaatgctaatgactatttaaaacagtacgcagaacaacataaagataaagttgtgttgcagcgttcgcctgcttatgaaaaaggtgattcgtttaccggtcaaatgcattcgacttttatggtcatcgggcgtgaggatttgagtgaactttatttatttgatagtgtagggcgcaaagaccatgtcagtttagtgaaaagtgatgcggctgtgacacaatggctaacttcaaaaggtttagatgctagcgcatttaataaattgttttattcggaagaagttaagcaacgaatggaacaagaaagagtgttgtttaacttatacaatccaccgtatgtaccgatagctatattgaatggcaaatacattttgttacaaaatactttatacaacgacgattatacttacggtgtattagatttcttaattgagaaactacaacaagaacaaaaagaggataaaaaataatgaaattaaaaattggaattatcggcgcaatggcgcaagaagttgaaattttacgtaatttaatggttgaagcaaaagtaacggaaatagcgggttgtaaaatttatgacggtaaaattaataatacgcgtgtggcgttattacaatccggcattggtaaagttgctgctgctgtaggcacgacgttattacttgaattagcaaagccggatatgattattaatacgggatctgctggtggcttagatccaaaattaaatgtcggagatatcgtgatttcaacggaagtgcgtcaccacgatgtagacgtgacggcatttggttatgaaaaagggcaattaccggctaaccctgcggcatttattccaaatgagcatttgatgaatgtggcaattaaagaaacagaaaaagcggggtttaatgcggtatccggtttaatttgtagtggtgatttatttgtgaacggagcagaaaaaattgcgcaaattcgtcaaaacttcccaagcgttgcagctgttgagatggaagctgcggcgattgcacaagtttgccatgcgtttgaagtaccttttgtgattgtacgtgcgatttcagatgttgcagataaagaatctcatctttcttttgatgaatttttaccactggcagcagaaaaatcatcagaaattgtagtggcaatgttaaatagcgttgcttaatggaaagtaaacaagcggtcgaaatttaacaaaattttgcaaaaaaagttaaaaattcgaccgcttattatcgctattctattgtaagttttgtacaatattcaatcttttacctacgcttatttgtaggtctttttttatttattgattacctaattatatttttgagaaatttatgagtactactcccaatattggttttatcagccttggctgccctaaaaatttagttgattccgaacgtattttgacggagttgcgtacagatggttacaacattattccaagttatgaaaatgcggatttagtgattgttaatacctgcggttttatcgacagtgcggtacaagagtcattagaggctatcggtgaagcattggaagaaaacggcaaagtcattgtaactggttgtttaggggcaaaagaaaaccaaattcgtgaagtgcatccgaaagtattagagattaccggaccacatagttatgaagcggttatgcagcatgtacataaatatgtgccacgtccggaacgcaatatttataccagcctagtaccggcgcagggagttaaactgacgcctaaacattatgcttatttaaaaatctcagaaggctgtgaccatcgttgtacgttctgtattattccttcaatgcgtggtgatttagatagtcgcccgattgttcaggtgttggacgaggcaaaacgtcttgctgactcaggagtaaaagagttattaatcgtttctcaagatacttccgcatattcgttagatcagtcaaaagaaaatcaaaataaaacggtcttctggaatggtgcaccaattaaaaataatctgattacgctatgtgagcaattaggaactttaggcatttgggttcgtctacattatgtatatccgtatccgcatgtcgatgatttaattccgttaatggcgcaaggtaaaatcttgccgtatttggatattccgctacaacatgcaagtccgaaagtattaaaagcaatgaagcgtccgggctctattgagcgcacgttggagcgtattaaaaaatggcgtgagatctgtccggaattaacgttacgttcaacctttattgtcggcttcccaggggagacggaagaagatttccaaatgttattggatttcttggaagaagcacaattagatcgtgtcggctgttttaaatttagcccggtagaaggtgcggtagcaactgaaatggcggatcaagtgccggaagatgtgaaagaagagcgttttcaccgttttatgcaagttcagcaacgtatttcagctgctcgtttacaacaaaaagtgggtaaaacccttgccgttatcgttgatgaaattgacgaagaaggtattattggccgttcaatggctgacgcaccggaaattgatggtgtagtatatgtagataatatttcaaatcaggaagttaaaattggccaaatcatttctgtaacgattacaaacgcagatgaatatgatctttggggaacgtgttaatttttgggacaattcgtatggaacacactaaaaaacctaatttagcaacatttgaagctgcagtagcagcaaaaaaatatgaagaatcttgtaccgaattacttgagattttagcgaaactcgatagtaattttggtggtattcaagacattgagtttgaatttccttctcaattaaaagatcttgagcaagagaaaacagtttatttctgtacgcgtttagcgaatgcagtgagtacgttgttttctgatccaggcttagagatttcagtagaaggtgcgcagcgttttctagcattccaacgctggttgtccctgatttttgcaagttctccgtatgttaatgcggatcatgtattacaaacatataatcgtaatccaaatcgtgagaatagcttagatattcatttagaagcaacaaaagcggcattaattaaattctgtattttatatttaccggaatcgaacgtaaatttaaaccttgatgctgcatggaatgcagatccggaactttgtgcttcactttgctttgcattacagtcgcctcgatttatcggtacgccagcatcattctcaaaacgtggtgcgattttacaatggttcccagctcgtttagcacaattacaaaatctaaataatgtgccgagtgccatttcgcatgatgtttatatgcactgtagctatgacattgccgcaaataagcacgatgtgaaaaaagcattaaatcaagtgattcgtcgccatatcgaaaatgaatatgggtggcaagatcgtgatgtgactaaaatcggttaccgtaatggtaagccggtaatggttgtattactagaacatttccattctgcacattcgatttatcgtactcactctacttcaatgattgcagctcgtgaacatttccacctcatcggtttaggtaatgcatcggttgaccaagcgggtagagacgtattcgatgaattccatctggttgatggtaataatatgaaagacaaattagagtttatccgctcaatttgtgaaacgaatggtgcattagtgttctatatgccgagtatcggtatggatttagcaacgatttttgcaagtaatacccgtttagcgccagtacaagttatcgctttaggtcatccggcaacgactcattccgactttattgagtatgtgattgtggaagacgattatgtaggttcggaagaatgcttcagcgaaacgttattacgtttaccgaaagatgcattgccgtatgttccatctgcgttagcgcctgagaaagttgaatacttattacgtgagaatccggaagtcgtaaatattggtattgcttcaaccacgatgaagttaaatccgtatttcttagaggcattaaaagcgattcgtgatcgtgctaaagtgaaagtacatttccattttgctttaggtcaatcaaatggtgtgacccatccgtatgtggaacgctttattaaatcttatttaggtgattcggcaacggcacatcctcattcaccttaccaccaatatctcagtattttgcataactgcgatatgatggtgaatccgttcccgtttggtaatacaaacggtattatcgatatggtcacgttaggtttagtcggtgtatgtaagaccggaccggaagtgcatgaacatattgatgaaggattatttaaacgtttaggtttacctgagtggcttatcgctaatacggtagatgagtatgttgaacgagcagtgcgtttagcagaaaatcatcaagagcgtttagaattacgtcgtcatattattgaaaataacggtttgaatacgttatttaccggagatcctcgcccaatgggacatattttattaacgaaagcgatggaatgggctaagcagaatagtgttgaactacaaattaatacacttgtagatgaacctaaagcaaaaacgccaagaaaaaccaaaacggttaaagctgcttcgacaacgaaggtaaaaacagcaactaaagctaaaaaggaaacggcgaaaaaagattctccgttaaaagcagcagctaaaaaagtaaagaaaacgactaaataattaacgtatttattgtaaaagcaccgaggagacctcggtgcttttttattgtttaaattctggtcagatgagtcttgtttttcgaaccttttgatatgaattaagtcttatggaaagcaaatgtttatataaacaatttgtgatagtagtaacctttaaaataaggaattaataatgaaatttatggtaaaagtacttgcggttgcggtattggcaacaacagtttcagcgtgtaacggcttaactaaatcacaacgtaatacggcaattggcgccgcagttggtggggttgctggtaatatgattggaaattctactggcgcgacattaggtggtgctgcattgggcggtgttatcggtagccaaattaaataattcttcaaataagaccagttaattataaaaattagctggtcttattttttatacaaaaagttgcataaataaaattatctaatataattcggatgttttgaaacgaaatttagatattaaatatcgaaacttctcatgaggaaagtatgtcaaaaagaaatacgcaacaacgtcgccacctaattgtaaaaatggtacaagaacagggagaggtgagtgttgaaacattggcaagtttcttcgaaacgtctgaagtgacgattcgtaaggatttaaccgctttagaagaaagcggtttgttattacgtcgctatggtggagcagtaaaaattccatcagaaatgatagaagatagtaacgagcaactttcaaaacaaaaattagcgattgcgaatgaagcggtaaaacatattcgagatcataatcggattatcattgacagcggcagtacgaccggagcgatggtaaaagccttgtaccagacgggcttagtgattatgactaattcattagcattagcaaccgaattaaccatgcttgataatgagcctacggttttgatgaccggtggtacttgggatactcgttctgattcattccaaggtaaagttgccgagcaagtactacgttcttacgattttgaccaactatttattggtgcagatggtctagatttagcacgtggtaccacaacatttaatgaactcgtaggcttaagccaagttatggcggaggtttctcgagaagttatcgtcttaattgagtctcaaaagatggggcgtaaaatgccaaatcttgagcttgagtggaaaggcgtgaataaattgatcactgatgccgatattgatgaagaaattaaaaagaccatcgaatcatatgggatagaagtgattgtggctcgtgattaagcgagcaaataataaacagtggcaatgatcgtattttaatggaattggcacattagaatcgtaatttattcgctattgcccagttatttattattttttaactttaacataggaaagacattatgtgcggaattgtaggtgcagtagcacaacgcgacgtagctaacattttagtagatggtttacaccgcttagagtatcgtggttacgactctgcgggtgttgcagttctaaacgaagaacacaatatgcaaattgttcgtcgtgtaggtaaagtaaaagcattagatgatgctatttctgcaaacccattagttggtggtacaggtattgctcatactcgctgggcaactcatggtgaaccatctgaaaccaatgctcacccgcatcgcagcggtaaaattgcagtggtacacaatggtatcattgaaaactatgaagaattaaaagcggttttacaagagcgcggttatgtattccagtcgcaaactgacactgaagtaattgctcacttagcagagtgggagctccgcacatcaagttctttattagaagcggttcaaaaaacagtcgttcaattacgtggtgcatacggtacagtagtaatgaatcaagatgatccatctcgtttaatcgttgcgcgttctggcagcccattagttatcggttatggtgttggcgaaaacttcttagcatcagacccattagcattattaagcgtaactcgtcgttttgcttaccttgaagaaggtgatgtagcggaaattactcgtcacactgtagatatctatagccgtgacggtcaaaaagttgaacgtgaaattcacgaaggtaacttcgaagcagatgctgcagacaaaggcccataccgtcactatatgcagaaagaaattttcgaacaaccggtagcgatcatgaataccttagacggtcgtatcgaaaatggtaaagtgaaaatcgatgcaattgcaccaaatgcagcagatattttaactaaagttgaacacgtacaaattgttgcatgtggtacatcttacaatgcgggtatggtagctcgttattggcttgaatcattagctggcgttgcatgtgatgtagagattgcttctgagttccgttatcgcaaatttgtgacccgtcctaatagtttattagtaactatttcacaatcaggtgaaacggctgatacgttagcggcattacgtttagctaaagaagctgggtttatgagcgcaatgacagtttgtaatgtagcaacttcatcgcttgttcgtgagtctgattttgcatttatgacaaaagctggcgtagaggtaggtgttgcttcaactaaggcatttactactcagcttacatgtttgttattattaacagctgctttaggtcgtttaaaaggtaatttaactgcatcacaggaagcagatattgttcatgcattacagcgtttacctgcacagattgagagtgcattaacgcatgagaaagaaatcgaacaactttcagaagattttgcagataaacatcatagtttattcttagggcgtggagagttttatccaattgcaatggaatctgcattaaaattaaaagagatttcatacattcacgcagaagcttatgcagcaggtgagttgaaacacggtccattagcattaattgatagtgaaatgccagttgtggttgtggcaccagaaaatgaattacttgaaaaagtaaaatcaaatattgaagaagtacgtgctcgtggtggtcagttatttatttttgctgatcatgatgcagggttagggtataaaacggtagtgttccctaaagtagatgaagtaactgcacctatcttttacaccgtaccgttacaattactttcttatcatgttgcgctaatcaaaggtactgacgttgatcaacctcgtaaccttgcgaagtctgtaacagtagaataattgatctaaatatagagaaaagccggagatttgattaatctccggcttttttttattcacaagcggtataatttcaacaatattttgcaaaggggaacagtatgcagaattttgttaatcatttacctgcttttttgcaatatccattgttttgggtgttggcattgcttgcgattgctgtcggcttatttattcaaaataaattgcgaatggatattgtcgctttgttggtaatgttgggctttgggttaacgggcatattaactacacaagaaatttttgccggtttgagtgacccgaatattgtcttactggctttgttatatgtggtgggagaagctctggctcgtacgggggtggcgtatcatattagcgattggttgatgcgggtggcgggttctagcgaaaccaaagtgttggccttgatgatgttatcaatcgggttgttgggcgcatttatgagttcgaccggcattgttgctatttttattcctgtagcattggcgatttgtgccggtatgaatatttctcctaggcggatgatgatgccgctcagtattgccggcttgattagcggtatgatgactttaattgctactgcacctaacttagtcacgcatgcggaattagttaaagccggctaccaagggtttggcttttttagctttacaccgattggtttggttgttctgctgttaggtattctatatatgctcattgctcgccgttggttggataatggcgatgtgcaagtgttagctaaagacgataacagtatgtcgcatttgattgaacagtatcaattgcatgggcgtgccaagatggtgattttgcaagaagattcaccgtttatcggcaaaactatggacgaactaaaattacgttcgttatatcgaatgaatgtgattgctatccagcgctataaaaatttccgttcacaaattatggcggcgttcggtaacgatcaattgcaagcgaaagatattttactgatggatattagcattgatgaagaatcttttgcgatgttatgtgaggaatgcaaattacagcgtattgaactaaaaggcgaatatttttctacacacgctaaatcggtcggcatggcggaatttgcggtgatgccggaaacggaaagtatcggaaaaacagtacaacagctaaattttcgctcgacttacggtttaagtgtggtggggattaaacgagaagatcgcattctacaagaaaatctactcaccgaatcggtgaaagccggtgatgtgctgttagtcatgggcgtttggcaaaaaatcattacgcttgaaaaatacgataaagatttatttttactcggtatgccgaaagaaggaaaacaaatcgcactggcgacaagccaagcgccttatgcattattttccgttgggttaatggtgatactaatgatcagcggctgggtaccgaatgtgcttgctgctttgatttgttgcttgttactcggtaagtttcgttgtattgatatgaaaagtgcttatgactccattcatattccgagtctgttattaattgtcggtatgatgccgttttcgaccgcaatgcaaaaaacgggtggtgtatcgttaattgtggaagagtttttagcgcttaccggcggggaaagtacgcattatagcttggtgttatgcggtttatttgtgcttactgcattagttgggctgtttatttcgaatacggcaaccgcaatcttaatggcaccgatagcaattgaagtggcgaaacaattaggctattcaccgattgcatttgtgatggtgattacgattgcatcctcggcggcatttatgacgcctatttcttcgccggtcaacaccatggtgattgcgcccgccggttatcgctttatcgattttgtgaaagtcggcgtaccgttcacattattagtaatgggcgtaacgatatggttagttacgttattatttccgttgtagtttgcgtccattagctaaaaagcctgtgatttttatgatcacaggctttttttagtaacatgaagcggtataattcggcggattttttacaataagagagaattatgcaaacgatcatcaattatttaccttcctttatgcaacttcccttgttttgggtattagcgattctggctgttgcggtcgtgctatttattcaaaataaattgcgtatggacgtcatcgcactcatggtgctattggcatttagtttaagcggtattttaaccaccaaagaagcgttagccggatttggtgatccaaacgtgattttacttgcactactttatatcattggtgatgcgcttgttcgaaccggtgtggcgaatcaaatgagtgattggttactacgtgtagcgggagcgagtgaagctaaagtgattgctttgctgatgttatcgatcggtacgctcggtgcatttatgagttcgaccggtattgtggcaatttttattccggtgactttagcaatttgtgccagcctcaatatttctcctcgtcgtttaatgatgccgcttgccgttgccggtttaatcagcggtatgatgaccttaatcgcgacagcccctaatttagtgacacacgctgaattggttaaggccggttatgaaggatttcatttctttagctttaccccgattggtgccttagttttagtacttggtattttatatatgttggcggtacgtcgttggttagatgatggtagtgtgccggtggtggcaagtaacgaagattcaatggcgcatttgattgaagaatataagttaaatggtcgtgccaaaatggtagtgttaagcgaaaattcacactttattggtaaaactattgatgaactgaatctgcgttcggtttaccagcttaatattatcgcaattcaacgttataagaatttccgtcatattactttagccgcatttggtaaagaccaattacaaaagaaagatattctattgatggatatcggggttgatgaggctcgctttgtacaactttgcgaagaattcggtatgcagccgattgagttgaaaggcgaatatttttcgactcaatctaagtcagtcggcatggcggagctaggtgtaatgccggaaaccgaaaccatcgggcaaaccgttgatgcgttaaatttccgctctaacttcggtttaagtgtggtgggtatcaaacgagaaggacagattttacaaaataatttgctgactgaaacggtcaaatccggtgatattttgctagtgatggtggtggcgattgcctcttccgctgcgtttatgacgccaatctcgccggtcaactcgatggtggtttcgctcggtaattatcgatttagcgattttcttaaagtcggcttgccttttacggtgattacgatgttagtaactgctttcttggtgccgattcttttcccttaatgtaagcttaagcggtcgattttgtctatttttttgcaaatttaatgtcaaagttgaccgcttgtataaagttgtacacaaaaatccttaaatgattatttctttttttgtaatagtctattaactataatctatcttatcatcaataattatttctctataatacgtttccgacacaaaagagaagggacgatattcgaggaataatgagattaacttttaaacatatttttttatcactttttttaggcattgccttaagtattacagccagcttacccgtgatttctaatgttgaagcgaaacaagaacaacaagagaaagttatcgaggtatatgaagaattaaataacgcattgattaacccgaattttgccaagttacaaagtttattagcggatgattttgaattggttacttcgaaaaacgatacgatgacaaagcaagaatggattaagaatatccaaaaaggcgggatgaagtacggtgcgattcaagaatctaaaattaagtcaaagggttatgacgaattattagttactgctcgtgtgtttggcgatatgtgggatcaaacaggcagttggaatgtcaaatttgatattgatactaaacaaaacggcgataaggtacagattacaaaaatcattgtaacgcctgttaaagcataagcttgccgtgtaagaacagtgttcaccttagcggtcggaaattgcaaattttttgcaaaattcgaccgctttttttatggttagctatagcgtctttgcataatttcggtaagcagatcaaacacttttaacacccgaggcgatgtaatttgttgataagggcgatataaatagagttgccatttttcaaattgttgctccggaaaaagttgtatcagttgcccattttccagataaggtttacaaaccgtattaccgatatgcgcaacggttctgccggcaagtacggcttgtaattcacaatacagatcggttgtgataaagcccaatttttgtggcacaagaacggtatgctcatcaagataaatttcccacggctgaccggttgttgcgttaattagactgctaaaagggaaatttttgcgtaaatcatccagatcttttgggataccccagcgggcaataaaatcgggtgaggcaacaaaaatatcgtgcatttctgccaacggacgcacgataaaattcggatccggctctttaccggcacggataccgatatctattcgatgtttgacattatctaagcgtgcggcatcgactcgccaatcaataattaaatccggataaggcttaagagcctgtagcagttcaaataaaatttgttcttggtctcgtaatttcggaagcgtaattcgtaccgtaccagccatttcatcttgttgttttttgcctaaattgaatacacgttcactctcggttaacagttgttttgcgtgtaatagaaattcttcaccgaaatccgttaaggtaatattgcgagtggtgcgcttaaatagttgttcgcctaattcactttccagcgcattgataactcgagtgataacaggcggtgaaatagctaattggtttgccgcttctcggaaatttaatgtttgtgccgcagtgcaaaagtatttcaacgcatcaagtttatttaacatatgattttgccatcagaaatggttggaagaacgattgtataaaaatgccgaggatttgaacatagaaagttagctactcactcattttgtgatttattttatattctaaaatattttgcatagttgtaattagttttatttatttgagcaataagtaaaacttttttataattaaaagccaagtttggtgatatttaaagaaaatttttaaggagaatcttgtatgtcattcaaaagtggggcgttaggacttgtttcactcctttcgatttcaatcgcacaagctcacaacgtatggttagaaccaaccaaaaatacgaatgaatatgttgtgaagtttggtcatgaaaccacagaaccctatcctgaaacaaaactccaatctgtccaattactacaaaagaatggtgttctctcttccataaaacctcaatttaatcaaggtgaagcctattttaatgccggtcgtcattccatggtatttttggaatttaataacggtgtttggtcgaaattaccaagcggtaaatatgttgagaaaaccaaagcacaagaacctacagcggtactcagtttaaatccaataaaacttggtaaagcgattctggtgtggaatgccgattcatttaaatctcattcattggaatacgagcttgttccgctttcaaaaccggttgcgggcgaaacgatggatattttggtattacattatggtaaaccggtatccggtattaaggttggattaggagaggataaaccttttaatctgacaaatgaaaaagggatagctcaatttacgccggtagccggttataacaaagtttgggctgagtttgaagaaaagggtgttgttcatccggattatacggaacgaacaatcgaatacatgctgacatttgaagtaaaatgatgagattaaaatatttattagtaatactatttgcattgacctctttaggtgtttcagcgcatagcctacatttatttgcgctttatgacggacatgagatttcgggtaaatcattttattccgatcaatcgccagctgccgaaacttatttggaagtttttagattgggaaaagatggaagcgagactgtaccgattgctacagcaaaaacggatgtttatggcagtttttctattccaatttccggtgatggtccgtttaaagtagtagttgaaggtgcggaagggcatcgtgctgaggggattgcggataatgtgattaaacgcactttagggcgagccgaattcgaagtgttacgagaagatattcagaagttaaaacacaaaatctacctgcatgatcttatcggcggtattggttatatcttcggattatttggtattgttacgttattaaaatcgagaaaggacaaaagctaagtgcatttatcagaaggcgttttacatgctccaacactacttgtcggtgccgttgttgcgactgttggggtgactattggcttacgtaaactcgattatagtcgtttaacgttaacggcattgtttgcatctgcattttttgttgcaggaaccattcatgtacccgtcggcattggtagcgtgcatttaattttaaatgggatggcagggctgtttttaggttgggctgtgtttcccgctttctttgtcgcattagtgttacagacgttattattttcattaggcggtttttctgttctgggcgtaaatttatgcgtcatggctctaccagcgttacttgtacattatatgtttcgccgaccacttgcggtaaatctttctcgccgacaattaatgttgtccggtattggtgctggtgtaattggtgttggaggtgcaattttacttgcttcgacggtattggcgtttgatggcggtaagaattatgcggatttaattggcttattgatcgtctcacatttaccaatatttttagtcgatagtatcgtgagtgtcggcacattatttacgttggcaaaaatgtatcctaacgcactacaagaaacataatggcgtatttatttcaagcacattggcggctgttttatttgtttgtgtttggcgtagtaatcagcggtctgaaatcggtaaatattttactttttttgaccgcttgtttagtcccttgtgttcttatcagtcaaattttttatgggcgatcattaaaagcattagctcgccgttggcttaaattcaatatttttacgttattgatttggttaacgttaagttggcgtttagacacattctccgtacagtgcaatccgcatggtattgaactggcaagcttaattagcctacggatgaatttgattttatgtgcaacgtggttactattattaaatgtgaatgaagttatgctggtgcaagcgatcagtcggcttcctctttcaccgaaattaattcatctctttgttttaagtattcgctatatttccttgttaaatgaggtaaaccgcaagatggatatcgcaatgcgagcaaggggctatcagccgaaatgtaattggctcaccctgaaaatcacttcacaacgcgtggcattattgcttattcacgccatggtgcgagcggaaagaacagaaatggcgctgaaagctcgaggttttaaattcggtaataaatgatttgcagttaatttaaacataaaaaatgaatgtattggaagttaataacctgacggttttacgtaatcgacaagcggtcataaatgccctaagttttaccattgagccgcagcaacgagtatttttacaaggtgaaatcggcgtaggaaaatccacactgctgctttcattgctcggttttttgccgattcactccggtgatatttatttgtttggtacgcattgccaacgagaaaaagattttgtgccgtttcgtggcaaagtcggcatttgttttcaaaatgcagaagaccaattatttggccccaccgtattagatgatgttgcctttggtgtgttaaaccaaggctacactcaagcacaagcttataaaatcgctcttgaacaacttcagatattagatcttgaatatctgaaagatcgtccggtgaatgcgctttccggcggcgaacagaatttcaccgccttagccggcgtacttgcgatgaaacccaaactactactgcttgatgagccgaccaatggtttagatgcaaaaaattgtgcgaaattgaccgctttacttaaacaactccaattaccaatgttggtggcttcgcatgatcaaacctttacgcgacagttagcagataaaacgctttatttacaaaaatagtggcaaagccacaatatatgcaaacacacaggaaaattaaatgaagcttattaaaactacccttacagggatagggcaaatctttttgcaagaaaatggtttgtccggtttggtcattgttatcgcgatgttttttagtcactggacgcttggggtaagctgttttctcggcgcgcttatcggtacgctgacagctaaaatattgaagtatccgccacagcaaattagccaagggctttatggctttaatgcaagcctagcgtttatgtgcaccatgtttacctttgcggaagtggatgcctcaaatcctttaatttggtgtattggttttgttgcttcgattgttgcaacgttaattatgcgtttatttgtgaaaaagaataaagtcgcatttacctttccgtttgtattgagctgctggttcttttgttggggaatcgccaaattaggcttattcggtttaacccagacaacgcctcctttagcggattacactggcacgcttgatgcaatccaagaacctttctatgcttgggcagaagtgaatttcggtaccagcatggtaaccggtacattactttttttagcgattgctattagttctcccattgcggctatgtacggtttggcggcagcagttatcggtactgtatttgctcaccatttaccggatattgatcataatagccttgccaacggtatttacggtttctctcctattctcgtagcttgtgcttttgctggcacacaattacgccattttttatatgtcattgtaggcactttactcgcgattcttattcaatatgcggttgctcaaaccggactggcaacttataccatcgggtttatcattgccagctggttgttattgatcgttaagaaacgattagataaagccgcatttgataaacataaattagtacaattactcaatccataaattcttcctcttcccctcttgggaaccggattttataaataactcataaaattaagaaggtacaaaatgcatttaacttcaagagaacaagaaaaactgatgttgtttcttgccggagagttggcggcaaaacgcaaggctcgtggtgtgaaattaaattatccggaggcaatcgcttatattgctagccatttgcaagaggctgcacgtgacggtatgtcggtggcggaagtaatgcaatacggtgcaacgttactgacgattgatgatgtaatggaaggtattgcggaaatggttcacgaagttcaaatcgaagcgacgtttccagacggcacgaaattagtgacggtgcataaccctattagataacgataccctctccctcaagagggagagagtaaacaaataaggaataaaaaatgatccccggagaatatcaattagcagacggtgatgtacaagcgaatgtgggtcgcaaaaccgtcaaattagaagtagtaaatgcaggcgaccgcccgattcaagttggttcgcattatcatttttttgaaaccaataacgccctaaaatttgaccgcttgcaggcgcgcggtatgcgtttaaatgtgccgtcaggcaatgcggtgcgttttgaacccggtgaagcgaaagaagtagaactggttgagtttggtggtaataaagtgatttacggtttccataacgaaatcgacggcaaattatagggagtaagaaaatggcattaacaatcccacgcagtcagtatgtagcgacttacggcccgacagtcggtgataaagtccgtttaggcgacaccgatttatgggcgacaattgaacaagatttgttaaccaaaggcgatgagtgtaaattcggcggcggtaaatcggtacgtgacggtatggcacaatcaagcaccgtaacccgtgataacctgaacgtattggattttgccctcactaatgtgatgattatcgacgcaaaattaggcattatcaaagcggatattgggattcgtgacggtcgtattgtcggtatcggtcaggcgggtaatccggatacaatggataacgtcacgccaaatatgattatcggcgcaagcaccgaagtacataacggcgcacatttaattgcgaccgccggcggtatcgatacccacattcactggatctgcccgcaacaggcacaacacgctatcgaaaacggtattactacgatgatcggcggtggttcaggtccggcggacggcacacacgccaccacttgtacaccgggtaaatttaacattgaaagaatgttccaagcttgcgaatccttaccggttaatatcggctttttcggcaaaggtaactgttctacgcttgaaccgcttaaagaacaagtggttgctggtgcgttaggcttaaaaatccacgaagactggggtgcaacaccggcagtgattgacgcagcgttaaaagtagcggacgaaatggatgtgcaagtagcgattcacaccgatacgctcaacgaaagtggtttcttagaagacacgatgaaagcgattaacggacgtgtgattcacactttccacaccgaaggtgccggcggcggtcatgcaccggatattattaaagcggcgatgtacccgaacgtattaccggcttcaaccaatccaacccgcccatttactgtgaatacgattgacgagcatttggatatgctgatggtttgccaccatttagataaacgtgttccggaagatgtcgcatttgccgatagccgtatccgtcctgaaacgattgccgcagaagatattctgcacgatatgggcgtgttctcaattatgagttcagacagtcaagcaatgggacgtgttggcgaagtagtgactcgtacgtggcagactgcggataaaatgaaagaacagcgtggagcattgggcgatgaaggtaacgacaacttccgtattaaacgctatattgcgaaatataccatcaacccggcaatcgctcacggtatcagccaacacgttggctcgcttgaagtgggtaaactggcggatatcgtactatggaaaccgcaattcttcggtgtaaaaccggaatttgtgatgaaaaaaggctttatcagctttgctaaaatgggtgacccgaatgcgtcaattccgacaccacaaccggtattctaccgcccaatgtttggggcaaatgcgaaagcgaatactgaaagtgcagtttatttcgtttcccaagcgagtgtagaagcggatatcaaaacccaatatggtatccagaaagatactttagcggtaaaaggctgtcgtgatgtaggtaaaaaagacctcgttcataataacgcaacgcctgaaattaccgttgatccggaacgctacgaagttcgtgtggacggcgagcatattacttgcgaacctgcgactaaagtgccgcttgcacagcgttatttcttgttctagtgttcaccctctccccttgcgggagagggacagatttttctttgttaagaagaaaaatcagggagagggggaacggttttttcctctctttgtttcgctaaacattccaacaagcggttaaatttgcataaaattttgcaaataccacgcactgacgtgcgtggttaagtatagggtcgtcgctctgcgacaattcacctaagttggttgcagagcaaccatacaatgtctaacctcatacgtgagtatgaggaaaaaggagaatctatgaaactctggtattccactactagcccttttgtgcgtaaagtgttagtcacattaaaacaccaacaattagaagctaaaaccgagctgttaaaaattaactcatcggtcgatccaaattcaccacacaaccaagacaatccgcttggacgtgtacccgctctacaacgtaattgtggaaactggttgtttggtagtcagctgatttgcgaataccttgatcaaaaaggcgaccaaccgaaattattcccagaaagcggtaaaccacgctgggcggcattagcgttacataaccttgcggacggtattttagaaaacaccgtaccgattatggcggaacgtttacttcgccctgaaaatgaatggtggacaagtcgccaagaacagttaatggatcgtaatattcgctcattcccacagcttgaaaaagcgattgagccattcggcacagaactaaatatcggcacaattactgcagtttgcttaattgattggttgcaattccgtgccgaaaaactcggctacgatcttgcaaaacatcacccaaatttgaccgcttgggcggagcagatgaatgataagtatgcagtgttggcagagacaaaacctaaggtgtgatattttttatatgacctaatgttttgacgattgtttgaaatcatcgaggaatgataactgttcattttttcagtataatgattaaattatattacttaaaaggagaacttgtatggatcaacaattacaaacattaaaattatcgctagaagcattagtgcagcgtattgatcaagataatattgagtattggtttgctcgcgatttacaaccttatttggggtatagccgttgggaaaactttaaacttacgattttaagatcaatggaggcttgtgaaactagtggtttccctgtgtcagaccattttcgtggcatcacgaaaatggttaaattgggtagtggtagtcagagaaaaattgaagattttatgctgactcgttacgcttgttatttacttgcataaaatggagatcctcgtaagcctgagatcgcctttgctcagagttattttgctgtacagactcgtaagcaagaagtaatagaagagcgaatgaagttgcaggttcgtattgaagcaagagatcgtttgcgggaatctgaaaaaatactttcaaaaaacttatatgaaagaggtgttgatgatgccggctttggtcgtattcgttcgaagggtgatcaggcgttatttggtggttttactaccaaagcaatgaaagaaaaatatgggattgttcctaatagagcattagtagattttttaccgacattaactattgcagcgaaaaatcttgcaacagaaatgacaaaccataataccttgcaagatgatttacaaggcgaaacggctatttctgatgagcatgtgcagaataataaaactattcgagaaatgctggggcaacgcggaataaaaccagaaagtttaccggcagaacccgatttacaaaaacttgaaagaaaagtgaagtctgaagataagaaactagcgaaacacgtgaaaagtttacctaaagagaactaaaattattatgcaaatccttaacccaatccttccagtaatggaagatattttaggcaatcttgccgagctaaaagcttcaggcaaaattaccaatcaacaaatcgacaccgttgaattgcaatggtatgaaagtgaacgcaatatattgcgtaaaacgtcgaaatcaggacgtgaagtggcgtttcgtttgctgaaagaagggcaacgtttgaagcatgatgatgtagtttttgtgagcgagagcctagtgattacgattgaaatcgtgccaagcgaagtgattgtgctttcaccgaaaaccttgcctgagatggctcgtgcttgctatgaaatcggtaataaacattcgccattatttttagatggtgatgaagtcacgctgccgtacgacaaaccgatgtttgaatggctacaagcggcaggatttgaaccgaaaaaagcagaacgtcgtttaagccaagcattgcgagcgaattcggcacaaggacacggacattctcacggtcatagccatgcgcacgatcatcacggctatcatcaccatggagacggaaattggcacaagcactagatttcgcacgtatggggcagttaggggcgttgttacacttagttgatcctacgctgccaatcggtggttttaatcattccaacggcttggaaacctttgtgcaacaaggcaaagtgaacagtcgagcaagtcttgaagagtatgttcaaacccagctaatgcagaactggatttacaatgacggtgcgtatttatcactggcatttgatgcaatggcaaaccacgatttagaccgcttgttggcgttagatcaagagcttgccgccagcaaaatcgctcgtgagagtcgtgagggcagttataaattaggtgtacgattgctgaagatttttattcgttatgaaaatcacccattactgagtgccttccaacaagcgctcagcgaaaaacgttgtcagggctatttcccaattgtgtttgcaatggtggctcaagcgatgaatctagataaagccgaaacgctctatgcgttctactacaatgcggcagtcggagcggtgactaatggcgtgaaactggtgccgttaagccaaatggacgggcaagatattttatttgcgttacgcacactacttgcgcaagcggttgaaaatagcctaaatcctgatcccgaatggctcggcgcagcaacgctggcaagcgatattcgctcaatgcaacacgaacagctttatacaagactttatatgtcttaatttgaataataggaaaaccaatgcgtaaatatatcaaaatcggggtggcaggccctgtgggagcggggaaaaccgcattaatcgaacgtttaactcgtgaaattgcaaaccgttatagtgtggcagtaatcaccaatgacatctatacgcaagaagatgcggagtttttaactaaaaacagtttgcttccacctgaacgcattatgggggtggaaaccggcggttgcccgcatacggcgattcgtgaagacgcttcaatgaaccttgaagcggtagacgaaatggtcgctcgtttcccggaagtggaattaattttcattgaatcgggtggcgataacctttcggcaacgttcagcccggatttggcagacgtgacgattttcgtgattgacgtagcacaaggcgagaaaattccacgtaaaggcgggccgggtatcacgcgttcagacctgttagtgattaataaaactgacttagcaccgtttgtgggggcggatttaagcgtaatggaacgtgatgctcgctgtatgcgtaacggtcagccgtttattttcaccaacctaatgaaaaacgaaaaccttgatggtgtgatcggttggatcgaaaaatatgcgttgttaaaaaatattgaagatccggcgtctttagttcgttaaatactataaccctcgccccttgcgggagagggacggatttttcttcgtacagaagaaaaatcagggagagggtaagcggtgagaatatcgtaacattttgcaaatttcccctctctctgcaaaaaattgcctaacgcaatttttcgctgtctctctcccacgaggggcgagagtgagcaataaaatgcaaagcaaacttttactttcaacaaaacttacctcacaaggcaaaacgcagcttgatcaatactttgtgtcgccaccgtttaaggtgatgaccttgccgaatttggattcgcattggcgcaatgctttgaatgcgatgcagatgtcgtcatcgccgggattactggcgggcgatcagctggatatagagatgactttggcggagggttctgcgctttcgttgaacacgcaggcatttactcgcgtgcaatcaatgaatgatggcgattatgccacgcaaaaaacgtgcataaaattgggcaaaaatagccgcttattttatcttccgcatccgttggtgctgcataaagacagcggatttaagcaaaccacagaaattgagatgggggagcagtccgagctaatttatggagagattgtggcgattgggcgtgtgctaaacggcgagcgatttgctttccgtcattttgcgtcctatttgcggatttctcaccaaaatcgaccgcttgttaccgaccgtattcaatggctgccggcaaaaatggcattgacctcattgagccaaatggaagatttttcgcatcaaggttcattaacctacatcaatttggcaaaaaatgccttagaaattaaggcgattgtgagcgagttacaaaccttgattgccgagcaaaaagagatgtcggtgggggtatcccagttaaatgacggcggattaatgattcgagtgcttgcacatcgagcggatatcattcaacatttatttgagcggattgggcaagttttaaaagctcagtccaatattgtttaatttaggagagcaattatgatcgcagtttatgcagtatgccatgtaaaagcggataaaaccgcagaatttgaagcattggcacaaaacttaattcgtgcttcacttaacgaccaaggttgtatttcttatggttgtggtgcggtgcaaggtcagccgaatgtgtatacttttgtggaacaatggcaatcgcaacaagatttggcgttgcatactcagcaagcgcattttattgatgcaggcgctaaatttgccgagttattaagtcagccgatagagattaatatcgtagatttactttaatttgaaacaagcggtcgtattttcacaagaatttacgaccgtttgtttttttaatgataggtaaatttgattggcaagtcgggtaacttattgctaatttggcgaacagctaagcacttagtgcgctaagtgtatttaccctcaatcttattggagaagaaaccctatggatttcagcaaaattttaaatcaagtgctaagcgttgcacaggaatcagcaaaaaatgcgatgaacggcaataccaccaccgataaagtcgccaaaatcggtggcggagcggcggcaatcggcattctttcgatgatcttcggtcgtaacggcggttctagcttagcgaaattagggtcattggcggcaatcggtagtcttgcttatcaggcttaccaaaaatatcagcaaaaccaaacgcaagccgctccggtgagtgaagaaaattttgcggtgacagaacaaaatgctcaagcaagtagccaagttattttacaagcgatgattgcagccgctgcttctgacggtgcgatttctaacgaagaaagacaagccattttaggcgaagcgggacaagatccggaaatccaacaatggattgaacaggcgatgtatcaaccggcgactgtacaacaaattgccgcacaagtcggtaacaacccagcattagcggcgcaagtttatttagccgctcgagtggtatgtgctgatctagctcgtaaagaaattgttttccttgccgaccttgccgaagcactcggtttagacgatgcgttagtagagcaattagaacaacaagcaggcttctaatccaagtagcggtcgtattttgtaaaaattttgcgaccgttttttattgtaaatcaacaacagtataaagctcggttgattcaaactcgctttagtattagagtaacaaagtgattaacttataatttataggggtttttatgaaatcagataaaccggttgaatgtgtgggttgtaatacttttgatgttggctcaatcattgataacagtgaacgagatgcaaaatttgcaaaagtatatgaaacacaagcggatgcggaacaagcacttgtgaaattaacccaaaaagctcgtgacacggaaagcgaaccgtgtgaaatcaccagcgaaattaaagcggtagaaggtggttttttactggatgcgaatttccgttttagttgccaagcggaagtggtaattttccaattaggtacacgtgcaatctaaattgtagttatttgaaaagcggttggattttgctgaaaatttgcaaaaaatgagcaaaatccaaccgcttttgttttcggagaaatttatgaacccttgggttttattgggctttgcgattgtcattgaagtgattggcagtaattgcatcaaggcaagcgaaggttttagcaaaccgctaccgaccgtagtggcaattggcgcttttgtgatagcgctatatttattatcggtgattaccaaaacattgccgattggtattgtgtatgcggtatggtctggagtcggtatcgtactgaccgccattgtggcgtatttcgctttcggacaaaaaccggatttggtaggttttatcggtatgggaatgattattgccggcgtgttggtgattaacctgttctcaaaagcatccgcttaatttgtgaatgagatacaaacggttgatttttgcaagagttttgcaaatttttctttaaaatcaaccgcttgttttcgattaaggctgctcacctgctaatgcacgagggaataaattattattttccaaatctacgtgcgcatctaaatcagcggcaaattcttgtaagccttgatatagattacgccaagatgtgcaagcaccttctggcggagtaaagttattggtcagtttttgcattgcttcgacatcattacctgcttcatcgtgttcggcttccatcacggaaatcggtgccgccgccatttttcctctgccggctttaatcaatgggaacagaatttgttcttccttcatcatatgattcactaaatccgcataaactttacgaataagttccgctaaacctttcgggcaatgagcactatctgcgtgaacggattccactttttccgccaattcaatcaggatcggtaattggttgcgatgtgtatcgtgaaaacgagggataataaaatcaatgatttcgccaagcggtacgacatgccaatctttatcggttaaaacagacatcgtaaactcctaataatatagttgattaaattagtaggaattataaatttggaagtttagtggctctataatcaagacggggtagcaattagacttaaatcaaaaagcggttatttttcgcaactttttcggtattatgtagctgttgcacaaaattattgataaatgaaacgtaggggcgaaccgatgtgttcgcccaagaaaaaccaataagaaatggtgtttatcaagggcggacacatcggtccgcccctacaaactgatttgtgcatttgctacataatactgaactttttgcaaaaaataaccacttgttaggaatggattagcgatttaaccacgccatatattctttagtgccttcggctacggttttgaatgtacctgtatagcctgccgcacgaagttttgttaaatccgcttgggtgaaggtttggtagcgagattttaagtgatccgggaatgggattttttcgatttcacctttgccgtggaagtcgatcaccgcttgtgctaccgcttggaacgactccgctttgccggtaccaaggttatagatccctgaaataccgttttgccacgcccaaatatttactttcgccacgtcttccacatacacgaaatcacgtaagaaagtttctgaaccttcaaataatttcgggttttcgcctttcagcatttgattgtttaagtggaacgccacgcttgccattgagcctttgtgttgttcacgcgggccgtacacgttgaaatatttaaaaccgcataccggcgaatccgcttccggtaaaacttggcgtacatattcgtcaaataggaattttgagtaaccgtaagcattgagcggttgttcaaatttacgctcttcaataaagttatccgaacggccgccgtaagttgccgcacttgatgcgtagaagaacggaatttggcgatctaaacagaaatgtaataactcttttgaatattcgtagttattgtgcattaagtatttgccgtcccattcggtagttgccgagcaagcaccttcgtggaataccgcatcaatatcgccgaaatcatcgccggcaatgatagaagcgataaaatcttctttatcacaataatccgcaatatctaaatctactaaatttacgaatttttcgccgttttttaagttatctacaacaagaatatcttttctgccgatttcatttaatgctttgacgatattgctaccgatcataccaaagccgcctgttacgataatcatagctttttcctttttgaaattaaaaacggggatattatcggtggattagggcggatttgcaaattttgcagcaaattagaccgcttgctagcaaacaaagaaaaagcgagacaatgctcgcttttcttaatgggtaggattattttgcacgctcaatttgttttttgagtttttgcattttttctttaatgcgttggcgtttaagtgcagaaatgtgatccacgaacagtacgccgttgaggtggtcgatttcgtgttggatacagatagcgaataagccatccgcatcgtaaatcacttcttcgcctttacggtttaacgcttttaccttcactttttctttacgtggcactaacgcacgatgaccggggatcgataaacagccttcttcgataccggtttcgccgcatgattctaaaatctccgggttaatcagtaccacttggttagttttatcgccttcaatatcaatggtaataacacgttttaatacgcccacttgcggtgcggcaagaccgataccttcgtgttcgtacatcgtgtcaaacatatcatcgatgaactgatttaattcatcgtccacctgtgcgacaggctcacacacttttgctaacccttcatccgggtaaagtacaacttctaaaactgacattttttgtgatctcaatcgaaaaataaaaaattataaattggttaattaactcgttttcttatgattggctattttgtgaaaaacatagccaaataagacgaacgtccgactaaattacctgtttaattgcggtttgtctatgtttcctttcaataatccataattaatttggggaacttattaatgtcacagactgatttactgaaattattacaaatcccgcaattgggggcgcagcgaattgctcgcctgttatccgaagtagatttcgcccaattttgccaatatgacaagcgccaattacaacaaatcggttggaacgaaaaacaaattcaacgctggttcaatccggaaaagcgttggattgagagtgcattggcgtgggcggagcaaccgaatcaacgtttattgaccttatttgatgaggaatatccgtttttattacggcaaattagcaccgcaccgccggtgttatttgtgcgaggttcgataagtagtttgagcttaccgcaaattgcgattgtcggtagccgagatttttccgcctacggagaatactgggcgggctattttagcgagcaactgattaaacatcatttggcggtaaccagcggactcgcgatcggtatagacggcttttgtcatcagcgagcggtagcggaacagggtattacgattgctgtgttgggcagcggtttagatcaagtgtatccggcaagacataaaaaattggcggaacagattgtcgaaagcggtggggcgttagtatcggaattttttccgaatcacccgccgcttgccgagaatttcccgcgtcgtaatcgaattatcagcggcttatcactcggtacattagtggtggaagccacggtgaatagcggttcactgattaccgcgcgctatgcgttggaacaagggcgagaagtttttgcgctccccaattcggtacaaaatccgtatgcacaaggctgtcataaactgatcaaagaaggggcggtcttaaccgaaacgatagaggatattttacaagcgattcaatatcaactgccggatcagcctcggcaacaggcgttatttgaaacggaacaagcggtcgaaaaaacacaattttttgcaaaagccaatatgccaaataaggtaaatcattttgcaaaaaaattgccggaaatgaccgcttgtcagcaacaaattgtggaacatatcggtcttaatccgatttcgattgatgatttagcgaaagcgaccgcattggaggtggaaacgctattagttgagttactgggtttggaattattaagtgtgattaagcaggtgagtggcggttatgtcagacaataaaaaacggcatctgtggatgccgtttagttcaaaagaagggaaatttattttttcgcttgcagtacacgacgagcgaaaataatacagccgatcacaaaaagcactaagccgagtaattccgccataccgccccagttctcgagatttagcgctaacggcgcatcggaaccgccggaggttaccgaacctgcgatcacaaaggctaatagtacgccgactaaactttcaccaacgattaaaccggctgcgaaaagtgtgccgtagcgttccgcttttttgcttgccgcttcaacatctttaccgttacgttttgcatggcgttggatatgacgattaactaaccaagaaagtaatgcgccgataattaacggtacgtttaccaccggcggtaagtaaataccaatacccaccgctaaagtcggtaaacctaaacgacctgcgctggcttttttcagtaatgtatccacgataattaagcaaataccgaaagcaacaccgactaaaatgtaagtccattcaaggctgtttgagaaaataccgttcgaaatggtcatcataatggtagcttgcggtgcagaaagtgcttgtgccgcatccattccttcacgcggcattgcacctgcaaaaccgtatgcgtggtaaaggatttccaataccggtgtaatgacgaacgcacctacgatacaaccgataattaacgcaaactgttgacgccatggcgttgctttcactaaataaccggtttttaaatcttgtaggttatcgtttgaaatagtcgaaacacagaatacgattgatgcggtgaaaatagttaatgccgtgaggaaacgttgtccatccgcattttccattaaaccgatcgtattacccaccaccatcagaaccagcgaaataatcacgattgagatgataccgatacctgaaatcgggcttgatgatgaacccaccaaaccagccatataaccggatgccgctgcaactaagaagccgactaccaccgccagaaccgtacaaagtacaactaataagaacgctaattccatcggtaaaccgaccggttgtaagaagctgactaatgcaataatgattaacgccacgctagccaatacggtataaatcatcgttttcggtgacagatcttgtgcggttcgttccacgttttgtaatgtcggatcttttaacgcacggaaagcttgtgacataccttgcagcatcggtttaaacaatacgagtaatgtccaaattgccgcaataccgatagttcctaccccgataaagcgaactttacttttccataaacccatcgcaaagctaaccatatctgcatcggccggcattggtgtagtcgcagtgaaataagggactgccacaccccatgtaaagattgtaccgactaacattgcgataccacccatcataccaactaaatagccggcaccgagtaatgcaaaagagaagcccattggtaattggaagatcgcattaccgcctttaaaccagtagcttgtaccgtcagcaaccacacgtaaaccgttagtcaggaagctcactaatgcagccaagagaccgcctgatacgatttcttttacgccgctgtctttgctatctgcctcatcaccggcttttagaatttctgccgcggcaacaccttccggataaggaagatcacttttcactaccattacattacgtaatggaaccgtgaagataacccctaaaatcccaccggaaatacagataagtaaggtttgccaaaacgggaagttttgccaatagcccatcattaataatgcagggataacaaaaataacagaagaaagcgtacccgcagatgatgcttgagtttgtaccatattgttttcaagaatatttgaacccttgaacattttaagtacagccattgagataaccgcagcaggaatcgatgatgcaaacgtcatcccaactttcagtcctaaataaacattagaagcggtaaacaccactgtgatcagcgcccctaaaatcatgccccgtaaggttagctcacgtagagcagtaggattatgcataagtcctccaatataaataaaacaacatattataggaaaaccaacaaatatagataattattcagcctattttgcgcgcattccaacgattatttacacaaatttgtgatatagcgcaaaaaatagagccgattttattaaatcggctctaaatgaaagaatgcgtaattgcattaaaatgcaatttttgcaaaattttatgaaaatttgaccgcttgttattctgtatcggtcaccggttttttggcaaaatagttataagcgactaatagtacaaataatccaacaataatagcggtaatcatatctttattaaatacttgtgccatataacctaacacgataccgacaccaccgaaatctgcatccgagaaggtggtattagcaaagcctaatgaaccgagaacaggtaataagaacaccggtaagaaggtgattaatacaccgtgtgcgaatgcaccgataatcgcaccgcggcgaccaccggttgcattaccgaacacgcctgcggtggcaccgcagaagaagtgtggcactacacccggtaaaatcaatacccaatttaattgtcctaatacggctaaactgatgaccccaccggcaaagctggctaagaaaccgattaataccgcattcggtgcataaggaaaaacaatcgggcagtccaacgccggttttgcatccggtaccagtttttcagagaagccggtaaatgccgggacgatctccgctaaaattaaacgtaccccttgtagaatcacatagacaccggcagcaaaggtaattgcttgaatcgttgcatacaccaaatagtgttgtccgccactgagggttgaaacatattcgctaccggaggcgattgctaatacgtagtagatcaccatcatggtgagtgagattgaaatcgaactatcacgtaagaagctgagatttttcggcaagtccatttcttcggtagattttgagccttttccgaccgcttgcccgattgcaccggctaagacataacctaatgtaccgaagtgaccgaagccgacatcattactaccggttaccttacgcatataacgatgtgcaattgccgggaagaacgccataattaagcctaaggttaatgcaccgacaaataccaattgtacgccctcaaaaccggctacggtcagaatcacgccaatcatacatgccatataaaaagtgtggtgaccggttaagaagataaatttcagacgggtaaagcgtgcaacgataatattcgcaaccataccgaacgccataatcagtgcggtagcagttccgtatttttcgattgccatggatacaattgcttcattattcggaataataccctgtacattaaatgcgtgttcaaacataccgcctaacggtgttaatgaactgagtaacacggttgcaccgccgcttagcactaagaagccgagaattgtttttaccgtacctttgataatatcgggtaacgcttttttctgagcgactaagccgactaaagcgattaatccgactaaaacggacggcactttcaatatatctaaaatgaaaaagagaattgagtccataactcacctcacgcacgattaaaataagcggttaatttttcttcaaattcattcacgctaataatatttttaacgacaataattttgtcttcggcaatgttactgctgcttgcaatatctttcgccatcacaaatacatccgcatcagccggcgtcacagaggccaaatcggtatgtccgacttctgcttcaaccccaattttggctaaggcttttttgatgttcatttccatcataaaactgctgccgataccatgaccacaaactgccataattttcatgtttgcctccatttaagaaaaattgttgataacttcggcgaattcgaagtgggattgactataaaatagaaagattacccgctgcaatgagcaaaaacgaaaaatgtgaactggctaacatttattctgataagaaattgaaagctattgtgttgttttgttcgaacgaatcctttgcaaattattttgaaataaaaattttggataaatttgcataaaagatcgtggcaagtaaggctaaaaatgttagaatctaacgattttcaaaataattgttctctttttcacaacatttaggttttatatggctactgagattaaaaagaaaacccctgaacagatcgaagaaaagggcgttaaaagtaagggtgtaaatggtgcactatggtttgttgctattgcattacttgctgtagctgcgattggtaatgcgtatttcgcatcgcatttttcattagttgtacgcgtattattacttgtcgtattagtggtaggcgctattgtacttgcagcaatgactaaccaaggtcaaaaagcgattggctttattacagaatctcgcacagagcttagaaaaattatttggccaactcgcccggaagcgactcaaactacgttaattgtgctcgcaatgtgtgtagtggtgtcattagtattatggggtatcgactctattatcgttacattgattacgtttttaacaaatttaaggttctaagatgagcgaagtagaaaatacagaagtaacaaaaatgcgttggtatgtattacaagcattttcaggttttgaaaaccgtgttgcagtaacattgcgtgaatatatcaaattacaccaaatggaagatcagttcggcgaagtattagtgccgactgaagaagtagttgaaaacgtaggcggtaaacgtcgccgtaccgaacgtaaattcttccctggttacgtgttagtacaaatggaaatgaatgacgacacatggcatttagtaaaaagcgtgccgcgtgtaatgggctttatcggcggtactgcggataaaccggcaccgatttctaaacgtgaagcggatcgtattttaaatcgtgttcaagaaacggcggaaaaaccacgtcatcgtaacgaatatcaaccgggtgaaaacgttcgcgtaactgaaggtccgtttgcagactttaccggtacggttgaagaagtggattacgaaaaaggtcgcttaaaagtgtctgtatctatcttcggacgtgcaacaccggttgaacttgagttcggccaggtagaaaaacaatcgtaattgtttttgtacagaatctagctgaaagcaagcggtttgtttttacgtaatttttgcaaaaaaatttaaaaaaatgaccgcttgtttcattctgtactgtatcttttatggtacgtatgaatttttcagcaataaaattttattattccaaatagttttgcttgaaaaatgatcgcaatttatttagaataatcagtctatacgagttggcttgctaactcgttttttgtgtaacaggggagccgattttcggcgttattacccacttagaggaaacttaaaaatggcaaaaaaagtccaagcatacgttaagttgcaagttgcagctggtatggctaacccttcaccaccagttggtcctgcattaggtcaacaaggtgttaacatcatggaattctgtaaagcattcaacgctcgtactgagagcttagaaaaaggtttaccaatccctgttgttatcacagtttacgcagaccgttcattcactttcgtaactaaaactccaccggcagcagtattacttaaaaaagctgtaggtatcaaatctggttcaggtaaaccgaacaaagataaagtgggtacagtaactcaagagcaattacgtcaaatcgctgaaactaaagcagctgatatgactggtgctactatcgaaactaaaatgaaatcaatcgctggtacagctcgctcaatgggcttaatcgtagaggaataatacaatggctaaattgactaaaaaaatgaaagcaattaaagctggcgtagattctactaaagcttacgaaatcaacgaagcgatcgcagttttaaaacaattcgcaacagctaaattcgttgaaagcgtagacgtagcggtgaacttaggtatcgaccctcgtaaatcagaccaaaacgtacgtggtgcaacagtattaccacacggtacaggtcgtacagctcgcgtagcagtattcacacaaggcgcgaacgcagaagcagctaaagcagcaggtgctgatttagtaggtatggaagatttagcagagcaaatcaagaaaggcgaaatgaactttgatgttgttatcgcttctccagatgcaatgcgtgttgtaggtcaattaggtcaagtattaggtccacgcggcttaatgccaaacccgaaagttggtactgtaactccaaacgttgctgaagcagttaaaaatgctaaatcaggtcagatccgttaccgtaacgacaaaaatggtattatccatacaacgatcggtaaagcagacttcgcacctgaacaattaaaagataacttagttgcgttattagcggcgttaaacaaagctaaaccaacaacagctaaaggtatcttcatcaagaaagtaagcatctctacaactatgggtgctggtgttgctgttgatcaagcatcactttaatttttgattaaaataaagaccgtatagggtaaaatctatgcggtctttttttcgttttaaggaaaataatgctaaaattttggattgtaatctttacactatttttgaccgcttgtacgagtctgccctcagttaaaacattaccgactcaaacgaaaaatattcggctatttaaagtagaaagtagggggcaagcaaatttattatcagtacagtttgaagccaaccaatggcgttgggtacaaactgacccgctaggttcgcctaaagcgagagtagtattagataaaaatggctggaaaaatgatggatttatcatgccgaatcagcaagctaaacagctttttacggcgattgcagttgcacttaatcctaataatccgccctttgagctaaataaaaactggcggattgagcaaaatggtatgcattttaatattatgcttcctgatggctcggaatggaaagtggatgaactataataactaaatacggatagaaagaaggacatgatgaaattattcttatctcgccctgcaatgataagtgccttaggagatgacctcaatactcacttagatgtgttgcttaacaataaaccatcacctcttgcagctacagatataccttattctgcgcatggtattattggtcaagagaaaatgctgggcgaagtaaaggagacactacgtgaatttcctgttgatttacctgcagaacatcgcagccgcaataatcaactgttatggcatgtattggcacaaatcgaaccgcaaattgagcaagtaattactcgcttcggtaagcaacgtgttgcggtggttatgggaacttcaaccaccggcgtagatgagaatattccagttttccaatatgcagcggaacataacgattggtccggtaaaccattctggcagcagcaacaatatttttccgctccagcagactttgttgcctaccaatatggtgtgcaaagtgcgagttatggcatctcaaccgcttgtacttcaggagcaagagcattgatttctgcggctcgcttattaaaagccaatctttgtgatgcggtgatttgtggtggcgtagatacgttatctccattgaccattagcggttttagctcattggaggtcctttcggatcagcgcaccaatccgctttctgctaatcgtaatggcattaatatcggtgaagcggctacggcatttattatgaccagagaagccattgatgaacatcgaattgagctacttggctatggtgcaagtagtgatgcttatcatatgtctagcccacatcctgaaggtattggtgcgatttctgcttttgaaaatgcgttaaaatcagccgcacttttagcaaatcaaataggctggattaacttgcatggcacggggacggtacataatgatcaaatggaaacgcttgcggttgcaaaagtttttggaaatcataccgcttgtaccacaactaagccttacaccggacacacgcttggtgcagcaggtgcattagaagctgccattttatgggcggtgattagccgaacctataacccgcaaggtattttacctccacaactttgggacggtatgcgagatgaaagtttgcctgaaattctcattaccgatgaacatagccgctggctaccaggcagacgccttggtgcgagcagttccttcgcatttggcggcaataatgcagtgctgattttaggagaaagtgaataatggactttacactgccgattgaaaatgttgcgccattagtgccacaaagtggtgagatggtactcatcgatcgtgttaccgactttggtgaagacttcttaactggcgaagcagaaattcgctcaaaccatatcttactcaaagcgggaaaactgcaaacttttgctggcattgaaattatggcacaggggattgccgcgtgggcgggaattcaagcgagaaaacgcaacgaaccggtaagattaggttacttgttaggcacgagaaagctttatattacgcaacctgagattgcagttggtagtcaattaatgattgaaattaaaatgtctattcaagatgcaacgggttttggtgtctttgattgtcgtcttatcgacaaagtaactcatcaaacattactgtcaggcgcattaaatgtgttcagcccaaaagacggcaaaattcagaaataaagttgatacgataaatttaacatagtggtgggtcctgtgcccgctcgaatagaaacagaattttatgggcgggcacaggacccacccctacggaaatagaaatgtcagataaaacagtccttattactggttcaagccgtggcattggtaaagcgattgcattgaaattagcacagtcaggttttgatattgtggtgcattgtcgttcacgtattgaggaagcagaagctgtggcggaggcagtgcaaaagtgcggtcaaaatgcacgaattttacaattcgatgtgagtaatcgtgaagaatgccgagcaaaattggaagcggatgttgaagcaaacggagcttactacggtgtggtattaaacgcaggtttaacccgtgataatgcgttcccagcattaagtgatgatgattgggatagcgtacttcgcaccaatttagacggtttttataatgtccttcatcctgtgatgatgccaatgatccgccgtcgcaaagcgggacgaattgtttgtattacttctgtgtctggtattatcggcaaccgtggacaagtaaactacagcgcctcaaaggcgggtttaatcggtgcggcaaaagcgttagctgtggaattagcgaaacgcaaaattaccgtaaactgcgtggctccaggcttaattgacacagaaattttggatgaaaatctaccgcttgaacaaattctcaaagcgatcccaatggagcgaatgggcaacccagaggaagttgcgcacactgtagatttcctaatggacgaaaaagcgtcttacatcacccgccaagtgattggggtgaatggtggattgtgttagaaacgaaataatgtgaattgtagggatgggtcctgtgcccgtccgaaaaaatggaaatattatgcaaacaaaacgagtagttatcaccggcattggtgcagtcaccgcttttgggcgaacctggtctgaaatcaaagcggcttttcagcgcaaagaaaatgccgtgcagaatatggggtggcgggataaatatcctgaattggaagctcaattaggtgcacctgtgccaaattatgcaccaccaagtcattggaatcgtaagcaacttcgcagtatggggcgtgtttcacagttatgtgtagatgctgccgaacaggctttaacaaatgcaggtttgctaaaagatggagaaatttcaccgcttgttcttaatggcaacatgggggttgcaagtggttctagcactggttcaaccgcagatgtgcgagatatggcagagctgttgatgactggtaagtcagacactttcaacgccagcacctatgttcgagcgatgcctcacaccacagcggcaaatatcggtattttcttcgggttgcaagggcgaattattcccacttcaagtgcttgctcgtcaggttcacagggcattggctatgcttatgaagcaattaaatacggcatgattccaatgatgttagcaggtggtggggaagagttttgtccgtctgaagtatatgttttcgacagcctttatgcggcaagtcgtaacaacaataatccgaaaggcacgccacgtccttatgataaagagcgtgatggtttagtcattggcgaaggggcgggtattttcgtattagaagaactagaacacgctctagcacgtggtgcaaacattattgcagaggtagtgggttacggtgcaaatagcgatggtagccatgtgactcagccacaagctagtacgatgcaacgctgtatggaaatcgccttaaaagacgcaggtattgagccttcacaaatcggctatgtaaacggacacggcacagcaacagaaaaaggcgacattgctgaaacccaagctacctcagccgtatttggcacccgagtagcgattagctcgcaaaaaagttaccttgggcatacgcttggtgcgtgtggtgcattagaaagttggttcagcattgaaatgatgcgagacggttggtttgccccaacgctcaatctggaaaatgtggacgaacgctgtggcgatttagattatattcgtggcgatggcaaaaccattcaaaccgattatgtgatgaacaacaactttgcttttggtggagtgaatacttcccttatttttaaacgttggacagggtgctaatgacgaaaaaaattcttttagtcagttattcgcaaacagggcaacttactcgcttggcggaaagttttgtaaaaccattgcaaaatcaaccgtacttttccgttgaacattgccaacttcaaccgcaaaccgcttacggctttccgtggcggtttctgccgttttttaatacctttcctgaaacggtacatttacaaccagcccccattcagccagtacaatttgccagtgaaaagtacgacttagtcatcatcgcttacacggtctggtttctctcgccaagccaaccgattaccgcttttttacaatcggattcggcgaaaaaaattctgcaagacacccctgtgatcacgctgattggttgccgtaatatgtggctacaagctcaagataaaatgaaaagactactcgctgattgcggggcaaatttggttggtaacgtagtgaaagtcgatcaatcaaacgactgggcaagttttattaccacgccactttggatgctgacgggcaagaaaaaagtggggaatttaccgagtgcagggattgcggaaagtgaaatccaagatgcttctcgctttggtgaaaaacttttgcaaacttttaatgaaaatcgaccgcttgatcagaccattttccaaggaatgggtgcagtgaaaattgatgaaaaattgatgatgagcgaaaaagtgggggcaagaagtttccatatttggggcaaattgctgataaagtgcagtcaaatttccccaagtttacgcaagtttattttatgtttttatattgtgtttctagtggcaatgattttaacggttgtaccaatttcagcagtgataaaacgtttacttaaaccattgttacaaaagaaattggatgagcagaaaaaatattatgcgcaaccttctggagaataatacgtaggggcaggtcctgtgcctgcccgaaagatatttgataaaacggacgggcacagaacccgtccctacaatgaattcgaataaaatgcaaaacgtctatatcaataaaatttctgctttcttacctaatgctcccgtttcaaacgatgaaatggagactgtacttggtatggtgggggaaacaccgtctcgagtgcgtaaaatgatcctacgttctaatggtattcagcaacgttattatgcgattgctccgaaaactcgccaagcgacacacactagcactgaacttgcggtgcaagcggtcaaaaatttaggaatttctgcaaatgcgtttaccagtcttgcggtaggtacgtcttacccagaccaaattttaccgggacaaggcgtgatggtacacggcttgcttgaaaatgcgccgccgatggaagtgatgtcgatgtcgggtgtatgtgcggctggaatggcggcaatgaaacacgctttcaatgcggttcgcactggcgagcatcaatgtgcggtggcggtagcgtctgaatgtgcctctgcgattatgcgtagcgaaaatttcaaggcggaagcagacagcaaattacttgaaaatgcgagaccagaaatcggttttgaaaaagatttcttgcgttggatgttatcggacggtgcaggggcggtggcactttccaatcaaccgaatgaaaaagggttaagttttaaaatcgactggatcgaactggtttctttcgccaatgaaatgcctgtgtgtatgtacgcaggtggcgatgtgcaagatggtaaatttgtgagctggaaatcggtttcgcaagcggagcgtgacgcacaaagttttatggcaattaagcaagatgtgaaattgctgaatgaaaatatcgtgcgttgcaccgtagaaaatgcacttaagcgattgatttcaaaatataatttgcaagcggaaaatattgactatttcttaccgcactattcgtcaggtttcttccgtgatcgcttgctagacggcttacgcaatatcaattttgaaattccgcaagaaaaatggttcaccaacttgacttattgcggtaacacaggttcggcttcgatttacattattttggaagaattttcccgcactttcccacttaaatcagggcagaaggtgctgtgctatgtgccggagagtggacgattttcaagttgttttatgttgttagaagtgataacgaaataaatgatttgtaggggcgtgtcctgtgcccgcccgaatatcaacgagagtttacgggcgggcacaggacccgcccctacgagcaatatatggaaattgaagacattccccaagacgacagcaaaattttccaagggcaacgtaaagtgatttacgctacccgcaacggaaaatttgaagcaggtactagcacaggctggcaagcggaagagtttgccaccgaacaagccgtggacgaactcaaccaactcaccgaacaagctctacaagcggtcaaaaacggtgaaaaatcggttatttactacctaatgtacaaaaaccgctacgatctccaaactctcgcccaagccacaggcttttggcaatggcagattagacgacattttagaccggagatttttgcgaagttgagtgagaggaagttggaagtgtatgcgagggggtttgggataaatgttgataagttgaaaggaattatatgacagaatctgagttacaagaattgaagaataaaatatctttaattttgaaagatatatctaatctatcagaatcggaatatcaggctatagagcaggaaaagatgattagaacttcgaatgaaacagaactaaagccatattatcttattttccttctttttgtgagctttctaggttatggatattcaggaaaagaagagaaagttagtttcacgataccgataaaatacaaaggtagtatttttttattacaacatcgaaaactaggaatggctcttctttcttttagtggtgtatctaaacgtgatagtttaaatgttgtaaaagtaattaataaagcaataaataaagcgaaacctttttttgattattatgcaaatgaagcttctaacgcaaatgatttaaatgttatcaataatagtattccattttttgatagattgtgtttccaattagaattatataagcaaaaagtaaaagaaatagatgtatttattatgagtcatcagagtgatacaggtgatatagatgtattagcagattttgtaagtcgttggaatcaagaaaatacactacaaagagaaaaaaattggctagcaatttctgtaatagatgcatttttcagttttacagagcatgtgtttattcattcggctattttgcaagggaaattacaaactaaacaggaaattgctcaattaacagtaagtgaatggaaggataaattcaaaagatgcatagatatatcagttcctaagaatagagatttttacgataaattaagtttactaaaagatcaaattcgtaatcatttaactcatggcgcctttggtaaaaataatgaagcatttcaaattcattctccagtgggtgctataccaatgttgatatcacctacaacatctatgttttctgttggcgaaaatttaaagtttacagatgaagaagctatcaaaattatagaagaatttattgaatattattggggtagtaaaaattttatagagaatatttatatacaaagtggactacctgcagttttgacttttgctctagatagtacatataaaagggctatggtttctttagatgaaatggaaaatttcacacattatttatctgaagaattttgtaattcaatgaatatggattggtaatgaaccatttttcccatcaacacaccgcccactgcgaaagcggtgtgatgtcaactttattaaaatcgcacggggcggagctgaacgaggcgatggtctttggtttggcgtccgctttgacgtttgtttatctgccgattattaaggtcagcggaatgcctttgatttcttaccgtatgcaaccgaagcacatcatcaaaaaggtatcgaaattgctgaaagtgcggttgaaaatgcagaagttttctaacgaaacggcaggacaaatggcattagatcaggcgttgcaaaatggcaaattagtcggtttgcagacatcggttttttggctgccttattttccgtctgaaatgcgttttcattttaatgcccataatttacttgtttatggtaaggaaaacgatgattatttaatcagcgatcctgtatttgaaacggtgcaacgctgtgccgctcaagacctgcaaaaagcccgttttgctaaaggcgcattggcggcaaaagggctgatgtattatttcgagcaaacgcctgatttttcgcaaattgacttgcctacgttagttcgcaaagctattcgcaaacaagcaaaacaaatgcttgcaccactgttttttgtcggtgtgaaaggcattcgcactgtagcgaaatctattgaaaatctcgctgcttgcaaaaaaggcgaaaaatataaccgcttgtatctcgggcatatcgtgagaatgcaagaagaaatcggcacaggcggtgcaggtttccgctatttatatgcttatttcttagaacaagccgctgaaatttgcaacgaacccaaattcaaacaggcttccgaacagatgaccgaaatcggcgacctctggcgagaatttgctattctttgcgttaagcaatgccgtaagccgagtgtggaaggatataaggaaacggcggcgtttttgagaaggatctcagagagggaagaaaaattatggagaatgttgaaataattgtaggggcgggtcctgtgcccgcccgaaataattgccgaaacagatatgaataaacaacatttaccacgtcgtaaaactatccgtttacaacattatgattattccgaaaatggattatatttcatcactatttgcgttcaagatcgtttatgtttattcggcaagattttgaatgagaaaatggaattaaaccctgctggtaaaatggttgagacttgttatttggagttggaacaatatttccctacagtaaaatgtttggattatgtgattatgcctaatcatatccattttattcttcagcttgaaaatgctatacatctacctcgttattcattatttgatgtgattcaacgttttaaatctcgaacgaatgttgaatatattaaaaatgtgaaacaaaagaattggcagccttttaataagaggttatggcaacgtagttattatgaacatattgtgcgagatgaaaaagattatttgataattgcggaatatattgagcataacccgttacattgggcgttggataaattgtatatagcagaataatttcgggcgggcacaggacccgcccctacggaagattaatgattgaaataaataacctaaaccaccaataccccaacgctcaaacacaggcgttatgcaatgtgaatttacacatcccccaaggctctgccattggtttactcggtccaaatggggcgggtaaaacgaccttgatgtcgttactcgctggcttgcagtcggtacagcaaggcgagattttgtttgagggcgtgccgtttgagaaattgtcgaaacagcaacgtcatcaaatctcgttagtaccgcaggattttgcgttttatccgttgttgacggtgtgggaaaatctgaaattcttcgccgcactttatgaaatttctgataaaaattggctgttggagttgttggaaaaaacggggctaacgatacataaatccaaattggcaaagcacctttcgggtggcttgaaacgccgtttaaattttgcgattggtttgattaatcgcccgaaagtgatttttttggatgaaatcacggtggggattgatccgcaatctcgtcagtttattctcaatagcgtggcagaattaaccaagcaaggggtaacggtgatttatacatcgcattacttgcaagaaattgagcaactttgttcacagttagtgctgttaaatgaagggaaattgatttatcaaggtgatttgcaagaaattatcggtaatcaaccgcttgagaaattttatttggattttttagataagcaggtaggaacaaggtgctaattgcttcgatttttaaagaacttcgcttattaagtcgtgatctgcacggtgtggcagtgctgtttattatgccaattttgtttatgttgattatgtcggcagcactaagtaatgagaatgaacttagccaagatgcgccgatagttttattagctgagccaaacaatccgttaaatgaagcattttttcagaaattgaaagcggaaaagcttaatattcaacaggcagatattgcggagttggcaaggtatcaagctgcattacaagcgggcgaatttgagctattaattgcaaattctaatcaaaaatcgaccgcactttcagatgaaaaaacgttagcgttgtggcttaacccaagtgttgatcgtggttggctattaggcgtgaaaggtgtattacaaaaacattacacccaattgcgtttagatcaatatatggcggacaataagattacgctaaaaaataataaacagaagcaaatcaaagcgatagagaaaaaggttaatcaggatttagataaaaaattcgctcaaattaatgattatctggctaaagatttatggcaagaaatctatctgaaccgccaaggtaaggaagttgcaaaacctaactcggtacaacatagtgtacctgcgtggctgattttcgggatgttttttattatgattccgctttctaatgtaatggcgatggagcgacaaaccaataccattactagactgcgaatggcgagagcttccgcatttaaactgattgtagcgaagttgattccttatttcttgatcaatcaatgccaatttatcggtatggtggcattaggctattttgttttgcctcgccttgaaatgcctgctttttcactgattggcgagtggtggcactatgcggtattagcgatggcagttagcctgtctgcgcttggttatgggctatttattagtgtagtggctcgcacaactgagcatgccgtggtgttaggcggtggcggtattatcattatggcggcgattggcggtattatggtgccaacctatgtcatgccggaaattatgcaaactatcgccgagttttcgccaatgggctgggcgttaagcggcttccaaaatctgttgttgaaccaatatgaattaccgcaaattgcaaattatttggcaaaattgatcgcttttggtgttgtgatgatcgggcttgccgccttgatttatcagcgacaattaagaacgcaggcaagattttaatgtggtacatactatgaaatatacatttaccttagaacctaatttacttgaattagaactgaaaaaattaatcgtaaacgaatccgaaaaagacgagtttgagtcgcaagatattgcggataacgagccactttttggtgagcaaagtcgtatccagttagattcgctcgatgctttgcaaattgcagtggcgttgcaagcgcattttaaagtacgtttgcaaggtgatcgtatggtgcgtaagcatatgatgaatgttgccgatttagctaaatttattcgggattcacatcaataatggcggtttatatcaatgcaagcggtcgaatttctgcaaaaaattgcaaaaaacgaaccgcactacaattagggcaatcaattgaattgccctatttttcggcttttgattctgtattattaagtttgccggcactctatgtgttacttgaacagcaattagagcaatgtctgtcaagtgcaggctgggcaatctctgaattagctgaaataccaattttactaggttcaacagcctatacgattgctgattgcgaatatcgctttgctactcatcaagcgttagccagtgaaccgaacatcacgataattggtgattatctccaacaaaaatatggagcaaaagtctttaactttgctacctcttgcacctcttctgcgcaggcgattggttatgcggcaaaaatgattgaacaaggcaaatgccagaaggtgcttgtactaggttttgaaatgtttaatcgtttaacctttgagcattttcaggcgatgggtttgctggcacaaagtgcagcagaaaaaggcattattttaggcgaaggtattggttgtgtagcattgagcaatcaggagtccgactgccgaattttagctgttgcaagcctgactgatcatttcagcttaaccaataatagcgagcaaagtttagtgcgcttaattgacaaagtgttacaaaaatccgaccgcttgccagcagaaatcaatgcaattaaaccacattttgtcggaggagactttgatgaaattgagcaagcgattttgcaaaaaattgtgccaaatcgaccgcacttcctccctaaaaaagagctggggcatacgctaggcgcaagtggtgcattggaaacggcatggctgttagaacagttgcaaaaaaatactgaaaatagaccgcttatcgtgttgaattatttccttggttttggtggcagtaacattgggtggatattgcaatggaagtaatcgcagaatttcaagtaacggaacaattggatgataaaaccttgcgtcaacgcttgaaagaattgggcgtagatgctcgtcgcttaagccgctttacacaattggctttgctcggtgctttaaacttacgtgaatttgtaaatggagaaagtgcggtttatttaggctcgaatttcaattcaccgagtaaattctacaaaatgttcaataatttattacaagaacatttaccaagcccgttggattttatggcaaatatcaataatgctgcggtttttcaaattgcgcaaagtttagatttacaaggtgcagggatttttcttgcactggaaaaacatgaaatggctaaattattcgatctggccgaattagatcttgcaccaaaccaaactgccctgattggttgggtgtttgaacaccctcaacaacatcagcaagatgaaagttgttggtgggtggtgagagggctataagcattttggcttatattggtagaaggtcagatttcgtgtagaataaaagagttatagttacattaaaaggaacaacttatgaaaacattatggaaattaattgggattttatctatatcagtcttcttaggagcttgtagctcgatgacgttagatagtaacttaaagcaagatgtgaaggaacagtatacgacttacaagattgttaatgtgtcttctaatgaaacgatttcgcctgaagttgccactatattcgaaaataacttaaggacgcaattacaaaaatatggctacaaagaaggcaatgatgttgtggtaagttatgatattaaagcttttgatgaaggcaatcgggcattaagaatgtttattgggttcggtgcaggtaaaggtacgttatctgttataacgacattaaaagataaaaacggtgtttacttgggttctgtcaatacggaaactacgttaagaatgggatttttcggtggtagcttaaatagcattattgcttcaacagcgaaaaagaccgcagctcaaattagaaaatcgcgaattattaatgctcattaattaaggaatatttatgaaaaagctaatgttaggtgcattatctctattggttgtcaccgcttgtactaataatttcccaacaacggatacagtagaaaaacgtgcagatttaacaaaattatgtattaaagaatcatcaaatccacgtttagcatcttttgtaccaagccttgtaaaaagcttaaaagctaaaggtattgaaagtgaagttcatattaatactgtccctcatgattcgtgtaaatatatgcttagctatgcactaaatgaacgccgtaatttagtattacgcgccacagtaagagtgagcgaattagatggttcggattatgatgaaattggtgaggttgtttataaacaacgtagcaaagaagaacaatccgcatcaaaatcgaatggtgttcaaggtcagacagaccgtattgttgctgagctgttcaaacattattaatttactatgacagaccattgtgaatttacatttaatatttcagcatggaatgttgtagctaataaacaactttccattgctgattggcaactaggtgaggcgcattgggttaaaaatgcaaaaaattgggaaaattttacccctaaattagcgtttttgccggcaattaaacgtcgtcgtttaagtgattcagctcggcttttctttgaggctgcttgggagctattaccgtcggaacaggcaaatattccggttgtatatgcttcaaacaatagtgaaattaaccgtagttttggtttgtggcatacgctattacaagatggtgatgtttcacctacctcatttagtttatcggtacataatgcattagtcggacaatggtctgaatttcgtcaagtgacggctgagaccatatctattaccgcttcgcaagacaacttagagtccgctttgttagaagcttatttgctcttgaatgacggagcagaccgtgtgctcgttgttgtggcggaaagcccattattagaaaactataatgcacagccgattgaacgtcagccttttgcatatgcgctagcattggtagtcacaaaaggtgagcaatatcagctgagtttggttgtaaaagatagcgtgaatacgaccgcttgtttagcaaaagataatgctttaacgtgggttcaaaaccattatgcgaatagtgtgcaatggcaaactaaaagtacaaatggaaaggtatggcaatggcgaaaaaattagactggctgcgtcgattcttagggacgatgttgggttttgtgttatttggcgtattaggaatcagttatagaattattctttctccttatgttaaatacgtgaaaaacggtgatctgtctcatgttttgcaagctcgccgttcagtggggaaaatttgggcattctttgtcaaatatctagttgccgtcggtgttcttgaagtggaatatcatggtttcgaacgacttggacgtaaaggtcaattaatggttgctaatcatccttctctattggacgtggtgttaatcttttcaaaagaaaaccgtttaaactgtatcgtaaaaaaagatttgcttgataatccggtcatggttgatcctattattgcatgtggttttttgcctaattccgaaagtgaagaagtattagaaaaaagccatcagattttacaagaagagtcgttattgcttttccctgaaggtactagaacaggttgggatggtgtagttaatttgcatagaggtgccgtatctatcggcttacgtagcgcagaagtaattactccgattataattaaaatgtctccgccgaatttaaaaaaaggtcaaccttggtataaggttccttctcagaaaattcgttatcaattaacggttgccgaagatattgatccgaaagcgttattagcggaaaagccattacctattgcttctcgtcgattgaaaaaacaattagaagatttatttaattcacatactcatacaatttaaggacagaaaatggaacttgaactgcaattaaaacaattaattatcgatagccttggtcttgaagatatgagcgtagaggatattgaaacggatgctccacttttcggtgatgatgggttgggtttagattcagtagacgcacttgaacttggtttagcggtacaaaaaacttttggattacaactagatagcgaaaagcagaatttacgtaatcactttgaaagtgttgcgacattagcaacatttattcgttcgattaaggggtaaataatgactgaacaagaaattcaaacattattggtaaatgcgttggaaactttgtttgaagttgatccgaagagcattacgccggaaacaaacttatatgaagatttagaaatcgatagtattgatgcgattgacttaattgatcatattaaacgtgaaacaggacacaaattacaagccgaagattttcgtaatgttcgtactgttgccgatgtggtgcaggcagtcgtgaaaatcagccaaaaaggcgaagaatagtatttatctcttcacgaatgaattactcatcaacagagcttattgctcaatatcctacttggtattataccgattttgaacagcgtgtttggcaaattgcgacagcgcttcaacagcaacaaattcatacagttgcactttggtttgaagatggagcaaaattagcctgcacgctgttagcttgttggcatgccaatgtacgcaccttattccttcctaactttactgaagaaagtatcgcttgggcaaatcagctggcagatatttggcttgctgatgtaccggttcatctctcgaatgctaaatattttgatgagtttgctaatcagcttgaattgcaaaaaagtgagaaaaagcgaccgcttgctgactttattgccgatactcaacttttgatgaaaacctctggcagtaccggtcagcctaaaacgattataaaaacggccggtcagctatggaaaaatgcccaagtctgtgcacaagcatttggatttgaatctggtaatcaaattacggccgtttgtaccgtgagtattcaacatttatatgggttaatttgtcaaattatgatgccgttggtattaggttggcagattgggcgtaaacaacagttctttcctgaaaatgtggctcaagtttgtcgtcaaacgaaaaaaacagtgctgattagtagccctacaatgttggcaagtattgattggcagcgtttatcttttcccacgcttagcgaaattgtttcagcaggaggtatactgccttcaggtgtggcagagatgatttttaattcgacaggttttcatgttactgacttctatgggaccactgaagcgggagcaatagcgtttaagcaagattcttctctttggcagccaatgccaactgcaaaagtcgggattgatgagcgttctacgctatggattgaagccgattggttagaagggcgcgagcagtgtgaggatgtagttgaattttcaaatcaacaatttgctattttagggcgtattgatcgcattattaagttgggtgacaagcgaatttcattagcaagcgtcgagcaaaatttacaacagcatatggcggtttcggactgttatattggtaaacatcctttgcaaaatcgtttagttgcttgggtcgcgctttcttcgcaagggatacagttatacaaacagaatcgaaaaatattggttgcaactttaaagcagcatttatcaataacacaagaaaaagttgccttgcctcgtttttggcgatttaccgataaactgccacgtaatagccaatcaaaaatcagcaaaatggcgtttgaacaaatttgtacagcagaacagcttgatcaatttggagtgttatgcgggtagtcaatattgtaactcgttgtttattgagcgtatttagcatcgcttatccgttattatggtggttatcaccagagatggattggttaacttatatgccgtttggccttgcattcttatggttttttcaagggatgcaagcggtcggttttcagcgtttttttgcattttttatgtctatcatgttgggggtggtcggtataagtcgaggcttagattggatgtattggtatccagttgcgatcaacgtttttatgttaataatttttggcggtagtttgtgggcgaagcaaaccattattgaaaaattcgctcgcttacaagatcctgatttacctgctgaggcaatagcttatacccgcaaagtaacccaagtttggtgtgcgatttttatcttcaatattgtagtaactgtatctctgatttattttaatcgacttgatgcctgggcgctttataccggtgtgattgcctatattattatggcaatcgtcatggtgggagaatggctgattcgtccgaaacataacagaacattttaattttatgaacaaaaatcctattgcattaaatcctatttggctcagtgatgattttttccagcgagtaacacaaatttcacagcaattccaacaagataatgtgaggtctgttggcttatggttagaagatgccgcccaatttgcttgcgtcttattagcttgtttccgtgccgatgtgaaggtgttattgccccctaacttgttggacgaaaatcagatctggctacaacaaaatgccgatttcctatttgatggcattcgtttccaaagctatgggcatttacaaaaagttgtggattttttaccgcttgtagattggcaatgccagacagaagtttggttaaaaacctcaggcagcagtggtgaggcaaagattttaaagaaaaccgcttcacttttatggcaagaggcaattgaggtcggcaagtttttacctttccaacaaaatggtacccatacaatcggtagtgtaagcgttcagcatttttatggtttgacgtatcgagttttgattccactttggcatttcttggaaggacgagcatggacaataggtcgtgagcaattagtttatcccgaatatttattggcggaaagtaagcagagttcgcagtgtttatggatcacgagtccagctttactttctcgtttaaatttggcattacctcatttagcggaacaacatgttgttggagttatttcgtccggtggtgcgttagacgagcaacttgccgaacaagttcagacggcaatgcgttgtcccgtattagagggctatggcagtacggaaacaggttgtatcgcttttcgtcagccttatcagcactggaagcctttgcaagatgtacatttaggtacaaatgagcagcaagcgttatgggttgaatctagccgtacgcaagggagagagcaaacagcagatgccgtggaattttttggtgatggatttgaattattaggacgtctagatcgcattgttaaattgggtgataaaagagtgtcattagtgaaaattgaacaggatttattaaagcactcatgggttgctgatgcttatgtcgcacaacaccctgagaaacagcgagcggtagcatggttggcattgagtgatgagggcattgattgtttacgtgagaatggccgtaaatatttgacggatcatttgaaacaaacacttgctatgacacaagaaaaatttgctttaccacgttattggcgtttaaccgacaagttacctcgcaatgctcaatctaaaatcttgcgccaagatttcgagtctgtttgtcaacacaatgtttgtgatccaatctggttgcatacgattgaacaagacaattctcttgaattaataggaaaagtgccactagatttgcattattttaaagggcatttcgcaaattttccgttggtaccgggagtaattgagttgcaatgggtaatagaacaactccctcgcttattacagagagaaattgaaattgagcgagtggataatttgaaattccaacagtttttacgtccgcatgatgacgtacatttaacacttaattgggatgttgtaaaacagcgggtaaaatttcagttgaaaggtaacggtgagatttgtgcaagcggtctaattatcgagaaaaaatgcggagcatagccatggcagagaaatctaacattgttgcattaatacctcattataatcacgttaatacgattgcgaaggtcattgagcaattgctagggtttggtttgccagtattagttgtagatgacggttcgaatgatgctcagcaacaaatattgaaacagataactcaacagccaaatgtatccgtcgtattccgctcacagaacgggggaaaaggtgcggcagttaaaacagggttacaatgggcttatcagcaaggttttacgcatgcaatacaagtcgatgcggacgggcaacacaatttagctgatattgaagcaatggtggaaatatctaagcaacattcaacggcgcttatttgtggtaaaccgatttatggtattgatgcgcctaaagcacgtttgtatggacgtaaaatcactaatttctggattgcgataaataccttatcaactcagattgaagatggaatgtgcggttttcgtttgtatcctttagcgttagttgcgcctattcttactcaagaaaaactaggtaatcgaatggattttgatattgaaattcttgtacattgccagtggcgtaagataccaatgatttgggtagaaactcccgtaaaatatgatgaagatggcgtatctcattttagaggttgggatgataattggctgattagtaaaatgcatgcccgattgtttttcgggatgttgggtcgagtgtttacggggaaattttaatgacggttactcgaaagaatcagcgacactgggcgaatcagcaagagcgaggaacccatttttttctaatgctaactcgcctcattgtgcaatattgtccactttggctaatccgcttttttactttttgggtcgtgttgtatttttatttaacctcaagtaaaactcgccgatatattgcagaatatcagcaaaatctgaccgcttatttccctcaagtgagattaaaaggagcgactatttttcgtcaatttcttgcctttggagaggctattacagaccgatttgccgtttggcaacatcaaatacattatgcggatttagtgattgatgatagcgaaaatctctatgcagagattgatgctggcggaagagggcaaatattaatttgttctcatttcggtaatattgaaatttgtcgagctttacttaataacggccatcatccgaattttaaactcaacgcactggttcatagcaaacatgctgaagcgtttaaccaagcattagttgatgcaggagcagatgaattacctctgattcaggtagaagatttagatgcgcacataatgttggagttgagtgagcggattgagcgtggcgaatggatcgctatcgcagctgatcgtgtgcctgtaagaggtgataagacccaaacagttaattttttaggtaagttggctgaatttccagaaggagcatggttattagcgagtttgttgaaagcaccgattaatacgatttttagtttaaaagaaaatggcaaatattgtttgaagcttcggcatttttcttcgcctattaaaggaagaggaaagatccgtcagcagcagattcaacaagctatgcaagattatgcagatttattagcgaatgaatgtgcaaaaaatccatatttatggtttaatttttatgatttttggcaacaaaaatagtgtatgcagtatggattcatataggagaacaacatgaaattagtgaaagtagcaggtgtagtaagtaccgcattaattatggcagcgtgtgcccctcgtaatacaacacattactattctattcaggaagcgttaaattcaccgcaagcaaaagaagtgcttgatccaagtgtaaaactttatttcggaaaagcggctcctgggaaggttattcgtaaggggatcacgaccaatccaaaaacaaacgcgcttaataaaagtgatttagaagcgtgccaatgggcgttcttgtccgcagttaaaaaattccaggaacgagcaaagaaagaaggtgcgactaaagtaggtaatttagtgagttattataagaagaatgagtataaaagtacctcacaatttgaatgtcatgcgggacgcagtattgcaggcgtagcgttaaaaggcgacattgtgaaataatttttgtaaaatgtgcggcaattgaccgcacttttttatatctatgagaatgaaaaaacatatttattgtaagcatcaatccgagtatgagatccagttctttgatgtagattcaatgaacattatgtggcatggacattatgtgaaatatctggaaatggctcgttgtgcctttttggaagaaattaattatacctatgatgttatgcgtcaaaatggttttgcctatccgatcgtggcactggatttaaaatatgtcaaaccggcactctttcgccaaagaattagagtggaacttgcattaattgaatatgaaagttgtattcgttttgattatattattgttgatgcgctaacgggcgaaaagttaacgaaaggctcaacgacacaaatggcaatagagattgagagtcgagaaacacaatttgaaacaccgttatcatggcgaaatgctgtgcaaaattttgagggttttcgaccgcttgtgggggaatgttaatgaaaaaatatctacttttatttttacttttctttagtccactttcatggggcttttctcaaactgagctgattcaacaattacaaaaacctcaatctatacaaggtaattttatccagcaacgctttttaaaatcgctagctaaaccgatagtcgcaacaggaaaattcaccttagtggcacaaaaagggttgctctggcatatggagaaaccttttatgagtcaaatgaaagttacctctcaagggatctctcaatggaatggttcaacttgggtggctaattcgagtatggggcaagcagagcaaatccaattatttttagggttgcttagcggagatatatctgcattatcaagccaatttgatttaagtcttaccggaactgcttcaaattggcagttatcgctcaaaccaagcagtttattgatgcaacaaattttcgaaaaaattactcttgaaggcagtaatattgtgagttcgatcgaattgaaagaaaaacaaggtgatcgaacagttattaagtttagcaaacatcagctgaaccagccgctcgcagaaagtattttatcagccctacaataagtaaaatttatgcaaaaaatgaccgcttaccgcatattatatgcggtatttttattcgtgattttcacattatttggtatacagaaattagcctcatcatggtttgagagcgatttacgatcacttttgccccaaactcagcagtggtcaagtgtacagatggaagctgattatcgacaagaacagcaacttaatcgtcagatcattgcacttgtgggacatgctgatgctaagctggctttttctattgcaacagaaataagctcacagtggcaagaaagtgggctatttgagcaaatttattccaaaacagaacctaatctcgcccagtttaaagcagaaatccaattattaaaatgggctgtattaccaaaggaaattaagtctcaattattagacacgccacaaacttattttcaagcgtatgcggaacagattgttaatccatttaaacaaaaccaactggtttcatttgagcaagattggctgggggttgggcggtttgttataccacaagctcagcagctatctaatatgcgctggaatgcggaaaatggcatgatttttacggaaaatcagtccaaaacatgggttatgttgcgagctgagttaaagcaatctgatttattgaataccgaacaatccttaccaagtttattagcagaaaatcgccgatatgccactgcattacaagcagaattaaatgttaccggtacatcattatttgctatggttgctaaacagcaggcagaaagtgaaagcacatttatgagtagtcttggtgttagcttaacccttatcctattaatcgctgtttttcgttcttggcgagtattatcgctgtttattcctattttaattggtatgggagccggaattgccgttacggtatttttgttaggaaaaattcacttactaacacttgttatcggtaccagtttagtaggtgtgctaattgactttccgttacattggttagcctcttcattatcagttcgtaattggcaagctgaacaagcaatgaaagatcatcaattcactttctttattagtttgatggtgactttactgggttatggtctgctttggtttacggatttaccgatattaaaacaaacagctttattctctgctgtagcattggtagcggcaattatcgctacaatattgtttttaccaccaatgtttgttcgtgtagatttttctcgccggcctcgttttcctatagataatattaaattaccgatgttattaaagcataaaggtataaagatattattttgtttactcgtcatcactggtgtatttcgttcggaatggcaggatgatattcgtcagtgggttgctctgccacatgggatgttacaggaagcacaaaaaattagtgagttaactggaattgatttaggtagccaatattttcttattgttgcagataatgatgaacaattattagccaagaccgaattactgtcgcagaggcttactacgttaggtcagtctcatcaagcattgagccaatggcttagttccgagcaagaacagcaacaattcaagttgcaattgagtgcaaaaattcaaccgcttgcatatcaaccgctaattgaattgggagtggagagcgaggaaataatacaatccatccatcaattacaaagacaatcgccagtttctttacagcaagccttaaatacaaaattgggacaggggtggaaaacactctatcttggtaaattaagttcgaatcaagttgctactttaattaaaattaagcaaatgcagagtgctgaacatttatctgctttggcgaataacaaagatatcttttggcaagataaacgagcttacttaaatcaggcatttcaacagacacggaacgatgccgcttggttaaaaggcgtatcgtttttacttgcaggtttagtattatggtgtttgtttggacgaaaagcggccgttcaaatattagtacctccaatcatagcgattgtaacaacggttgcaatatttggttggcttgcattaccaatcacgttatttacgatgttcggcttgctgttggtttctgcaattggtattgattatacagcttatatgcaacactcagcagaaaatttagccacaaaaataaccgctattttgttggcggctactactacaatgatttctttttgtttattggcgtttagcgccacacctgcagtagcaagttttgggttaagtgtgagtattggtctcggcatctgcgtctgcattatttttagtcgaaaatatatattttagtgaggacaagcaaataccactttacacgtttaaaaaatcagcgtagaatttgcgacctattttgcagtattgcaaatattgatggtgcttgcctatcaagccccgtccaagaccgtaggtgaaatgatgttaatcatctcttaatttggcctacgtagatggtgaacagacagaattttctgcttctggacaccttaggctcagaagattgctacttgcgatgcaagcggtgagttttttgaggttttttgtaaattccactttggtggagtgtatcaggagctaaaaccaatggcattaaatcttcaagacaaacaagcgattgttgctgaagtaaacgaagctgccaaaggtgccctttcagctgttgttgcggattctcgtggcgtaacagttgagaaaatgactgagttacgtaaatctgctcgtgaagctggtgtaacaatgcgtgttgtacgtaatactttattacgtcgtgcggttgaaggcacagatttcgagtgcttaaaagatacgtttactggtccgactcttatcgcattctctcatgaacacccgggcgcagcagctcgtttgttcactgaatttgcgaaagcaaacaaagagtttgaacttaaaggtgcagcctttgaaggtaaagtacaagatgtagaattcttagctacattaccaacttacgaagaagcaattgcacgtttaatgggcacaatgaaagaagctgcggcaggcaaacttgttcgcactcttgcggcattacgcgacaaattacaagaagctgcataatttttagcagaaaacttcttaactcgtttaacaacttatttactttaggaattgattgtcatgtcattaactaacgaacaattaatcgaagcgatcgcttcaaaatcagtatcagaaatcgttgaattaatcgcagcgatggaagaaaaattcggtgtttcagcagcggcagcagtagcagcagctccagcagcaggcgcagcggcagcagaagagaaaactgaattcgacgtaatccttgctaacgcaggtgcaaacaaagttgctgtaatcaaagcagtacgtggtgcaactggcttaggcttaaaagaagctaaagacttagttgaatctgcaccagcagcattaaaagaaggcatctctaaagctgaagctgatgcacttaagaaagaattagaagaagctggcgcacaagtagaaatcaaataatttttgatttaacttttccagaacttcaagttcagaaaaagccaacgagaaatcgttggctttttcgtttttattaagcggtgaaggtgcagatttattgtttagcaagagagctttcatacgaaaaaagtactttaggcgttatcattgcaaacggttaaaattttcccgttttttgcaacaggattgaccaaaattgcgaatctctgctataattaccaaccatttttgcattccggctgacggctataactccgtcagccttttgtgcttgaacgcaattgctgattttgtcattttaatcaacaaattttgcaaattccctgcccattttgaccgcttatagtagtgatttttgactgtaagttaggcaaatggaaaatgacacctcgtaaattaatgccacttccaactcgtcctgtgacagtcggattgtgtaatcttaaccaaaaaaatcagaaggctatctaacaatggcatactcatattccgagaaaaagcgtattcgtaagagctttggtaagcgtccacaggttcttaacgtaccttatctattaacaattcagcttgattcttttgaaaaatttattgaaagagattcagatggacaacaaggtttagaagcggcattccgttcagtgttccctattgtgagcaacaatggtgcaactgaattacaatacgtttcttacgaattaggtgagccggtatttgacgttcgtgaatgtcaaattcgtggtacaacctatgcagcgccattacgcgtaaaattacgtttagtgacttttgatcgtgaagcggcagcaggcacggtaaaagacattaaagaacaaaacgtgtatatgggcgaaatcccattaatgaccgacaacggtactttcgttatcaacggtactgagcgtgtaatcgtatctcagttacaccgtagtccgggcgtattcttcgattctgacaaaggtaaaacccactcatcaggtaaagtgctttataacgcacgtattattccttaccgtggttcttggttagactttgaatttgatccgaaagacaacctttacgcgcgtatcgaccgtcgtcgtaaattacctgcaacaatcattctacgtgcattaggttacactactgaagaaatcttaacgatgttcttcgataaaattacgttcgaaatccaagataataaacttttaatgacattggtacctgagcgtttacgtggtgaaacagcacaatttgatattgaagccaacggcaaagtttatattgaaaaaggtcgtcgtatcaccgcacgtcatatccgtactttagaaaaagacgatattaaacaaattgaagtgccggtagagtacattgtgggcaaagtagcagcgaaagattatgttgatctttcaacaggcgaattagtttgcccagcaaacatggaaatctcaatggagatgttagcgaagttatcgcaagcaggctacaaagagatcgaagtactcttcacaaacgatttagaccatggtccgtatatttcagaaacattacgtgtagatccaacttatgaccgcttaagtgcattagttgaaatttatcgtatgatgcgtccgggcgagccgccaacaaaagaagcagcggaagcgttattcgataatatgttcttctcggcagatcgttatgatttatctgcggtaggtcgtatgaaattcaaccgctcacttgatattccggaaggtgtaggttcaggtattttaagcaacgatgacatcatcggtgtaatgaaaaaactgatcgagatccgtaacggtcgcggtgaagtagacgatatcgaccacttaggtaaccgtcgtatccgttctgtaggtgaaatggcagaaaaccaattccgtattggtttagtgcgtgtggaacgtgcagtgcgtgaacgtttatcattaggtgacctagacggtattactccgcaagatttaatcaatgcgaaaccaatttctgcggcagtgaaagaattcttcggttcttcacaactttcgcaatttatggaccaaaataacccgctttcagaggttacacacaaacgtcgtatttcggcattaggtccgggcggtttaacacgtgaacgtgcaggctttgaggttcgagacgtacacccgactcactatggtcgcttatgtccaatcgaaaccccagagggtccaaacatcggtttgatcaactcactttcggtatatgcacgtactaataactacggtttcttagaaacgccattccgtaaagtagtgaacggtcaagtaaccgaagatatcgagtatttatcggcaatcgaagaaggtaactacgttatcgctcaggcgaactcaaacttagatgaagagttccgtttcactgatacatacgtaacttgtcgtggtgaacacggtgagtcaggtttatacaaaccagaagatattcactatatggatatctcaacacaacaagttgtttctgttgcggcagcgttaattccgttccttgagcacgacgatgcgaaccgtgcgttaatgggtgcgaacatgcaacgtcaggcagttcctacattacgtgcggataaacctcttgttggtaccggtatggaaaaaccaatcgcacttgactcaggtgttgcgattgtggcgaaacgtggtggtactatccaatacgttgacgcatctcgtatcgtagtgaaagtaaacgaagatgaaacgattccgggcgaagcaggtatcgacatctataacttaattaaatacacccgttcaaaccaaaatacctgtatcaaccaaattccttgtgtgaatttaggtgagccggtagcacgtggtgagatcttagcggacggtccttcaacagacttaggtgagttagcattaggtcaaaacattcgtgtggcattcatgccatggaatggttataacttcgaagactcaatgttagtttctgagcgtgtggtacaagaagaccgtttcacgacaatccacattcaagaattatcttgtgtggcacgtgataccaaacttggtgcagaagaaatcactgcggatattccaaacgtaggtgaatcagcattaagcaaacttgatgaatcaggtatcgtgtacgttggtgcggaagttaagggtggcgacatcttagtaggtaaagtaacgcctaaaggtgaaacccaattaacaccggaagaaaaacttttacgtgcaatcttcggtgagaaagcatctgacgttaaagattcttcattacgtgtaccaaacggtacttcaggtacggttattgacgttcaagtatttactcgtgatggcgttgaaaaagataaacgtgcattagaaatcgaggaaatgcagcttaaagaagcgaagaaagatttaactgaagagttagaaattttagaagccggcttattcacacgtgttcgcaacttattagttgaaggtggcgtatctgaagctgaattagataaagtttctcgtgagaaatggttagaacaaaccttagatgacgaagcgaaacaaaatcaattagaacagcttgcggaacaacacgaagaattacgtaaagagttcgaacgtaaacttgaaattaaacgcaacaagatcattcaaggtgacgatttagcaccgggcgtgttaaaagttgttaaagtttacttagcggttcgtcgtcaaatccaaccgggtgataaaatggcgggtcgtcacggtaacaaaggtgttatctcgaaaatcaacccagttgaagatatgccgtacgatgaaaacggccaaccggttgagatcgtattgaacccgctgggcgtaccttcacgtatgaacatcggtcagatcttagaaacacacttaggtttagcggcgaaaggtatcggtgatcagattaataagatgatcaaacagcaacaagaagtggctaaattacgtgaatatatccagaaagcgtacgatttaggtcacggttcacaagttgttgatttaagtacctttactgatgaagaagtaatgcgtttagcagaaaatttacgtaaaggtttaccacttgcaacaccagtatttgatggtgcgcacgaagctgaaatcaaaggcttattagaattaggcggcttaccgacttcaggtcagattacattatttgacggtcgtaccggtgagaaattcgagcgtcctgtaaccgtaggttatatgtatatgctcaaattgaaccacttagttgacgacaaaatgcacgcgcgttcaacaggttcttatagtcttgttactcagcaaccacttggtggtaaagcgcagttcggtggtcagcgtttcggtgagatggaggtttgggcattagaagcatacggtgctgcttacaccttacaagaaatgttaacggttaaatcggatgacgtaaacggtcgtacgaagatgtataaaaacatcgtagacggcacacaccaaatggaaccgggtatgccggaatcattcaacgtattgttgaaagagattcgtgccttaggtatcgatatggagttagacgaagactagtcgtcaaccttcaagcggtcaaatttagtaaaaattttgcaaaatttgaccgcttgtaaaaccagatttcctcgtttagagccctgtgttctaagcaaaactttaattcctcactaggggcaaaaagtgaaagacttagtaaagtttttaaaagcacaatcgaaatcgaatgatgattttgatgtaattaaaattggtttagcatcaccggataaaatccgttcttggtctttcggtgaagtaaaaaaaccggaaacaattaactatcgtacctttaaacctgagcgtgatggtcttttctgtgcacgtatcttcggaccggtaaaagattacgaatgtctttgtggtaaatataaacgcttaaaacaccgtggtgtaatttgtgaaaaatgtggcgttgaagtaacccaaactaaagtacgtcgtgaccgtatgggtcatatcgaacttgcgtgtccggttgcgcacatttggttcttaaaatcacttccgtcccgtatcggtttaatcttagatatgcctttacgtgatatcgaacgtgtactttatttcgaatcttatgttgttactgaaccaggtatgactgatttagaaaaaaatcagttattaaccgaagaacaatattgggaagcggaagagcgttggggcgatgagttcgaagcgaaaatgggtgcggaaggtattcaagcacttttacgtgatatggacttagagcaccaatgtgaaatgatgcgtgaagagttacaagaaactaactctgaaacaaaacgtaagaaaatcacaaaacgcttaaaattattagaagcattccaacaatccggtaacaaaccggagtggatggtaatgactgtattaccagtgcttccaccggatcttcgtccattagtaccacttgatggtggtcgttttgcgacttcagatctgaacgatttatatcgtcgtgtgatcaaccgtaacaaccgtttaaaacgcttattagatttagtagcgccggatatcatcgtacgtaacgaaaaacgtatgttacaagagtctgttgatgcgttattagataacggtcgtcgtggtcgtgcgattacaggttctaacaaacgtccattaaaatctcttgcagatatgatcaagggtaaacaaggtcgtttccgtcagaacttattaggtaaacgtgtagactattcaggtcgttcggtaattaccgtaggtccttacttacacctacaccaatgtggtttaccgaaaaaaatggcattggaattattccgtccgtttatttactctaaattagaatctcgtggtattgcttcaacaatcaaagctgcgaagaaaatggttgagcgtgaagaaccgatcgtatgggatatccttgcagaagttattcgtgaacacccaattttattaaaccgtgcgccaacacttcaccgtttgggtatccaagcgtttgaaccgttattaatcgaaggtaaagcaatccagttacacccacttgtttgtgcggcgttcaacgcggacttcgatggtgaccaaatggcggtacacgtaccattaacacttgaagcgcaattagaagctcgtgcgttaatgatgtcaactaacaacgtactttcaccggcaagtggtgacccgattatcgtaccttctcaggacgttgtattaggtctttactacatgacgcgtgagaaagtaaatgcgaaaggtgaagggatgtacttccttgacccacgtgaagcggaaaaagcataccgtaccggtcaagctgaattacacgcacgtgtaaaagttcgtattaccgaacacgtgaaaaacgaagcgggtgagttagttgcggaaactaacttagtggataccacaatcggtcgtgcaatcttatggatgatcgcaccgaaaggtatgccgtttaaagtattcaaccaaacgttaggtaaaaaagcgatttcaaaattaatcaatgaaagctaccgtcgtttaggtttaaaagaatctgtcattcttgctgaccaaatcatgtataccggtttcgcatacgctgctcgttcaggtgcgtcagttggtatcgatgatatggtaattccggcgcagaaaaatgaaattatccgcgcggcggaagcagaagttgcagagattcaagagcagtttaactcaggtcttgtaactgcaggcgaacgttataacaaagtaatcgatatttgggcggctgcaaacgaacgtgttgcaaaagcaatgatggaaaacctttcaacggaagaagtcatcaaccgtgaaggtaacccggaaaaacaagcgtcattcaacagtatctttatgatggctgactcgggtgcgcgtggttctgcagctcagattcgtcagttagcgggtatgcgtggtcttatggctcgtccggacggctcgatcatcgaaacaccgattaccgcgaacttccgtgaaggtctgaacgttcttcagtactttatttcaacccacggtgcacgtaaaggtcttgcggataccgcattaaagacagcgaactcaggttacttaacacgtcgtttagtagacgtagcacaagacttagtaatcactgaagatgactgtggtacacacgaaggtatcgtgatgactccgttaatcgaaggtggtgacgttaaagaagcattacgtgatcgtgtattaggtcgtgtggttgcagaagacgtattaaaaccaggtacggaagaagtattaattccacgtaacaccttaatcgatgagaaatggtgtgatgtgattgatgcggaatctgtagacgtaatcaaagtacgttcggtggtaacttgtaacacagacttcggtgtgtgtgcgaaatgttacggtcgtgaccttgctcgtggtcaccttatcaaccaaggtgaagcagtgggtgttattgcggcacaatcaatcggtgaaccaggtacacagttaaccatgcgtacgttccacatcggtggtgcggcttctgcggcagcaaaagaatctagcatccaagtgaaaaacgcaggtacgattaagttaactaacgctaaatttgtaactaacaaagaaggcaaaatcgtattaacttcacgtaacacagaattaaccgtaatcgacacattcggccgtaccaaagaaaactataaagtaccttacggtgcagtgctttctaaaaacgacggtgcagaagttgcagtaggtgaagtagttgcgaactgggatccgcatacaatgccggtcatctcagaggtaagcggtcgcatccaattcagcgacatcgtagatggcttaaccgttactcgtcaaaccgacgaattaaccggtttatcctctatcgtggtacaagatgtgggtgaacgtgcaacagcaggtaaagatttacgtccggcattacgtttagttgatgcgcaaggtaacgacatcttaatccctggcacagatgttgcagcacaatacttcttaccaggtaaagcaatcgtaaccttagatgacggtgcggaaatcgaagtcggtgaagcattagcacgtattccgcaagaatctgtgggtacgaaagatattaccggtggtcttccacgcgtagcagacttattcgaagcacgtaaaccgaaagagccggcaattcttgctgaaatttcaggtatcgtgtcattcggtaaagaaactaaaggtaaacgtcgtttagtgatcacgccggcagaaggcgaagcattcgaagaaatgattccaaaatggcgtcagctcaacgtattcgaaggcgagatggtacaacgtggtgacgtaatctctgatggtgcagaaactccgcacgacatcttacgtttacgtggcgttcacgctgtaacagattacatcgtaaacgaagtacaagaagtttaccgcttacaaggggtaaaaattaacgataaacacatcgaagttatcgttcgccaaatgttacgtaaagcggttatcaccaacgcatacgacagcgaattcctcgaaggggaacaagttgaagtggctcgcgtgaaaattgctaaccgtaaacgtgcagaagaaggcaaacctcttgttgagttcgagcgtgaattgcttggtattaccaaagcgtcgcttgcaactgagtcatttatctcagcagcgtcgttccaagaaacaacacgtgttcttactgaagcggcagtggcaggtaaacgtgacgaattacgcggcttgaaagagaacgtaatcgtaggtcgtttaatcccagctggtacaggtttcgcataccaccaagcacgtgcgaaaaaacgtagccaacaagaacaagcggttgctttcgaagcaccagttacaccggctaacgtattcgcaacagatgctgatatcgaagcagaattcgaattcgttgcagacgatgcaactcaaagcctagcagcgttattaaacgcaggtgatgaagagtaattcgtagcgtatagataaaaagcccctagaacgaaagttctaggggctttttgtttattatatgatttctattggagttaaaataacatcatatccatcattccttatattatttatagtattaaataaacttatcttcgagaaagaactcatattaagagggaaaccactaattttcttagattctattgcaatagcaattacaacagttttccttgcttcttctgaaatagtaaaggcgcttgtacatttttccctaaattcttttgagtttgcatataaagtagatgctatgtatgcttgtgaaaataggtatgaggattttgctccccagacatttttaatgtgaataaaacgatgtttactatgatcataaaggtcggcaagttcaatttttgacttttcatcagtcttaattaaatttcgatcaagtaataagaaacctttctgtttagaaacctcatcattatatatctgttcagcataagtttttctaccctcatttttttctatggaaataattttgttttttatgtcatcagcattccattttggtagataatcattttcaatggtaatatttcttattttatcatctataaaagaaatgatattatctaaaatattaaaccatttgccatctaatttcacgtaatgttgattatttaaagaagtttcgcaaacaataagcctttctagtgagttattatgataaaaatctttttctccctcagttgttattcccattatatgtatatttaatagttctttaagagatagattcatttgaaaattttcttgaataaggactttgatttcatctatatcaagctcatttattttgaaattattatttttaatagataattcatattcagaataatcaaatcgtttgaatggttctggtaagtctaagtacaagatacagtcgctgctattgatatttttatagaacttatatagtttccgataacaatttaaatttaacttgtgtattaattccttatttttaacttgtttatatgatttgggcatcttaattttttcttcttgtcctagaattttattaatttcatcaagtacctgctctatatttctaatatctttttctgtgcgaagaacaatggaggatttaccttgcactacaaagtgttttcctgagaattccccttttcctgatatgctttttaatattttattatagttttcattgtcgaagttagggttataattcgctacacttctttgtatttgccttgtttggctctttatagaaaactgatggatagaagaaatagataaattatctattaatcgcaaggcaacatctaatccaaattcatcttcaatatactcttgaataatcttaaacccatatccccctgtaagggcataaaggttatctttatagtttattagatagataaaactatttgaataattctcaaatgatatttcaggtgctaacggtgctataaatttactccattcaggaatgcttcttttatttttttgtataaataaactacttttttcgtctgagaaaatcttttcgtattcatttatagaagagaaattagcaaggctaaaatgagagcttaatttaaagatgttgatacgatttgttttagatctagccataatatattttcctcaaaaatacgttatattattttggcataatgaaagtttgtacaagcactcgtcatagatgagcgctatcatttctggacatagtgagcagagaataaaaaaacaagcggtcaaattctcccaactttttgcaaaaatcttgaggaatttaaccgcttgtattgtatcaattactctaaaccgacaattttccagcggttgtgagacacgccttcaactttgccttttttcacgttagagatgtaatcgatcatcatattttgaatggtgccggcttcgctgcccattgcgactttagattcccataatactgggatttgttgtccttcccatacgccgccttttttgatgagctgctcataacgatatgagttcataccgagtttgattttgctgtcatcagtgattgcggtgccgttggcaaggctaagatcaacaattttctcgccgcttggtttgcgtaaatcaatattgaattctacgccgccgaaaatatcaaacgtaacatatttcgatttaccgcgtttttcattgatacggtagtctttatcttgcggctgaattgtatcgaagtaatctgccgaccagttcatatatgccttgagctgtttgccggtcacttcgtacacgctcacatcaccacccgcatagcgatagttatagataatatcttttttcttaatatcgcctttgtctaaacgcacggtttggtggtcgaaggcaaaagacacgacgtccgctttactgtaatgttgttgcacgtcattaatcaatgaagataaaccggtatcttgcgtgaaggcaatcgctacgccgtgatttttaccttgcggaatcatggtttgtgcggtttcaccgattttcacattgttcaaacggcgtaattcgtcatgatatggttgataaattttttcgattgcaggatctgaagccaatgctttaaccggtacggtttttgcattttttgaaagtaatttcactttgccatcatctgcgacatcaaaggctaaatccacttctgaaaccaccgtgccgtagcggtgcggttcggtaatcagtgtatttttgatggtttccgctgagacgtttttgtgcatatgaccggcgataatcacatcaatgccttccacgttattgactaaatccgccacgccggtatcagggatattattttcgttttcaatccccatatgcgctaacacgataatcgcatcaacccctttcgcttttaactcggcaatttgtgccttcgcttcttcgcttggtgagctgaatttcatctcatcaaggtgatgggtatctttttcgaaggttgccgacattggtgtggttaaaccgattaaaccgagttttacaccgtctttttcaataatatcggtggcggtaacgtaacgcttaccatcttttttgtagtagaagttggcagttaatactttggcattaatgtctttaatgatttcatttaaagcggtcataccgaagttaaattcatggttacctaaaatgaaatagtcgtatttcatttcgtttaatactttaggaaccgggttgtctttgtagtattttttcgttttagcaaaaacttccacttggttgtcttgaatcgcatcaccgatatcgactaatactacatttttattattttggcgtacctcttttacataggtggaaatttgcgcgtaagaaccggatttgtcctcaatatccgcgccatagttccaaggtacgatacgcccgtgaacatccgatgtgcctaaaaatttaatattcacttctttagcgactgcaacgctcgccgcagacaatacaaataaagtactgagtacttttttcatgatgctctccttgtgagataagtagggatagatagattccaagctattttagcttaggctgattacaatttgtaatcaatcaaaagagtttttctggaaaatgtgatcttaccgacataaattggagtatttacgaaacaagcaagcggtcgaatttcgcaaaaaatttgcaaaatttgaccgcttgtaatgaaaagctataaacctatcgcatagcgcaatgcttttttcttgataggtgtgattttttccgccagtaccaagcctaaatttcgggcgacttttactggcaataactcggttttgaatgccttataaaaaacatccataccggtttgcatcaataaattatcgggtttacgtttatgttcataacgtttaagcaccacttcatttgcaaagttttcgccttttttgaccgcttgttcaatcacttctaataatacttgcacatctttaaaaccgagattaaccccttgtccggcaagcggattaatagtgtgcgccgcatcgccaatcaataccacgccgtttttgacataatgttgagcgtgttggcgagtcagcggaaaactggcggcattgactacttccactttgcctaaacgagcagggaaatgttgctgaatttcagcagtgagtttttctgaagacagttgttttagttgggtaatacgttgcggtgcgtcataccacacgatacaaccgttgtgatctgatagaggtaaaaatgcacgagggccgctcgggaagaattgttgccatgtgaccgattgttgcggtaattcggttttcaccgtggcaagtaaacaatgttggcgatattgccagctggttagcccaatactcgcccagctacgcacttgtgagtttgcgccgtccgccgcaatcagtagtggagcggtaaatgtttgctcatcaacggttaccgtccataattgttcatgataatttgcagaaatttgcgaaaatccgaccgcttgtcggcagtttggatactggtttaaggcttgccataaaccgagctgaatcgcattattttccaccataaagccgagcttatccaagccgatttccgctgcatgaaaggcagtattaaatccttcgatttcccaagtttccaaaccgtcatacgggcaaactcgcatttggctgattgcctgccaagcgcccagttcttcaagcagtttgaccgaggtaatactaatagcggaaatacgcaaatcataagcggcattcgtatcaaatgagggaagcggttttttttcgattaatgcgatatttaacccctgcttcgctaagccgagcgccgccgctgccccgaccataccgccaccgataatgataatatcctgtgttttcattttgccccccatttgctgaatattgatgctctattataacgttttaatcaccggaactaactcaatatttagtgcttttaggatttttagcttggatttaatagagaggaaatttatttttgcgatcctgatcgagaaaagtgattttgttgctgtgacatagaacatttatcttttaccctcctaacaatttttaggagggaagatgtctttagccattgtttatagccgtgcatcgattggtgtagaagcaccgttggtaacgattgaagtacatttgagtaacggaaaaccggggctaacgattgtcggcttaccggaaaccacggtaaaagaggcgggcgatcgggtgcgtagtgcattaatgaatgccaactttatgtatcctccgcaacggatcacgattaacctcgcaccggcggatctacctaaagaaggtgggcgttttgatctaccgattgcgattgggatcttagccgcttcaggtcagatggattcggatcgcttaaaacagtttgagtttttaggagaattggctttaaccggtacattacgaggcgttcacggcgtgattccggcggtaatttccgccgaaaaagccaaacgacagatgattattgcccgcccgaatgtgaatgaggcgtcgttagtgtcgaatgccgaaacctattttgccagttccttattacaggtggtcaattttatgaataagcgggatagcctgccgattgctcagcagattccgcaaaaaacacaagaaattcaaccgcttgtaaaacgtgatttaaccgatattatcgggcaacagcatgctaaacgagcgttgatgattgcggctgccggacaacataatttacttttccttggccctcccggtaccggtaaaacaatgctcgccagccgtttagcggatctgttgccggcaatgagtgatgatgaagcgattgaaaccgcttcggtcaccagtttggtacaaaacgaattgaattttcacaactggaaagagcgcccgtttcgagcaccacatcacagtgcatctatggtggcgttggtgggtggcggttctattcctaaaccgggtgaaatcagtttggcgcacaatggtgttctttttttagacgaattgcctgagtttgaacgcaaagtgctggacgcattacgtcagccgttggaagccggtgagattattatttctagagcgaatgctaaggtacaattccccgccagttttcaattaattgcagcaatgaatcccagtccaacaggacattatcaaggcacgcacaatcgtacttctccgcaacaagtgatgcgttatttaaatcgtttatccggcccgtttttagaccgtttcgatctctcgattgaagtccctttattaccaaaaggcgcattacaaagtagtgataaccggggggaaaccaccgagcaagtacgcaagcgggtatttttggcaagagaattacaaatggcgagagccggcaaaattaatgccaaattaaccaccaaagaaatcgaacgtgattgtcgccttgcagaaaaagacgcgctatttctagaaaatgcactgacaaaattaggactttcagtgcgtgcttatcatcggattttaaaagtttcccgcacaattgccgatttagctaacgaaccgaatattcaacaaatccatcttgccgaagcactaggctatagggcaatggatcggcttttacagaggttgcaaggtgaaaattagcttcgtgttttagttacattaattgagctaagaggttttccacaaatacttgcggttgttcgaaatgagcgttatgtcccgcctgtgaaatcactcggtaagtgagttggttttgctctgccatatttcgaaatttttgatcgtactcgccgataaaaaatgtgattggtggcgtggtggcttgttgtaagtgttgggcgtaagaaggctgttttgccaagctagttgcttcaagcatcgtggcgatggctaagctgctgttgttttgtctttttttgattaaatttgaccgcttgttttggtctaaattggcaaaaacggcttgttggtaccaatcatttaatacttccaccatcggctcgtggcggaaacgttctgcccattgatgatcgttttgccaacgtgcttggcgttccgtatcagtcactaagccgatattcgccccttcaagaatcgtatgttttagctgaggattattggcattaagtgcatagtccaacgctaaacgcccacctaacgaatagccgaccaaataaaaaggctgattaccgatataatgcaaaatagtttgatgaatgagttctctggcgtgagtaaagccgtggcaggcgatatgttcgcttgcgccgtgtaaggggagatcaatggtaagcggtcgaatttttggaaaattttgcaagcggtctaacaccgcttgccaatcttgttgtgaaccgagtaaaccgtgtagaaaaaccaccggaatacccgtttcactatgccatgttgcgtggagcattaggcaatttccgcttgtgagatttgtttgattaatgacttataaaggttgctaccgtcttgatcattcactttaatttcaacgatagtcacgcctttacgtccgtaagcgagtttcaatttggctttcagatctgcccaagtgaacgggcggatatactcaatgccaaacatggttgcaattgatgcaaattcatagttgtgtgataagcggtagaattgttctttcgctcttgcttctaccggtaacatatcgaaaatcgcaccgccgctattgttaatcacaaacaaaatgcaagggtgattaattttgttaagtaaggcgatagagttcaaatcgtgtaatgcggaaatatctccaagcacaccgacagtcggctgaccgctaccttttgctacacccgccatggttgcgattaaaccgtcaataccgcttgcgccacggttggtataaaccggataaccttccggtaatttgcatagcgcatcgactaagcgcacgaagagactgttaccgataaataaattaccgttagttgccaatacttcttcgatatgatgtgctaatgaagcttcgtttaggctgccaccgacttgttgctcaataaaaccggcacagaattgtgaaagtgccagcggttctaataaccacggtttttggcgaagcggcggatgtacgcgtaaaaagtggtgcgcttttgctacaaagcgggtttgatgatgcgcaaacggattgaggtaattgctgtattcatccacttgccaaaactcgcctttaaattcttcaaggaatttattcactcttttactcacgatttggctaccgaattgaatcacgatatccgcttgtaacaagcgctggtgaaccgtattgttcgacaaccaaatatctgcatacggtaagcttgcatctacgcaagattgtacatcggtaagtaagcaccagccgagcgtttctgcccaagctttaatgccgatgccttgctcaaccggtaatttaccgaccacaattacaccacgtttggtacgccagtaatcccaattctcgtgcattgacacttcgctttgaatcgtttggctgttaatccatttcgtttgtgaattgattaaccaactttgaatcggttttaaccacgggtgtgtgctaattgcattttcgtccgcttcatataacggctcggcaaacggcgcattgatatgtaccacaccaccttgttggctttgcgtgacacaggcttgctcgatagttgcgactaaccagcttgcgttatagtgctccgccggtttcggtaaattaacgctcgcaaccggataattagcaaaaatcccttgttgtggaatcgcttgatttgcaccgcagccgattaattccggtgggcgatcagcagacagtacgatcaatttatgatgagtaagactggcttcgataactgccggataaagatttgcgacagcagtacctgaagtcacaataatcgctaccggatcattggtcgctttggcaatacctaaagcaaaaaagcctaatccacgctcatcaaaatggctatggcattgcgcttgttggtcttgttgcaactgaagcgcttcgagtgttaaaggtgttgaacgtgaacccggtgcgatacagaagtgtttcacgccataacgtaataaggcattcacaattacttttgcccaagagcggttaaaggtgctgactgtcatatctcttctctgttcttaataactggttgaattttcactaaatagcaagattgtagcaaaatctgtaaaaaataggtggaaaattaccgcttatatatacattttattcctttaatttcattgttttttgatgtttttccaagaattaatgagatgtagttcacatatttctattttactaaatgaaaattactccattatggatataataaatggtgtatttattcataaagtttatgaggtttggagaaatgttgtcagatgaggatattgttcggcgttatctcgcaaaaaatacggagtttaaacgtattgcggacatcagtttgcttggtcattctttatttgatatgtggagtgattggcaacatgaactgacgcttaatggtttgtcggtggcaaatttaggcatttccggtgtgagtacccgccaatacttggatgtgattgcgaaaccgcaacgcattacttcattagggcaaaaggtttttctcttcttaggcgtgaatgatattgtgaaagagcctgactattctcctacccaagtcatgtattggttattgcaaattattcagcaaattcaaccgcttgcaatgccaaatacccgttatttcttgctggaagccacgcctgttcgtcatattcatacggtcacgaaccgccaaattcagcagcttaatgcctatctcagcgaacattgtccggcaaatcttacttttattaaaacctttgacgcatttgcggattcagagggaaaccttaatgcggcattcacaacggacggtttgcacttcaatttacagggctatgcgatcttacgccgcttattagaagcttatgtgtaatgtgtgttggaaagcataacagactcaaggagtttatatgtcaaagttatctcgtacggaaatattaaatacgattcgaaacggtttaatcgcctcgtgtcagccggttgatgacggcccgatggataggccgggcattgtcgccgcaatggcgcaagcttcgattatcgggggagcggtagggttacgtattgaaggggtagataatttaaaggcaacgcgtccgactgtgacagcgccgatcattgcgattgtaaaacgtgatttaccggatagcccgatacgcattacgccgtttttacaagatattgaagatttagcggcagccggtgcagatattattgcggtggacggtacggatcgggtgcgaccggtcacgattgaagcggcgttgaaacggattcacgagctaggctgtttggcaatggcggactgttcgaccttggcagaagggctatattgccaacaactcggttttgatattgtcggtagcacaatgtcgggttataccggcggggaagtaccgaatgaaccagattatcagttagttaaagacttaaaagcggcaggttgttttgtgatggcggaagggcgttataactccccgcaactggcaaaaaccgcgattgaaatcggtgcagattgcgtcacggtcggttcggcgttaactcgtttagaacatattgtcggctggtttgccgatgcaatcaaaacggtgaaagcttaggaggcgtttatgcgttgtttagcattagatattggcggtactaagattgcttcagcgttagtcgaaaacggcgtgatttcccaacgccgacaaatcagtacgccacaacaagatgcggtggaagcgatgcaccatactttggcgaacattttgcaacagtaccaaggacagtttgatgcagtttcagtagcttcgaccggtattatcaataacggcgttttaaccgcattaaacccgaagaatttaggcgggttggctttctttccgttgcaagaaagtattgcacgtcatactgacaaaccgattttcttactcaatgacgtgcaagcggcggcttgtgccgaatatcaacatcaagataaacaagcggtcgaaaatttcgtatttattaccgtttcaaccggggttggcggcggcattatccaaaacggcaaattgctaacccaaccgaatggcgtagcagggcatatcgggcatactttagcggatcctaacgggccaatctgtggctgtggtcgccgagggtgtgtggaagcgattgcttccgggcgagctatcgaagcggtttcaagccaatgggcgcaaccttgtacaccgaaacaagtgtttgagcaattccgagcgggcaaagtacaagcggtcgaattagtcgaaaaatctgcaaaagccattgccaatttagtggcggatttaaccatcggtttagatacgcaaaaggtcgtgatcggtggcagtgtcggcttggcagaaggctatttaccgcttgtacgacaatatttagtcgaaatgccgcatttctatcattgtgaattggaagcagcgaaatatggcggcgatgccggtttaatcggtgcggcagcatgggcggaacaacatttttaattgaattgataaggaacataatatgaaaaatttaaccggtatttttagtgcattgctcgtggcattcaacgaggacggctcaattaatgaaaaaggcttacgccagatcattcgtcataatatcgacgaaatgaaagtggacggtttatatgtcggcggttcaaccggcgaaaactttatgctttccaccgcagagaaaaaagaaattttccgtatcgcaaaagacgaagcgaaagatcaaattgcgctgattgctcaagtaggtagcgtgaatttacaagaagcggtcgaattagggaaatatgcaaccgaattaggctatgacagtttatcggcggtgacaccgttctattacaaattcagctttgccgaaattaaacattattacgacaccattattgcagaaaccggcaacaatatgatcgtctattcgattccattcttaactggtgtgaatatcggtgtagagcagttcggcgaattgtataaaaatccgaaaattttaggggtgaaatttaccgcgggcgatttttatttattagaacgcttgaaaaaagcctatccgaaccatttaatttgggcgggttttgatgaaatgatgttaccggcggtagcactaggtgtggacggcgcaatcggttcgaccttcaacgtgaacgccccgcgcgctcgtcaaatttttgaattgaccaaacaaggtaaattggcggaagcgttagcggtacaacacgttaccaatgatttgattgaaggcattttagcgaacggtttatatctcaccattaaagaattacttaaattacaaggtgtagaagccggttattgccgtgagccgatgaccgccaaagcaaccgataaacaacttgaagtggcaaaagcgctttatgcaaaatttttataaaatttgaccgcttgtcatatatataacaacaataattaggaaatattatgcgtcttatcccattacaaaccagtgagcaagtaagcctttgggctgctcgtcatattgttgaacgaatcaatcaatttcaaccgacggctgatcgtccttttgtgttaggtttaccgaccggcggtacgccgctacaaacctatcaggaattgattcgtttataccaagccggcgaagtgagctttcagcatgtggttacgtttaatatggacgaatatgtaggcttacctaaggaacacccgcagagttaccatacctttatgcaccgtaacttctttgatcacatcgatatccagccgcaaaatatcaatattttgaacggcaataccgaggatcatgatgaggaatgtcgccgttatgaagagaaaattcagtcgtacggcaaaattcacctgtttatgggcggcgtcggtgtggacggtcatatcgcctttaacgaaccggcttcttctttgcgttcacgtactcggattaaaactcttactgaagatactttgattgcgaattcccgcttttttgataatgatgtcactaaagtaccgaaatatgcgttaaccatcggtgtggcgacattacttgatgcggaagaagtgatgttactgattaccggccacaataaagcgttggcattacaggcttgtgttgaaggtgcggtaaatcatatgtggacggtcagtgctttgcaactgcatgaacgagggattgtggtgtgtgacgaaccggcaacccaagaactcaaagttaaaaccgtgaaatatttcacccaattagaagccaatgcaattcaaagcgtgttgtaagttttaaggtctgttacactattaacagaccttttcctttggagaacaagaatgaaatatgctttcaccaacagtgtaatttataccgctaaagatgtgttatatgggcacgcagttattattgaagatgacaaaattcaagcgattgtacgcgaagaacaattagcggacgatatccaacgtattgatttaaaaggacataatctcaccgccggttttattgatttacagctaaacggttgtggcggcgtaatggtaaacagtgaaccgacagttaacacttttgaaattatgcagcaaaccaatttacgttccggcacgacaagttatttgccgacctttattactgcgcctgatgagggaatgaaacaagtagtcgcggcgatgcgtgattatttgcagaaatatcaaaatcaagcgctcggtttacatttggaaggcccttatctcagccttgagaaaaaaggcgtacatcgtgccgaatatgtgcgtgaaatcagccccgaaatgcagcagtttttatgtgataacgctgatgtgatcaccaaaattaccttagcggcggaaaacccgaccgcaaaagcaattcctgagtttgtgaaaagcggtattattgtgtcggttgggcattcgaacgccacttatgaagtggcaaaacaagcgtttgctaacggtgcaacctttgctacccatttacacaatgcgatgtcgccgatcagttccggacgtgcaatgggcgttgtcggtgctgtgttagacagcgatgaggtttataccggtattatcgtggacggtttacatgtagaattcggtaatgtcaaaatcgccaaacgagctaaaggtgacaagctttgtatcgtcaccgatgctaccgcagcggcaggttcggatatcgaacaatttgattttgtcggtaccacggtgtatgtgcgtgacggtaaatgctatgacgctaacggcactttaggcggtgcatcaattacgatgatcgaatcggttaaaaatgcggtgcaagaagtagggattccgttagatgaaacgctgagaatgtgtaattactatccggcgaaagcgattggtgttgatgatcgtttaggttcgattgaagtgggtaaaattgcgaatctgaccgtttttaccaaccgtttcgaagtgattggttgtgcagtcaacggtgaatggaacgcttttagctaagaattgaataagcattgaatggaacaagcggttaaatttcgagaaagttttgcaaaaaaacattgaaatttaaccgcttgttttatggattagagtgctgcaaacgctttgtcagccgctgctaatgtcgcttgaatatcttcatcgctatgtgcaagagacataaagcctgcttcaaatgcgcttggggcaagatacacgccttgttccaacattaaatggaagaaacggttgaatttcgccgcatcgcatttcatcacatcttggaaattattgatttccgcttgttcggtaaagaataaaccgaacataccgccgacatattgtacggttaacggtacgttatgtttatccgctaatgctttaaaaccttccgccaatgttttagtttgtgcagcaagtttctcttcgttgcccgctttggatagttcggttaaacaagctaaaccggctgccatcgcaatcgggttgcctgaaagcgtacccgcctgatataccggccctgtcggtgcaatgtattccataatttcttttttaccgccaaatgcaccaaccggcataccgccaccgataattttaccgagtgtagttaaatccggtttaacatcgtaataggcttgcgcaccgcctaatgcgacacggaaaccggtcattacttcatcgataataaacaccgcaccgtattgatcacataaagcacgtaaaccttttaagaaatcatttttcggcggaatacagttcatattgccggcaacaggctcgacgattaaacatgcaatttcattcggatattgttcgaaagcggtttttaccgaatctaaatcgttgtaagtacaagtgagcgtgtgcttcgcaaaatcagcaggtacacccggaccacttggctgacctaaggttaacgcaccggaaccggcttttactaatagcgaatcggaatgtccgtggtaacagccttcaaatttgataattttatcacggccggtataaccgcgcgctaaacgaatcgccgacatggttgcttcggtacctgagctgaccatacggactaattcgatagaagggactaatttggtaaccaattcagcgagagtgatttcgctttcggtcggcgcaccgaaacttaaaccgttcggtaccgctttcagtaccgcatcaataattgccgggtgattatgacctaataccattggtccccaagaaccgacataatcaatatattgcttaccgtccgaatcggtaatatacgcaccttccgctttttggataaataccggtgttccgcctacacctttaaatgcacgcaccggtgaatttacaccaccggggataactttctgagctttttcaaacagttgttctgatttagacataaatgattccttaaattgaaattctgaatagcgttgatcgacaaggttctgctttacaaaaaatagtttaaaaataaccgctatgagttcccttctgaactgcctgagcgtgttgaaatttgtaggaacatttttcttgagcgaagcgaatctaaaatgttccgttaaacaaattacaactaagtgaagataagcagtgaagtaggatcgcctttcttttggttacttttctttggcgaagcaaagaaaagtaatggagagaatatgtaactgattttctaaggttatgattaaaccaaataaagcaaactttatatttatccattttataaaaaaaagcccaaataacctaaaaaaatttgagagtccgcccctttatgatattctgcacgcatttttgtacattcgttttgagggagtaaaccctttatgtggcttacttttatagctgtttttattgtctcgttcgccagtctcatttttatgcgccctgtggcggaaaaaatcggtttggtggataaacctaactatcgtaagcgccaccaagggcttattccattaatcggcggtattgctttatttttaggtaatctcaccttctattttatggaatggcaagatatgcgcttaccgtggctgtatttaacggcggtaacgtctttgctgattatcggtgtattagacgatcgctttgatgtcagtccgtttattcgagccattattcaagcaacgctagccggtttgatgatttataacgggctttcgttggatagtctaggtcaggtaattgcgccgtttagtattgaactcggggtgttgggtattattttcactgtgttagtgaccatcggggtgattaacgcctttaacatggttgatggaattgacggcttattggcagggctttctagcgccagttttgccggtatcggtgtgctgatgtggctggatgaacaatacaccttagcttattggtgctttgcgattattgtcgtattgattccgtatgcgctgtttaacctcagtgtcttcggtgccaaatggaaagtgtttatgggcgattcgggcagtaccttaatcggctttactattatttggattctattactcagcacgcaaggacaagggcatacgattagcccgattaccggtttatggctgattgctgtgccgctaattgatatggtagcggtaattattcgccgcttgaaaaagggcaaaagcccgtttcgaccggatcgcttacacttacaccatttaatgatgcgtgcgggattaacttcgcgccaagcgttagcggtgattaccttcggggcggcaatttgttctaccatcggtgtgttaggtgaatattactattggaaccagtgggtgatgactattggttttattgcgctgttctttatctatgcttactcaattacgcatgcttggcgtgttactcgtttgattcgtcgaatgaaacgtagagcaaaaagaaagctgaaacttgagcaataatcataaggttttgttatgcaacaacagcaatcaatcagcctaagcgcctttttcaaaagattatgtaaaggtgcgacaacgcttattttcactaccgccatcggtgcgggcgctgcttttggcttagcgcagttacaaacaccagtatggaaatcggtcgcacagtttgatcagccgagagtattagagcttggtaattactatgcactgtattcgacttatagttttttaaacggcggtgataatgttacttaccacgttttaaaagatgataaaagtgcgctttctttagcaccggcggtgtcgcaaaaagcggaagaacttgcagtacagacgacgtatgaggaatttaaacgaaatctgacttcggcagatgtgttagtaaatttcttagcgcaaacggaaatcgtgaagttaaaagctcagcttgaaaacaagccgattgcggtaatggcacagcaaatggcaacccagtttgtgtttgataatgcttcaaaacgtcacccggcggatcgtttaagcgtatcgtcagtcaatccggaagaagcgcaacagttgctgagccaatttattgcctttgctaatcagcaaacaaaacaaaccttaaatgcggaactgattgctaaatggaaaatcttatttcaacaagtgaagaccgcagcggaaattaaattaggtgcaacgcaacaaggcaatcaaatagccgcacaagattggaacggtaaattagcattaatgcgttcggtacaaccgttggatgataaattggtggcattccgtttcgtcaaagcaccgaatgttccgctttcaccccattctcctaatcaatcactttggttaatgattggcggattaagcggattattattcggtatcgtgctggtttctttttcgggtttattgagcagaaagcaaggtaatggcgaaacaaattaatgtgttaaccgtttttggtacacgtcctgaagcgatcaaaatggcgccgctggcgaagatgttggcggatgatccggcatttaatgccaaagtgtgcgtcaccggacaacacagagaaatgctggatcaggtattggaactgtttgagattcagcctgattttgatctgaatgtgatgaaatccggacaagacctcaccgatattaccgtgcgaatcttgcaagcactacaagcggtatttgcagagtatcgtccggatattgtgttggtgcatggcgataccaccacgacatttgccacaacattagcttgttattatcagcaaattccggttggacacgttgaagcagggcttagaaccggtaatctgtattcgccgtttccggaagagggcaatcgcctcttaacgagtgtacttgccaactatcattttgcgccaacccaagaagcgaaagctaacttattacaagagcgtaaagcggagcaatctatttgggtgacaggtaatacggtgattgatgcgcttttgagtattttgcaaaaaattggtcataatgaaccgcttgctagacaattagccgcacgttactcgttcttggatcatactaaaaaaatgattttagtaacggggcatcgccgagaaagtttcggacaaggttttgagcgtatttgccaagcattggttgagcttgcgaatcagtatcctgaagtacaaattgtttatccggtacatttaaatccgaatgtacacgaaccggtcagccgtttgttagccggcattcagaatatctttttaattgagccgcaagattatttgccgtttgtctatctaatggatcgtgcttatttgattttaaccgattccggcggcattcaagaggaagcgccggcgttaggcaaaccggtattggtgatgcgtgaaaccaccgaacgtccggaggcgataaaagccggtacggtacgtttggtggggacagatacccgaaaaattattgcggaagtagaacgcttgttacaagacaagaatgcctaccaagcaatggtgcaagcgcataatccttatggggacggtcaggcttgccagcgtattgtgaccgcaattaaacaaactttctattcataagctttgtgctatccacaaagcttttttaccacctgtagttatatggtggttttcggaaatcagcaaatgacaacttttaataccatttcagtaattggcttaggttacatcgggctacccactgcagctgcgtttgcaacagcaggctgccgagttttaggggtcgatattaatgccgatacggttaataccattaaccaaggcaagattcatattattgaaccggatttagatcaagcagtacaacaagcggtcgaaaaaggcctactttctgcaagtgtttcggttcagcctgccgatgcttttcttattgccgttcctacccctttccaaaatcattaccagccggatctgagttatattgaagccgccgcgcgcgcgatcgcaccgcatttaaacgcaggcaatttggtgattttagaatcgacttcaccggttggcacgacggaacaattagcccagtggttgaaagaaattcgaccggatttgagcttcccgaatgaagccggagaggctgccgatattcgtatcgcatattgtccggaacgtgtgttaccgggcaaagtgatggtggaattgttccaaaatgatcgcgtgattggcggactaagtgctaaatgcgcacaacaagcggtcaatttatacaaactttttgtaaaaggcgaatgtattcagactaatgcccgcacagcggaaatgtgtaaattaactgagaatagcttccgtgacgtcaatatcgcttttgccaatgagttgtcgatgatttgcgataaattgcaaatcagtgtttgggaattgattgagctggcgaatcgccacccacgagtgaatatcttgcagccgggtgcaggagtcggcgggcattgtattgcggttgacccttggtttattgtttcgcaagcaccggaacaggcgcgtttaattcgtacggcacgagaagtgaatgacagcaaaccgcattgggtgatggataaagtaaaagcggcattagcggattgtgtaacggagaaaaacgttaaaccgagtgaggtaaaaatcgcgtgtttaggcttggcatttaaaccggatattgatgatttgcgtgaaagcccagcggttgaaattaccgaaaatattgcaaattggcacagcggtaaggtgcttgcggtggaaccgaatatcactcgcttaccggcaaaattgcaagataaagtcaagctattaagttttgaacaagcgttgcagcaggcggatattttagtcttgttggtggatcatcaaccgtttaaagcgctgtcggtcgaggtaattccgcagcgctggttagtcgatacaagaggcgtatggataaaataatgcagcgtgaaattgcaccgaatcaatggttatccgagtttttcgggcgggacatttacgaaatcaaagtcgcagcagacgatatagaacggattcgcttggtacagcaacaagggtttcagtttgttgaaggtgaactggacttctgtttgtcattggtaaattttttgccaaaaacgaccgcttatcagctggcgaccgaagcggatattgtctcattacaagcgttgtttggtacggcatttcctatgagtcgctttcgagcgccgtggttttccgcagaagaaaatcaacgtttttaccaaacgtggattagcaatgcggtacgagcggaatttgatgacgtttgcttagtattcaaaacggcaagcggtcaaattcagggcggaattagcgttcgtgtccgagataagcaggctcgggtcggtttactggcggttgcgccatcatttcgccgacaaggtatcgccagtcaattattacaggcggcaatcaattgggcgcaacagcaaggtgcggaaacattcgcggttgccactcaaacgagcaacttaaacgctattcgcttgtatcagaaattaggcgcttcgcttcagcaggcaagctattggttttatctttaaataacgtgatgaaatatgattccatttaataaaccgccggtcattggcagtgaattggcttatctacagaatgcgattaatagcggaaaattatccggcgatagctattataccaagcaatgcgaacgctggtttgaacagcatttcggtacacctaaagcgctattaacgccgtcatgtaccgcttcacttgaaatggcggcaattttgctgagtattcaagcgggcgatgaagtgattatgccaagttacacctttgtttctacggcaaatgcatttgcgttgcgaggggcaaaaattgtgtttgtcgatattcgtccggatacgatgaatattgatgaaacgaaaattgaggcggcgattacctctcgtaccaaagttatcgtaccggtacattacgccggcgttgcttgtgaaatggatagcattatggcgattgcggctaaacacaatttatatgtggtggaagacgcagcgcaagccgtgatggcattttataaaggcaaaccgttaggcacaattggccatttaggttgttatagttttcacgaaaccaaaaattacagttcgggcggcgaaggcggggcgatcttaattaatgatgctaaattggtagagcgtgctgagatcgtgcgagaaaaaggcactaatcgtagccaatttttccgaggacaagtagataaatatacgtggcgtgatatcggctcgagctttttgatgtccgatttacaagcagcttatttagcggcacaacttgaagcggcggaacaaatcaatcagcgccgtttgagtatttggcaacagtatttcgaagcgttttcaccttttgtggtaagccaacgcattcaactgccacaagtgccggcggaatgtcagcataatgcgcatatgttttatctaaaatttaaagatttaactgaacgtagcgcctttatcgaatggatgaagcaaaagggtattttagcggtattccactatattccgttgcattcaagcccggcagggcaacaattcggcacttttttcggtgaggatcaatacaccagtgcggaaagcgatcgtttagtgcgtttacctttattttataatatgtcggaagcagaattacgccttgtgattgaggcggtattggaatttcttcatcaatgaaatcgttaagtagcacaaccctttggacggcattttctaccgcatttaaaattgtcgtcgggttattactgattaagttatttgcgttgcaattcggcacagcgggtttaggtcaaattgcgaattttatgactctaattaccgtgttaggtgtttttgccggtgcgggtatttttaatggtgtcaccaaatatgtggcggaatttgaacatcagcctgagaagttaaccgctttgctctcaactgccaatcgcattattgtgtcgttttccggtgtgttggcgttgattttgttcttatttgccgagcagattagtcaatggctcttttattcgaaagagtatcaaagcgtagttatggcaactggtttggcacagttcggtatcgccaatagcaattattttttagcgatcttaaaaggttatcgtaacgtcaaagcgaatgcgctgagtgtgatcatcggctctttgctaggcttaagtttttttctgattagtttatatagttgtggctatcaaggtgcgttagtcggctttgttgcgctaccggcattggtctttttgcctgcacgctactttcttagtcgacaactacaagcggttaaattttggggaaattttacattttcagccaaatatgcgaagaagttgctgaaattcagcgtgatggtctttctgacagccgtaactttgccggttgcttatgtgttgatgcgagatttattagtcgaatatcattcattggaagcagtaggcttgtggcaaggggtgagtaagatttctgatgcttatttacaatttattacggcggcattttcggtttacctgttgccgaccttcgctaaattacatgaaaaatctgcgctgcagaaagagctgattaaggcgctcaaatttgtcggtatttctgttatttggacgagtttaaccattttcacctttaagcattggattatcttattgctttatactgaagattttttggcaatggagccgttgtttatctggcagttgctgggggatgtctttaaagtgatggcgtatgtgttcggctatttgattgtggctaaggcatcgttaaaattatatgcggcagccgagtttttacaattggcgttattggttagcatgggctatttgtttattccgttacatggtgcggaaggcgcaacgcaagcctattttgccacttacttttgttatttcttactatgtgtggcaggatttaaatattacctgaaacattaaaaaaagccctcgggacatcctgtctgagggctttgtcattaacaatacttgctaatagtttgttggaattgcgttagacagatatcgtcacattttctttcacacggcagctacacgctagcacataaccttgtgcaatttcttcttcggttaaatcaccagtgtgtaccacttcatattccccacccgttactttagttttacataaaccgcataaaccggtgcgacagccggaaaccaccggttgttcttgtgcttctaatgcggctaatagggtcataccgaccggtacttctgcagtgatttgttttgcaccgttgatggttaaggtggttttcttatccgaactgatttcaccggctaaggtggtattaaagaaggcttcggtaaagaaacgatcttcgctcacgcctaattcggttacgatatcttttaacgccaccatataggcttcagggccgcaggtcatcacggtgtaatcgctcacattcggcaccgcatttttgataatttctgctgaaattcgaccgcttgcaaagccctcagttgctccgaccgaagcgttaatcactaagttgagtttcggatatttagcttgtagctcttgccattccgctttgaaaattacatcttccggcgaatgtaccgaatggataacggttaagttcacttccgggcgatttgctaataaccaacgagccattgacataatcggggtaacaccgctgccagcaccgactaataagtaattagtcgctaacacctgttggcaagaaaattcgcccattgggttggagaaccatacttggtcgccgactttcacgtcattgttgagccaagttgaaccgaccccaccttcaatttcacgcacggtaatcgacacgaaacggctctcgcccggagtagaagaaagtgagtaagcacgggtaatatgcggtgtgtttttaatgctaactaacgcatattgccccgcttggtatgggtagaaatcctgtgcgataaagttaatcgtttttacctttggcgcttcttgtacgattgaataaacctgtaattcattaatacataaagggtttttattggtatttgccattttaattattccttcttgttcttttcgggcgggcactggacccgcccctacaagtggtttaaatttgcaaaaattttgcgaaatttgaccgctcttttttaattagccgattatttattgatgatatgaccgaaatcttgttcaggggtggttaaaccgcttaaaccgaatttttcgtgtaataaattcatcacgttgtcatttaagaatgctggtttgcttgggcctgaataaacatttttcacgccaagtgctaatagcgttaataacacgataatcgctttttgttcgaaccaagaaagcacaatcgaaagtggcaattcatttaaaccaatccctaatttttgtgaaagcgtaactgctagcataatcgctgaataggtgtcgttacattgaccagcatctaataagcgaggcaagccgccgtcaatcgtaccaaagtctagtttattaaaacggtatttaccgcaaccgagtgtaagcactgcggtatctttcggtaacgcataggctaaatcggtgtagtagtggcgttcttctttatcgccgtcacaaccgccgatcacaaatacgtggcttaatttgcctgcttttactaaatcaattaccgcatcggatgcgtcaattaaggttttacgaccgaaaccgacagtaatgtagtgttctaattcggtgtatgggaagccatcacattccaacgctttttcgataaccggtgcaaagttgtgtttttctaaatgcaccacgcccggccagcctacgatgttacaagtgaagatacgatcggcataatcgcccacattcggatcgattaaacagtttgaagtcattacgatcgcccccgggaagcgcgcaaattctttttgttggttttgccagcctgaaccgtagttaccgactaaatgtttgtattttttcagttccggatagccatgtgccggtagcatttcaccgtgagtgtaaacgttgatacctttgccttcggtttgttctaataattcttttaagtcttttaaatcatgacctgaaattaggatacatttgcctttcaccggacggatatttaccgttgccggcaccggattaccgaaagtttcggtttcgccggcgtctaacattgccatcactttaaagttcattgagccgatagcgagcgacttttcgagtaattcgtttaaatcgcttggttttgtgcctaaccaagccataaatccgtggtattccacatataaatcgttatcaaatttacctaacacataagcgtgttctaaataagccgccgcaccttttaagccgtaaagcgctaataaacgcacgccgtgaacttcttcaccgatttccgctcggtcggtatctaacgcaaattctttagcctgttcggcaagttgatcaattgaaatgcctttgagttcaatatgtgctaacgggtggttgagcgttggatttggctcaacttcgctaattgctttaattaattcgttacggtaaataatcgcttgttgcgcatagccaacgatgcgatttgaatcgaagttaacgttggttaaggtggcgaagaacgcacgaggagcaaagttgtccgcatcgtggttgataatgccgtgttcacgcgcttttaacgcccacgcagacaggctgtgtaagcaggcgattaataagtcttgtaagtctgaagtttctgccgttttaccgcacataccttgaccgaaactacaaccatttcccactggggttaccatcgtttgttcacattgaacgcagtacataaaatcactccaatttaaatagtaaaataagtaacctactaaaatagtaggaattaatgttcgcaatcatagcgataacaaaaatggagaaaaagcagaaaattttggaaaatgcagggaatttgatctagtcgtagttatctacttaaaatagggtataggttatttttattgcaaattattcctaattttattggtaaagttttagtggtttttgaccgcttgttttgattctaagcggcatatgataaacttttaatcgatgctgtattttgcatcggaaatgatcatgtaatttaaacgtattgtggcgatcagaattggtcgccttttatcttctatttgttagaaagcattttatgaaaccgatttatcacattctaggctcggatattccacaccataatcatacggtgttgagctttttccagaatgaactgttacctcaattaagtggtcaacagcatttcttttatgttgtggcggagcagtcgttacagatagcctatccggatcttgctctttcttgtttcgatacgaaaaaaagtattgctcaagctgtggtacgtacagctcgcttagataagcaggcacaatttattttacatggtcagtataattttccgctttggtttgccattttatctggaaatttacccgcttctcgttgctattggcatatttggggagcggatttatatgaagattcaaaagcgtggaagtttaaaatgatgtatcccgttcgccgtatggcacaaaataaattgccggtgttatggggaacgaaaggggatctggcttttgctcaccaaaaattgcaacgagatccgacacaagactgtgtattatattttccaaccaaaatggcaaatcttcagcctcgagaaattacgccgaatcattcgtcattaaccattttattaggcaattccggtgatcgatccaatcgccatttagatgcattggtacagcttaagcagcagttaggtgatcaggttcgcattattattccaatgggctatccggcgaacaaccagcactatatcgagcaggtaaggcaacaagcggtcaaattatttccggaaaatgcaattgaaattctaacggagcaattgacttttgaagactatttggcgctattggcaaaatgcgatgcgggttattttaattttgaacgccaacagggtatcgggaccatctgtttactgacgcagataaatatcccgacgattttatgtcgtaacaatccttttacgctagatatgcaagcggaaaatgttccttttctttatagtgaggagataacgccagccaagcttgcacaagctcaacaacaattggcaaatttggataaaagtacgattagcttttttgcaccaaattatcgtacgcaatggttagtgcttttaacacaggtaagtgaaaaataattatgataatggaatatgctttactcggtggattttatattttgtcggcatggctgcttttagtgctttgctatatagcttataaacgaaagcctttttctttccacttattatttagtgtgatttattttgtgactttttatttaggttttccgttatcgctaacattatcccttgggtttgatgttgagctacaaagtacggacagcttgttgctcactttatttagtgctttatccggttatctcatctattacgctatctatcactcttcattattatcaagagtggatacaagacaacaagcggtcgaatttccacagaaatttgcaaaatttgaagcaaaagtgaccgcttacctattagctggcgttgcgattgcgagcttggtggcgtttattgtaatgaatgggctgttgctatttaaacttacgcaatataaccaaatcttttccgcagcggtaagcggcgtggctttaaaacgcttcttctatttctttattcccgggctactgattatgtttttcctatctaacaataaaaaagcgtgggttacttttctgatctgcggcgtagcatttggattgctgacttatctagccgtgggtggcaccagagccaatatggcattggcatttgtgttgttcttttttattggtctttataaacgctaccttagctttaaatggttagtgatggcgggagtggcgatgatcggtgcaatgtttgtcttagcactggtacgttacggcttgaatgttagcggtaaagaagcattatttactttcttatatttaacacgcgacaccttctcgccgtgggaaaatgttgccttaattttagatcaaccgatggaacatcagggattgatgccgatagtgcgagatttttatgtgtatattcctaaatggctatggttggacagaccggactatgttttaaatacggcaaattattttacgtgggagatattaggtaatttttccgggttggcgatttcgccgacgctcttaggctctttctatattatgggcggctttccaatgatcgctttaggtatggcatttattggcttacttattaaagctttcgatagattactggattatggcagaacacattctcaatgcagcaaagcggcaattattcaggcttattgctttgccaatgtattcaatatcattgtgttagttagagaagggagcgatgctttcttttctcgattcggttttttcagtgtgatttttgcgttatgttggggaatcgcttatctggttagttcgcttgctaacaacactaaacatataaaagaaggttaatatgatacaaagcgtcacaataagaagcattgaattactggcagtaaaagacaaaatgacctttgtagagtttttaatgaaccagcaagcggtcaaaaccggcaaattaattgcaattaatgcggaaaaactcattatcagcgaacagcaaccaaagattcgcacactgctggataatgcagagtacaaatatgcggacggtattagtattgtccgttccattaaaaagaaatatccgaatatacaagaaatcgaaagagttgccggtgccgatttatgggaagcgctgatgcagaaagccggcgagttagcggttccggtatttttagtgggaagcacagcggatacattggcaaaagtacagcaaaaattaaccgcttggaatgtcaatattgtcgggtcacaagacggctactttaaagcggaagatgaagatgcactaattgaacgaattcatcagagcggggcaaagtttgtgagtgtcgcaatgggttcaccgaaacaagaactttttatgcaaaaagctcaacaagcccatcctgattgcttatatatgggtgtaggcggcacttatgacgtatttaccggtaaagttaaacgtgcacctaaactttggcaagatcttggcttagaatggttgtatcgtttattaagccagccgacacgttggcgacgtcaattaaatttacttcgctttgcatattactactacacgaaacagctataaaaagcagcaaaattgacaattattattcattttgaataaattaaaagcaggcaaacatgtttttgtaactttttttaaaaaagtgctagacaaggtaaggtgaaatctataatatacgcctccgttgcgacgcactaaacaaaacgatgaaaatcgtaagcgttcgtagctcagttggatagagcgttggcctccggagccaaaggtcgcaagttcgaatcttgtcgagcgcgccagtggtcaaaagcaatattcaatcggcaatggtggctatagctcagttggtagagccccggattgtgattccggttgtcgtgagttcgagtctcattagccaccccatttaaaacatactcttatgagtaactgacggcgagtagcgcagcttggtagcgcaactggtttgggaccagtgggtcgtaggttcaaatcctatctcgccgaccactttattttttgttctttaacaatttatcagacaatctgtgtgggcacttgttgattgacttaattgaaaaaatatttttgattttgaagtcttaataggtgcttaaactagaaattcatttttacttttgaagtaatatgtaaactttagctaagcagtttattgagcgattaaactttttgaattgaagagtttgatcatggctcagattgaacgctggcggcaggcttaacacatgcaagtcgaacggtagcacgaaggagcttgctccttgggtgacgagtggcggacgggtgagtaatgcttgggaatctggctcatggagggggataactacgggaaactgtagctaataccgcgtaatatcttcggattaaagtgtgggaccgcaaggccacatgccatgagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactttaagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttaccaagaattaagcgactgcaagtgttcacacagattgtttgatgaatgaataagcgtttgcgttagatggagagaaaagttattgaaaaataacggaatttaacgtagaataatgcgctcaaatggcaaagtggagagcatctttaaatgttgtccccatcgtctagaggcctaggacatcgccctttcacggcggtaaccggggttcgaatccccgtggggacgccatttaaagatgacttttgttgtctaaattgttctttaaaaaattggaaacaagctgaaaaactgagagattttcgaaagaaagtctgagtagttaaaaaaatcttgactgaacaaaagcagtcaagtgtttagttgaataaaatacagcattgaatggatttgaataagatttgaaaacatttgaggttgtatagttaagtgactaagcgtacacggtggatgccttggcaatcagaggcgaagaaggacgtgctaatctgcgataagcttggatgagttgataagaagcgtttaatccaagatttccgaatggggaaacccactagatgaagaatctagtatttactactgaatacataggtagtaaaggcaaaccgggagaactgaaacatctaagtaccccgaggaaaagaaatcaaccgagattctgtaagtagcggcgagcgaaagcggaagagcctgttagtgatagcagtagacacagaagaacgagctgggaagctcgactataaagggtgatagtcccgtattcgaagtgtctattgtggtactaagctaacgacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcctctttgtggggtgactgcgtaccttttgtataatgggtcagcgacttatattttgtagcgaggttaactgaataagggagccgaagggaaaccgagtcttaactgggcgttttagttgcaaggtatagacccgaaacccggtgatctagccatgggcaggttgaagattgggtaacactaattggaggaccgaaccgactaatgttgaaaaattagcggatgacttgtggctgggggtgaaaggccaatcaaaccgggagatagctggttctccccgaaatctatttaggtagagccttgagcggacaccttcgggggtagagcactgtttcggctaggggtccatcccggattaccaacccgatgcaaactgcgaataccgaagagtgatactcaggagacacacggtgggtgctaacgtccatcgtggagagggaaacaacccagaccgccagctaaggtcccaaagtactagttaagtgggaaacgaagtgggaaggcttagacagctaggatgttggcttagaagcagccaccatttaaagaaagcgtaatagctcactagtcgagtcggcctgcgcggaagatgtaacggggctaaaactagtcaccgaagctgcggcatcagtcgaaagactgttgggtaggggagcgttctgtaagcggatgaagctgaattgagaagtttggtggacgtatcagaagtgcgaatgctgacataagtaacgacaaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtataactgcgatgtggggacggagaaggttaggttatcagactgttggatgtctgtttaagccggtaggtgggaattttaggcaaatccggaattccgttaacaccgagaagtgatgacgagtctctacggagatgaagtaaccgataccacgcttccaggaaaagccactaagcttcaggttatactaaaccgtactataaaccgacacaggtggtcaggtagagaatactcaggcgcttgagagaactcgggtgaaggaactaggcaaaatagcaccgtaacttcgggagaaggtgcgccggcgtagattgtagagatttactctcgaaggttgaaccggtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagatgacacgccagtgttgttggaggcgtccttgaaataccaccctttaacgtttgatgttctaacgaagattgcggaacgcggtctcggacagtgtctggtgggtagtttgactggggcggtctcctcccaaagagtaacggaggagcacgaaggtttgctaatcacggtcggacatcgtgaggttagtgcaatggtataagcaagcttaactgcgagacagacaagtcaagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgttccagttgtctcgccagaggcattgctgggtagctacatgcggaagagataagtgctgaaagcatctaagcacgaaacttgcctcaagatgagttctccccgactataagtcggtaagggttgttggagactacgacgtagataggtctggtgtgtaagtggtgtgagccattgagctaacagatactaattgcccgagaggcttaactatacaacgctcaagtgtttttgagcactacactcagtagcagcttgtttcgaatttaaaccgaatttcccgacgacaatagtgcggttgtcccacctgaatccattccgaactcagaagtgaaaagccgttacgtcgatggtagtgtggggcttccccatgtgagagtagagcatcgtcgggttttattaccttagcttattttaactaagtgagttaagttaataagtacagaatttgattaacagccatagtgccgtggctctacctgactccattccgaactcagaagtaaaacgcggtaacgccgatggtagtgtggggcttccccatgtgagagtagggcactgttaatctactaaatttgcggagcggtagttcagctggttagaatacctgcctgtcacgcagggggtcgcgggttcgagtcccgtccgttccgccacttatctaaaagcgagttagttactcgctttatctatatatgatatcaataggggcgtagttcaattggtagagcaccggtctccaaaaccgggtgttgggagttcgagcctctccgcccctgccatatttaagaagccgattagtttatactaatcggctttttgcatatttatacttttttttgaagttatattttctgttaaaataataaaatattccgaaacaaaagtagctttatgaagagtttagatcctattattgaacaatttctagataccttatggcaagaacatgggttatctgaaaatacctcagcttcatatcgtttagatttagaacgtttttctgaatggttacctacgcccaaagcatttcttactttagatcattttgatttacagtcttttcttggtgaaagactagagcagggctataaggcaacaagttcagctcgaatgttaagttgtctacgtaagttttttcgctttttatatatagagaattatcgacaagatgatcctaccctaactttaacttctccacgtaagccgacgaatttacctaaatctttaagtgaagagcaagtaatggatttattggattgtcctaatccattagatcctatcgaattacgggataaagcaatgttagaattactttatgcaacaggattacgtgttaccgagctcgtttctcttacgacagataacttgaatttacggcaaggtgttgtgcgtattgtaggtaagggtgataaagaaagattagttccaatcggcgaagaagcaagttattggattcaagaattttttcaatatgggcgtgcaatattattgaataatatacaatcagatgttgtatttccaagccgtagaggattacaaatgactcgtcagacattctggcatagaatcaaacattatgctgttttagctggtattgatagtgagaaattgtctccacacgtattgcgccatgcttttgcaacgcatttagtcaatcatggtgctgatttaagagtggtacaaatgcttctggggcatagtgatctttctactactcaaatttatactcatattgctaaagcacgtttaaaatcactacatcaacgatttcacccaagaggataatatgcaaaaatcatcatctaaatttaattgggcattggcattcttttgcttgccttgtgcattatggccacttgcattattggtttcaccaagattttccagtttagcgttaagtccagcacagattaattggttttccacagcattttggatctatccgcttgttttatttgcaattacattaattttatataagttgcatcagtcacagaaagtattagctagaggtctattaatggttgcctttattggattttatgtattacttggttatattcttcaatctctatagtaaacttgttatctactaataacaatccgcccgtaaaacgggcggtttttaggctcccctataagggcctaggacttcacaagcccctcaaggggcatgtgaaagactgacaacagcacaatgacactatagcttaccccttaaaggggtctatatattctttcttcgataaactatccgaaaccatatcctccttctcttgattcctgatatattcttcaacaacttttgtatttaaacctaccgtactgacatagtatcctttcgcccaaaagtttctgttcccatacttatatttcaaattcgcatgcctttcaaatatcatcagtgaagattttcctttcagatagcccataaaacttgatacggctaatttgggcggtatttttactagcatatgaatatgatctttcatcgcgtgagcttcgaggatttctacatttttgtagttacataattgccttaatatgccgcctatatctatacgtaactttccataaattgtctttctcctgtatttcgggataaaaacaatatgatacttacagttccactttgtgtgtgatagacttgaatcgtcattggatttacttgccatgacttctcctcctatatgttgaattttggttgccagcctgattcattataggaggattttttattctgctcgccgcttaagctctttgattccatacgcatagcgtatggtttttatagctagacgttgtctagctataaataaaaaagccaccttctctgaaggtggcttttgctatttagtctaaaataactattacatagttacttctttagaaccttgaacttgaacttcaacacgacggtctggtgctaaacaagcgattaacgctttacgacctttaactgcatcacatgttgcgccagttactggatttgcttcaccgtaacctaccgctgttacgttagctgctggagcgcctttagaaacgatgtagttagctacagtttctgcacggcgttgtgaaagttttaagtttgaagcttctttaccgatacggtctgtatagccattaacttggatcgcagcatttgctagaccagcgttattgatttcagcttgcattgcatctaaagcttgagctgcagctggttttaagtttgatttgccgaatgcgaataatacatcagagctgaatgcaaagtttttagtttcgattgctggagctgcaacaggcgctgcaccttgaccgaaacgatatgataagcctgccgatacagagctgatatctgggcgataatcagttgcacccatacggtttaatgttgagtagcttgctttaccagcgttatttaaccattggtattctacgcgagctgctaattccggaagaattgcatattcaacaccagcacctaaaattaaagagctttggaaacgacgagtttttactttctcttgtgctgcgttaaatgttttatatgtattatttactaatgcgatacccgctttaccgtaaatatctaaattaggcaatacttcgtagcttggttttaatgcgattgttgcaccgtgagctgcgtgacggaaagttttcttgtccgctttgccgttaggtttttctgtaccgcgtacacgaccaaaatagtcatagccaacttctgcggctaaacctaatttatcttggtttaagatttgataaccaccgaatacaccgtaagttacagagtttctgttgataccatatttaccacctttagctgcatctaattgttcgatgccatcgtggaatgatgcccagcctgcttttgcacctgcatagaaagtatttgcttgtggtgctgcttgagctactgctgcagctgataatactgctaaagcaactaatgattttttcatattgatgtcctctaaattttatcgtcatccattaaatacccccgtcatggggacaatgaataccagttttggatactttcttgcgcgctatgtaagaaagaaaactgctattactattctattttatcaaattatgagctaaaaatacaataaaaccgctatatcctgtagataagcaaaggtttgtgataaatatttgtgatttgttgatacgattagataataaaaaacgcccacattattgcgggcgtttttttattctttagttacaaagaacgcgctaaattacatagttacgtttttagaaccttgaacttgaacttcaacacgacggtcaggtgctaagcaagcgattaatgctttacgacctttaacagcgtcacatgtagcgccagttacagggtttgcttcaccgtaacctacagcagttacgttagcagggttttgacctttagaaactaagtagttagctacagtttctgcacggcgttgtgaaagttttaagtttgaagcttctttaccgatacggtctgtataaccgttaacttggatagctggagtcgctaaacctaagttagcgatttcagtgttagctgcatctaaagctgttgctgctgctggttttaagcttgatttaccgaaatcaaataaaacgtctgagctgaatgcgaagtttttagttacaacttctggctcaacaactggtgctacagcgccttgaccgaaacggtatgataaacctgctgttacagagtggatatcaggagcatattggaagtccacatcttgtgtgcctgaacgaactaatgctttattgaagttacccgctttgtttaagtattggtattcgatacgtgctgctaattcaggaagaattgcgtattcaacacctgcacctaagattgtagatgcttttaatttgtggaatttctctgttggttcgttagtgttttctgcaccgtagaatttgtagtcgttacgaacaactgcaacacctactttaccgtaaacgtctaagttaggtaatacttcgtagcttggttttaacgcaaagtttaaaccgtgagcagaatgtttgaattcacggaaatcaccaacgttaccacgaacacgaccgtagtaatcgtaacctaattcagctgctaaaccaaagttattttggtttaagatttggtaaccaccgaatacaccgtaagttactgagttacggttgataccgtaagctgttgtatctgagttataacgagcatcgtttgaatatttgtcattaaattgacgaacgccttcgtggaatgacgcccaacctactttagcacctgcgtatgcagtgttttgctgtggagctgcttgagctactgaagctaatgctaagccagatactgctaatgcaattactgtttttttcattttgatgatcctctagattgtcatcgattaaaaaaataaataacttcaataccacttggtactaaagcttaacttatatgcttccgcctcattagagaagaaagatagttaattttctaggatactgagcaaaagtacaacaaaaatttgtgattttgctaaaaaaagttgcaatatccctatacaacatattcttgttctctaatcaaatgagcaagaatatatttattatcggagttcaaattcacaaaatcaataacccacccctcctaaaagtgtaagaaagtgtatagaactgttgatttaataagctatgtgtaataatttcaatcattcaagttgttttcttcactttcattttcaatattcacaaatcttgttaatatcgttttacctcgaatttatacctataattaatatgcttccacaattgtcgacaacgccagaactgaataaaacagttatacagtttttagcagaactcaaacagcaacattttagtggcgatatcgcttctcattatgcggatcgcctttctttagccaccgataacagcgtttaccaacagttaccgcaggcgattttatttcctaaatcggtttcggatgtggttattctcactaagctggcacaacgccctcacttccaatatctgacatttacccctcggggcggtggcacgggtacgaacgggcaatcgttgaataacaatattattgtcgatctctctcgccatctaaatcaaatcctcgaattaaatgtagaagaacgttgggtgcgagtgcaagccggtgtggttaaagatcagcttaaccaatttctaaaaccgcatggtttgtttttctcaccggagctctccaccagtaaccgcgcgaccttaggcggtatgattaacaccgatgcttccgggcaaggctcactgcaatacggcaaaacctccgatcatgttttagcgattaaatcggtattgatgaacggcgaagtgttggaaacacaagcggttaaatcttgcgatttttttgcagaaatcggccgcttgggcttaactgctaccggtaaacagctccaccgtgaaatttttagccgttgtcgtgagttacgtccgaccgttcttgccgagttgccgcaactcaatcgctttttaaccggttacgatttaaaaaatgtattcaacgcagacgagagcgaattcaatctgactcgcattttaaccggctcggaagggtcacttgcttttatttgtgaggcgaagctcaatttactgccgctgccgaaattccgcaccttaataaacattaaatataattcatttgatgcggcattgcgttctgcgccgtttatgctgaaagccaatgcgctgtcggttgaaacagtcgattctaaagtgctgaacttggctaaacaggacattatttggcattcggtgtccgatttattaaccgaagatccgaataacccgattctcggtattaatattgtggaatatgctggcagcgatcagacactaatagaacaacaagtcgcagacctcattaaagcgttagataaaaaactggcagattcaaccagcggtattattggctatcaaatttgcaacgatattgcctccatcgaaaaaatttatgcaatgcgtaaaaaagcggtcggtctattgggaaatgccaaaggttgggcgaagccgattgcgtttgtggaagacacctgtgtgccgccggagcatcttgccgattacatcgctgagttccgccaattattagatgatcacggtttggaatacggtatgttcggtcatgtggatgccggtgtgctacacgtgcgcccagcattagatttaaccgaccgtacacaagtgcaaaaatttaaagtgatttccgatcaagtggttgaacttaccgcaaaatatggcggtttgatttggggagaacacggcaaaggtatgcgttcggtgtatggcgagaaattctttggcgaaacattatggcgagaattacgttatatcaaacagttgtttgacccgcaaaaccgcttgaatccgggcaaaatttgtacaccgcttaacagcaatgcggcgctttacccgatcgactcatcaatgcgtgccgattttgatcgccaaattccaattcaagtgcgtgaagaatttaaaggcgcaatgaactgtaacggcaacgggctatgctttaactttgatgtacatagtacgatgtgtccgtcaatgaaagtatcgggtaaccgcctttattcgccgaaagggcgtgcgactttgattcgagaatggctcagattgcttgccgaacaaaacgtatcaccggacgatttgatcttcaaaccgcgtaaacaagcggtcaaattaaccgattttgttgcaaaaattcgcaacacgctgaataaacagaaagaatacgatttttcgcacgaagtgaaagcggcaatggatacttgccttgcatgtaaagcctgtgccagccaatgtccgatcaaaattgacgtgccgacgtttagatcgcaatttaatgagctgtaccatagccgttatttgcgtccggcaaaagattatctggtttccaatcttgaatttgttgcgccgatgatggcgaaagccccgaagttttttaactttttcagtcgttcaaaattagcggaaactgtggcgaacaaaacgatcggcatgacttatttacctgcgctttccgtgccgaacttgcagcaacagttggtcgagattggttatcagggggtgaccttagaggctttggaaacacaagcaagcggtcaaaaatcagcggaattttgcaaaaccgtgctggtagtgcaagacccgttcacttcgttctatgatgcgaaagtagtggcggattttgttcgattgctgcaaaaacttggtttccgcccagtggtgctaccgtttaaaccgagcggtaaggcgcaacatattaagggttttttaaacaagtttgctaaaactgcacgcaatcaggcggaatttctcaatcgtgtcgcccaactcggcttaccgatggtggcagttgatcctgctctgaccttagtttaccgtgacgaatatcgtgatatcttaaaagccgcgcgtggcgatttcaaagtgcaactggctcacgaatggctacgagatgtgattcaagccggtgagttggagcattgcaaaaaatcaccgaattctgaccgcttgagctggcatttattcgcacactgtaccgaagcgaccgaattgccaaatgcaccgaaagagtggcaagcgatttttgcccatttcggtgaacagttggtaaatgaaaatgtcggttgttgcggtatggcgggcacgttcggacacgaaaccaaacaccttgaaatgtcgacagcgatttatcagcaatcatggcaaattaaattgaaaaataaaccgcttgagcgttgcctcgctaccggctattcctgccgttcgcaagtaaaacgttttgagcattattcggttaaacacccgattcaggcgttgcttgaggtggtgtagattttaaatcctccgtatatccctcaccccttgtgggagagggatagatttttcttcgttcagaagaaaaatcagggagaggaggaatcgtggaaaaactaggcgtattttcccctctctctgcaaaaaattacctaacgtaatttttcgctgtctctctcccgcaaggggagagagtgatatttaacaaactttttcttctataaagagcacttggaaagatttttcataaaggaaacataatgactatttggaagcaaactgcaacttgtgaacaattaaacgcacttagccaaaaatcggcggtagcgcatttaggtatcgaatttaccgcaatcggtgaagattggattgaagcacaacttatggtggacgagcgtactcaacagccgttcggtgtattgcatggcggcgtgtcggctgctttagcggaaaccaccgccaatgccggtgcgttaatggtgtgtgaagcgcatcaaattgcggtcggaatggaactgaatatcagccatttaaaatcagtaccagcaggtacaaaggcaattgcccgtgcgaatccgcttaaattaggacgtgaagtgcaggtgtggaatatcgagattaaagacgaacaaggtaatctatgtgcggtggctcgtctttcgactaaaaccttagataaacgttagtttcttatcaacgacaagcggtcaaattctccgaaaattttgcaaaaaatccggaaaatttgactgcttgttcatttaggcatttattcagccgtttggcggttgctttggtagataaaatagagtgcaatacctaaacaaattaccgctaataagcgagggattgaaaacgcaatcgcttcattatgaaaccaaccgaaggtatcaatcagtaagctcattgctaattgcccgaaaatcacggcgactgttgctaccgccgtgccgatttttcccactgcaagtaccataatcacgatataaggtacgccaagcaatgcgcccatgagctgccattttggcacgtcaaatagggttaattcgtgctttggctcgaagaaaaataccaataaaccggtgactaatgccccgaccgagaaagtcaaaaacgcacttttaaatacacctacctgtgcgcctaatttgccgtttacgctcgcttgaatggctaatgcaacaccaccgagtaaggctaaacataacatgatgaaaatcattacatctctccccaaataataaagcccaacgccaatacgataaaaccgagcgcaattaaacggtgtttattgatcttatgatgttgtgatccgaacagcgcaaaatggtcatttaataaactttgaaaaatttgtccgaccaagacaccaatcatcgtcattgccacaccgatgactggtgtcgcgagagttaagatcaccacataaactggtcctaggataccgccggtcagttgccaaccgggtagtgaaaaataagatggcgtattgcgtggtgagaaaaatagcatcagtaaaaaggttaaacaggctccgacaccgaaaatactcaaagttgcccaaagtttgccgacttgttgccctaacggcccaagtaaaccggcttccaccgacaacccggcaccggcaagaatggtcgctaaaattaaaatgatttgcataatgttctcagttgataaaaaaagagagcattatatttgtacaaattaccttatcaataggtaaaatatggcaatactatccataaaatggaataatcaaatgaatcatattcaagcaatgcaggcttttgtacgagtggttgaaagcctttctttccataaatccgccgaacaacttgggattcctcgttctacattaagtaaatggatcagcgatttagaacagcattatgcagtgaaattgctacatcgctccaccagaaccgtgatgccgaccgccgaagggcaggcgtattatttgcaagcggtcagattattggcggaatttgatgaattggaacaacagatgcacgataaacatcgtgttgtaaaaggacacttacgggtggatatgccgatgctgtttgccgagcaactttttattcccaaattacctgatttttatcagcgttatccgcaaattaagctgacattaggcattagcgatcgggcggtgaatattgctcaagacggggtggattgtgtgattcggattggtgaagttcatgatcaaacattaattggacgaaaatttgctaattttgactttgtcacttgcgcttcgccggcctatctaaccgaatacggcataccgcaaacaccgagtgaattggaaaatcatcgcttaatcgggtatttttccgatataaacggcacgcggccgttatgttttccacaaatggaaataaatcaatttcactattcggcaaatggggcgaacgggattgtcgcgatgttaaaagccggtttaggtatcgggcaaccgttgcgtgctttggtacaaacttggctggatactggagaactggtagaaattttagctgattatccacgcccgagtttgccggcttatttgctgacgcacgaacgcaaacaaagcgcaagattacgtgcgtttagcgattgggtatgggaacagtttgctcactcatcataagcggtcgactttgatcaactttttgcaaaattcttgctaaatccgaccgctattcgcaaaaggcggttggatctagtgccaacctattataaaatgcctttctttttatctgtccttaacccaagagaaactcaacatgaattcaaatcgtagtttactggtactggggctgttattggtgtctttccttgtgttcactcagtggcaacaagattttaaccctgaaattcaggcgcaaaaacaagcacaacaacaagctcaagttgcatcacaatcaggcgatgtgcctgctgcatctaacgcaaataccgttattgcggagaatgcaacccaaggtaaaaccatcactatccaaagtgatgtattacgtttaaccatcgacactttaggtggcgatgtgattgcttcggatttattagcgcataatgcggaattaaattctgaaacaccatttaaattattacaaaccggtgcaacaacttatgttgctcagagtggtttagtgggtaaaaacggtattgataccaatacaggtcgtccgcaataccaagttgcgcaagacgcatttgtattagctgaaggtcaaaatgaaatcagtgtaccaatgacatttgaaaaagacggtgtgctttacaccaaaactttcgtgttaaaacgtggtagctatgatgttgcagtgaacttcaatgtgaaaaaccaatctgcgcaagcaatcgaagttcagccttacggtcagttaaaacatactttagtagaaagttctggcagtttaactatgccaacttataccggcggtgcgtattcttcatcggaaaccaactataaaaaatatagttttgatgaaatggcaaaagcgaatttaaacattgatacgaaagccggttgggttgcagtattacaacactacttcgtttctgcttgggtaccgaatcaagatgcacaaaactcactttactctcgtacgaacaacggtattgcgactattggctaccgtggtccggtaacagaagtggcgccaaacagcgaagcgacgattaccagccaattatggaccggtccgaaagaccaaaaagagatggaagcgactgcggcaaaccttgatttaaccgtagattacggttgggcgtggtttatcgcaaaaccgttatttgcgttactcactttcattcaaagcatcgtgactaactggggcttagcgattatcggtgtaacgcttgtggttaaaacgattctttatccgttaaccaaagcgcaatacacttctatggcgaaaatgcgtatgttacagccgaaaatccaagaaatgcgtgagcgtttcggtgatgatcgtcaacgtatgagccaagaaatgatgaagctctataaagatgagaaagtaaacccgatgggcggctgtttaccgattcttatccaaatgccaattttcatcgcattatattggacgtttatggaagcggtagaacttcgtcacgcaccgttcttcggttggattcaagacttatcggcacaagacccgtactacattcttccattattaatgggtggttcgatgttcttgttacaaaaaatgtcgccgacaccagtggcagatccggtacaacaaaaagtgatgacttttatgccggttttattcacggtattcttcctctggttcccatcaggcttagtgctttactggttaacttcaaacttaatcacgattgcacaacaatggttgatttaccgtaaccttgagaaaaaaggcttacactctcgtaaaaaataaacgagcgttttaactaaaaaagcactgttcgccaacggtgcttttttgtttttatggtatgataaagcaacgacaagcggtccgatttgcaaatttttttgcaaaaacgaccgcttctttaatagaaaaggataccaaatgaaagatacgattgtcgcccaggcaaccccgattggtcgtgggggtgtgggcattttacgcatctcggggccattggctcaagaggtggcaaaagaagtgctgggcaaagagctaaaaccccgccttgccaactatttgccgtttaaagatcaagacggcacggtgttagaccaaggcattgcattgttctttaaagcgccgaattcgtttaccggcgaagacgtgttagagctgcaagggcatggcggtcaagtgatcttagatattttactgaaacgtattttagcggttaaaggcgtgcgtattgcccgtgccggtgagttttccgagcaagcgtttttaaacgataaactcgaccttgcacaagcggaagcgattgccgatttaattgatgcgaccagcgaacaggcagcacgttcggcattaaaatcgctacaaggtgaattttccaataaaattaatcagttagttgattcggttatttatctacgtacttatgtggaagcggcgattgatttccccgatgaagaaatcgactttttagcggacggcaaaatcgaagggcatttaaacgatattattcgccaactgaacggcgtacgcaaagaagcgaaacaaggtgcgattttgcgtgaagggatgaaagtggtgattgccggtcgcccgaatgccggtaaatcgagcctgttaaacgctttagcgggcagagaagcggcgattgtaacaaatatcgccggtactacccgtgacgtattgcgtgagcatattcacattgacggtatgccgctgcatattattgataccgccggtttacgtgaagcgagcgatgaggtggagaaaatcgggatccaacgtgcgtgggacgagatcgaacaggcggatcacgtattattgatgatcgacagcaccgaacaaacggcggaagcatttaagaccgaatgggcggactttttagccaaattaccgcaaaacattccggttaccgtgattcgtaacaaagtggatttatccggcgaggctgaaggcttacaagagttggacggttttactttgattcgtttatcggcacaaaccaaagtgggcgtggacttactgcgtgagcaccttaaaaaatcaatgggttatcaaagctcgaccgagggcggcttcttagctcgccgccgtcacttacaggcgttggaaaccgccgcagagcatttagaacgcggtcatatccaattaacccaatttttcgccggcgaattactcgcagaagaattgcgtatggtacaaaatgcgttaagcgaaattaccggtcaatttacctcggatgatctgctaggcaatatcttcagttcattctgtatcggtaaataatcatgaaacaagcggtcgattttcgccaaaattttgcaaaaaatttcaagaaaatgaccgcttgctctccattcaatattggttacaatggcttaattttcattcttactcgagaacattatgactaaatcaatttgcattattacaggtagtacattaggcggtgcggaatacgttgccgatcacctcgaaagctgtttaaaagcgcaagattttgaagtggaattattcaaccaagcaaccttggcggatattcagcagcaagcgcatttaattgtggtgacttcaacccatggcgcaggcgaattgccggataacatcaaaccgttatttgacgaactgacggcaagcgatttagatctcagcggtatgaaattcggtgtggtcggtttaggcagtaccgattacgacacattctgccattcggtggatatcgttgaaaacagcttgaccgccaaaggtgcgaagctggtatgtgaatcggttcgcattgatgtggcaaacaattttgaccacgacggcaccgcagaagaatggctgccaagttttgttgagcagttataacgaacaatttgaaatgacaagcggtcgaaatttgtaaaaaatttgcagattccgaccgctttttttacgcttaaagcatcgcttttaacgcttcggtgagttgttgataacgctgatatttttgttggtaagcggcaaaatttgccggattcggttgtacttttaacatttctattttcaatacttgtacttgtgaaatctctgcgccggtaccttgcattgccattaatgccgcgcctaaacagccggtttcttccacttgcggaatttccaattgcataccggttaaatcggcaagcatttgtagccaaatcggagatttggtcggtccgccggtcacacgtaatacgtttgcattcgggaaacgttgcttcatacggttgaggtggtgcataaggctaaacagcacgccttcataaatcgcctgtaataaatgcgcttggctatgatgcgcttgcaagccgtagaagcccgcttgcataactaagccggcattcgagccgtataaaaacggcacaaataacacggaactggctgccggcggtaaactcgctacttgttgattaatttccgcataatccaatttccattgtttcacaaaccattccaaatttccggcggaagtcgggctggcttcatgaatgataaatttgccttcatccgtataacgaccatagacaaacggtaaggtttgagtcaagtcgatattatcagtgataccgctgacaaccgaccacgtgcctaataccgcactcagtttgctttcgtcatctaagtcagcacaacgtgcagttgaaaccacatcaaataaaccaccgaccaccggcgttcccgccgctaagccggttagttcggctgccgcttcggtaacatagccggcaatttgattcggcttaatcacaggcggtagcttttctaaaatattttgcaaaccgagtaaatcggcaagcgtctggtcgtattcgccggttgccatattgtagagattgctttcggaaatattggtttcttcggcaaataattcgccggttagacagaatcgtaaatagtcgtgcgatatcagcaccgagccgatttgcgcatagcgttccggctcgttgtcttgtacccaacgcaaaatcgaaacagggtgtccggtccataacgtctggcgggtaatcggataaagttgttccggaataccgtccgcctgccactgtttcacaattgaaagcgaacgttgatcggaagataaaatcgctctgccaagcggttggttttgctgatcaagtaaaaatgcgcctttaccctgtgccgaaatgccgacccctttgatagcgttcggatttaccccgctttttgcaatggtttgacgtactacctcggcacacacctgccagagttgttgcatatcacgctcagcatagcctgcggtttcgctgattaccgatacattttctcaatgtaacgccttaatattgccttgattatcaaaaagtgcggctttaataaaagtgccaccgcagtcaatgccaagagtatagttcattttatttcccataattatgaggacgaagttcgtccgtttttgtaaaaaatttcgaaaaaataaccgcttgtaggacgaaatggtttgccttcgttgtcggacaaaatgccgtacggcggatcggtaaaccagattgtgccgtccgatttgaccaccacatcattcggcgagttaagccggttaccgtgctcgcaggtaatcaggttgtcgttggcatcaaaggcattgccgttggaaaagtgcgacggctggcggaaaatttgcgtgccggtttcggctgtccagcggtacatcgtgcagcctttcacatcgctgaaatagagtgcctgttgagccttgctccaagctgggctttctgcccagatggctttatcaaaaagttcttcgatttcaaaagtgttgccgaccaactctgcaaaacgtgggtcggagatttgggggataaatttcttgctcattttttatactgaactccgtttttgattctgccaaatcgaagaaattatttcatttttcattacaagcggtcagatcttgcaaaaaattgcagtattatgtagcaattgcacaaaacccaaaatgcaatcttaaccgcagtaaaatttttgatgctcttaactctaaaaacagagctaaatcgttattggcgacattacaaaagaaatcctaattgcaaataatcaaccgaataccccagtaaatcggacttatgtcaagaatgttcatgctgcaatggataggctactcaagaaaggtattgtagaacgacaatcagataaagcacataaagaggctttatggcgattaaaaaccgaaaaatagtggctatgctctacgcaacaatctcttttaagcgccactgaattaccttaactaacggtttttcttgcaatttctgccactcaacaattcctttcccttgcaaccgtcttaatgcatgtgaaaagccagtcgcaatcgaatgatgttgagatttatgtgcaattctcccttcaatttcaaatgccttaaacattatctcttttacagacatccattgatttgggtaatgcttagcctttttcacgaagtatgttcaatgcgagtttataatagaggtctttttctgttttgatgacacggtgataaacgactttttagataggtttgttgtaaaagaataaattcagctttaggggattttttaatataacattgaatagttctgattgaaaattgacatttttcagctaattgtttataggtttgttttcctattgtgtaatcaattcaaatatttattggatttaatttctttgtggaagaaaaggttttattgcagggcgaacaaaggtatctctgaatattatttttctttccatgcttttagatattgctcttaaagcaaaaaggacagttttttgtgcatatttcaaaaagcgggcttaaagccttgtgccataaggctctagctcactttttacaacacttttgtctactatgccttttagaaactaaggtactctaaattagaatttcatttcgaatgaaacaacataatttctacccggagccgcatatcttgcgtaatctttcacattagtgtgctggtgaatagcgttaagcgaagattgacgtacggattcccaagtggtgtaacggtaattcatcagattatatacaccagctcgtaccgttgtatgtttccaaggggtgatatatcccgttaagtcaaaggtatgccaagaacgtgttcttttcttcgtggcagttcgctcataattggcaaaaccgacttgttcattacctcttaactcatctggattttttccactggagtgtgtcattgttagattcacgccccatttttcatctggctgatcgtaccccactcctacaacatagcgagcaggctgaatggtatctaacaatggagaacgaatattcatatacccttgatagtttttcacctcttttactcgcattttgctataagccaatgttgtgtaaatgccctcaggaattttatcaaataccccattccaatctagcttaccaataagattaatgccgtccaatttaatatcttgcacattaaaatagttaatcattgattgagtttgatgcattctttctgctggagcaattaactgcttatagtcatttttgaaataactgacttcaacgacaccaaaatcacctttgaaagtcgcagcaacctcttggtttaaggatttttcaggagataacttctctgttttttggtaagcatcgctggagcctttcattgcaccatcataacgtaagccaaatagctcttggaaacttggcactctaaagccagatgatgctcgataagagagcgataggaatgacgttggttttgcgactatgccaatattccacgcactgtttttataatcgccttgatttgcccagcgatgagtgctacggaatttatgcttatcgaaacggtaacccaaaccaatatccaaatacttggttatggcaaaattatctctcagagcgatgtagtgattatgccctttgattttacttgtagcacaatcagccctacctgcaatagtgccactataatcacattcatttttactataaattgcctgatcttttagctcatacacataaggattattgtaagatccatttcgatagccaatgtctctaacaagcccccaactccctacagaaaattcactcaaaatttcgtggcgttttaaggtggaattgaaacggtctgaacctaataacatatttaattgatgtttacccaatcccgtttgtacggttttatctaacgagagctgaatagtgtcgtgtttttcttcataagaactttgctcatttttagtagaagaccaaagtttatcaagagttgcacggcaattcttatctatggttggatattccgaacagttgttttctctcaagcgggtagataaattaattttttgctgatcgaaactcaaggatagtctatcaatcagacgatttccatcttgattagtataacgatataaagcacctaagcgatcacgagtgtgccactcgtcaataaaacgagcttttgcccaacgtaaaccttttgaggatttcacaccatcttccgtaaagtagtcaatagcaacaccatctaaagcattatcacgatataatcctttagcattattcattggataccaatttctaccagttctaagtaaatccgatggttgccaataagcggtataggtcatatctcgggtgtcgtaacgctgtttgctatgttcataagtaccagcgacataatgtttcggagagaatgtgtatcccaatttaaccagccaagaatcagatttatatttaagcggatcaggtaaagctctatattcaccagtgtaatcctgagcatttagacgctctgtaatatgtttttggttctcataagcctgtttttcctcaggagtatattcagggtaagaacggaaagatggcgtatcttttgtcaccctagccatctgtttcggcgtacaatctaacgttggacattcatctttaatcaaaaaccagccataagtatgttgattattcgtcgtcgcagtatatctatttgaggtatcaagctcgttggtttccactcctactcgggtgatattctgagaacgactctctgcatctttatgagctttcgtttccttaccatcacggtgagtgtaaatcacaagagcatcaaagccattgtgagtacccgcaaaagcaagtgagtttaaccattgttgatttttgctactgtaggcacttttggtatctaatccccaagattgccctggcttaataatgtcgcttacctctttggtacggaattgcaccgaaccgcctagtgagccactaccaaactcagaagaactagcccctttactaatttggatcgaacgcagattttcgtattctatttcattaatggcaccgcttgaggaacgtgaatattggcttacataggattgaatctgtggcaaaccgtctaatgccaagcccacacgattacgatctaccccgcgaattgagtagcctgtcgttgcacctctcccttgttctacgacagaaataccggggtcgtaacgagtcagatctcgtattcctaacacttgctccttactaagagtatctggtgttttaactactttccctaagcctgtgacttcgttctcttttttatgtgctttctttttggtacctgtgacataaacatcatttaattgtaccgcttgttctgcatagctttgtacggcaaataggctaagaagagcaaggctaatcagatttaatttatttttcatagcaaattccttattatttttctatttgtcgttttgcaccaaagacagcgccaacactgccattgtctgatttatgatggaattgtccgccaagttctccagcggttggaccatagaagccaccattgacttttatatcactaaataccgcatttccgtgttggctagagcctgcatctaaagcaaagccactatcagaggttttcgcactgccgataaagccattaccattaattgtcgcatctacggtaaatacaggatttacaccgcctttatcaaataacttaccgtttacttttttatcactaaaattaacatcaaattcagtgcgatagcccgattctcgattattatctgcttccgctatccagttcgtccctttagatacgagtgcatcccaagttccaacatacttatagttacctcctgcgggcattttatccgttgcagtacgttcaccttgtaggaataaactattatctttaacttgttgtttgccctctttttgccacaattgaccaaatttcatatattccagattactacagcaagctacggctaccattgttttgccgttgatttcaaccgttttactatttttaaaattgacacctgctagatctattttttgtccatcaataattaaaacagaggcatcaccaaaattgttgagttctttagcattaaattgggttaaatcaattttagttgcatcaatgattcgttctgtggtcgtctcgccgttttcacttttagctgcaaatactgcaaagagagatttattatttgtgaaaaatttccctgccatttcttcagctttaggaccatagaatcccccttcaagataatttgaatcagtaaagatcggatcacctgctttttctgctttggcttttcctctaaaacggttgcctgttatatcagcttcaatgctatagcgtttcgttacttcttgcgctttatttctgttgatataaccattacgatataaactacctgtcaattttttgttatcaaaatctactgcaaattcactagaatgagctacccctttaacttcattatcacctagtttttcaccaactttatgatctcgattgacattatccgaaatagatgtagctgcaacatttttaccattaccagcatcactaaatccacttaactcgtagcttgttttaacatcgctggtgaaatcccaagtacctttataggtaactttatttcctttagggagttcttttgacgggcttgtccctaaatagtaaatgtaaccatcgatcccatttttaaaaatatagggtacaccattcttattttttactatttcactataagattcatcgaaaacatagcctgaacgcacatattgtaaatttcgttttttgtcctcctgtttaccatcgtgagagtgataaattaaaccactcgttgttttatcgtttaactctttcaagtgaggaatttcatctatattttcattccaaatcgccataatttgtgcttcagataattcatcagttgtatcaggtgttgcttttcgatttccttctttatcaaataaagctctattccggcgaggtatctttgcctcaactcccaaagtaggctccatcaacttatctaattcttcctttgtctttttcttcgtttcctcatcttgataagaggttgttgctttttctgcttttgcagtttgatttggccgaacatcttctaaatcaaaacctccttttccgccagaacaagcgacaagaaacagcgaagtaaacgctaacgcatagggattaagtttaaaatgcatattgcctccaatataaaatttctgcttttatttactaggttgagtcacaaagcctattttcgttagcccgacgttttgagctaattcaaggactttcacgatatgttgatattccacggaaatatccgcagaaatagcaataacggtatttttattttcctgaaattttgtcagaaaagattgttttaattcttcttcattcactagcttctcgcctaaataaatgcccgtaggattaatcgccactctgaagatatcttttggctcatcttttttctcaatactggaggttggtaattcaagtggaatagattgggttaatattggcattgtgatcataaaaacaattaataacaccaacattacatcaactaatggcgtaacattaatttctgacattaccgaattttcatttttatcaaaacttccaaatgccattatttattttctccatagtgatgtaataaatagataaataactcgtttgcgtaatgatctaaatcttgagaaagattacggttaaggcgagcaattaagttataagcaagtactgccggaattgcgacaaatagtcccattgctgttgcaactaatgcttctcctataggtgcagatacagttgcgatactgacttgtccttgctgactgatgtccataagtgcattaaaaattccccagaccgttccaaataacccaatgaacggtgcaaccgcaccaatagaagcaagtgcaactaaaccaccatcatatttacgaagggactgtgttattgcatttcgtaaatgtaaggttaaaaaatctttaaaaggaagttgatgagataaattatatttcccatttaattgataaagttcgcattgtttaaaagtggtttgcaaaatttcagaaatatcagaccgcttattttgagtgtatttctttgcttgattcatattttcatcagatttaataagattaaatgttacctgattgtttttctttactccgattattttaattaatcttattaaaataatactccaagataaaatactcataaaaactaatatgaagaaagataccgagagtacaatatcttgttgtttgataagttctgttaaattcataaattaatttcctcaaataatttaggctgctgcaccacatttaaaatgaatattgaaagttacactgcctacaatagtattcccattaatttttgccggttgatacgtatgtcctgttgccattctgctagcttggttatctaggcgtttgatgcctgaagaagataaaatttcaacattgattgctttgccgtttgctccaatagtaactttcaatttcacactaccgacatcatcagattcatctgaaatatcagagcaacgccctcgcattgcattgccataaccagcaccaagggaggcatcgactttggcatttccataggttgatttgcttccatttataccatttggatttccttgttggatcggctgctgagtacgactgcttttgtttgttggagaaacatctttctttgtctcatgttttttcatgatcttttcaggcgctttttttacttcctttgagggaggcttttttttaggaactgctaatttgggggctaagtttgactgagttacatcttttactgtagtatttaaaaattcttcaggtggttctgctattttaggttttaagggtgtatttaccgtaagggactcttcaacacctaaattaacttctatcatgtgtaaattttttagtcctccaaagagagcaagatttttgtcccaggaaaatcgtgagattgaatatgctactcctagatggatcagacttacagccaagatgataaaaaaatgataaaaacttcttttcatatctctatttttacttgcatcttaagttaatgaaaatcattatcgtttattttaaattgaaaattgtaagatttgcaaatgttttttgctttttatgtaaataatgtttgttcgggctagatttgaggtattgtgagctgtgtgattaatggctatagcgaagagtatcagttaggttagttagggttttatgatctaattacgttagcgtaagattcaataagcagtctgtttttgtaaaatttccacaaaaacagatcgcttgagcgtatttgttatgttaatccaataaaaaatgctaataaaattggcacgactaagttgatgataaagccaaagctgatggctaatggcacaacttgaatactacctgacttttggataatcggcaacgttgcatctaatgcggttgcgccaccgagtccaacagcggtcgatggaaagtagcgcataaaaaatgggatggcaaataaacagaaaatttcacgagacagttcgttaaaaaatgcaatgctgccgtacattggtcctcaggcatcataaactaatacgcttgaaagagagtaccaaccaaagccagaggcaaaggttttaattatcgacaaatctaatacacaagcacaaacgttgtcccccatacgagccatgtggggtttacgcattcctcagaggctccgcctctgtcctaaattatagcgactgtaatttagcccatacggtgtcatctaccggaataccatttgctttgttatccgccagaatttgggtaaattcgtggcccggtaaacgtacagccacttctgggtctgcacgctctgcggtgcgaacgtaatccataatacggttaagtttttcgtctttggttttgccgtcaatcagtctatcgacttcaattgcaataaacacctgggaaacgcagtattcgtcatctttatcttcggtaaccgcagcggtggattcaccgttagaaagcagggttgcgatcatatctaacacaatcgataagcccgaacctttccagaagcccattggcattaagtggcggtttttctccacggttgccggatcacgagttgggttaccgtcatcatcaaaacccgcatcaacaaaggtttggcgaccggctaagcggtgcacttcgagcattccgtaggagtacattgagcaagacatatcgaccatggtaattggcgtagttggcactgcaacaattaacgggttagttccgatacggtactctttctccccccaaggtggcataacggctaaagcgtttgtccaacagataccgatatagcctttttccgctgcttgccagccgtaagaaccaccacgcatccagtggtttgcattacgcaacgccaccgcaccgataccgttttgtgaagcgagttccatcgctctgtccatcatttttttcgcagtgaggttaccgatggcttgatgagcgtcccattgttcgattgcacccaatgaaagcactttagtcggaacggcttccggtacaatatcaccgttttccaactgctgaataaaacgtgggaagcggtttaccccgtgtgaatacgcacccgcctgagtggtatcggcaaatacggttgcacattcttctgcaatttcttcacgtacgttacgagccaataaaacacgtttaaattcagcttttaaatcttgataagaaactctcattggacacctctaatttatgtcgtttcaaatagtaaaatggtgtttcataagttacgcttcgccactaaggaagtcaattaaatgagaaaaataaaagttctttataatcaagcagttataaaattttttgtcaatttgtgacagagatctcactttccaaagtcaattttttgggctaaattaagtacaaagcaaacgttttcgcaatgacaagtaaaaaggataaataatgaaaaaagtatatgtaactcatggttatacggcgaatccgagccgaaattggtttccgtggttaaaacaagcattggaaaaattgggggttgagtgtgagtgtttgacaatgccggatgccaataacccgaatccgcaagcgtggttggagcatcataaaaatacgcttaaattaaatgaagagacggtgttgatcgggcatagtttgggttgtattgcgttactgaattatctggcggtaacgcaacaaaaagtgaataccgcaatttttgtttccggcttttatgaaaaattaccaactttgccggagctggatacatttgcaactttttacgcaaatcagaccgcttgtttgccgacaaaatcttatgtgatttctgctttagatgatgagattgtgccgcatttattcagcgacagattggcgcaatatttacaagcggattatattcgtttggcgcagggcgggcattttattgatcgagacggaataaccgaattaccggttttattagaactcttaaaacaaattttgaaataggcacaagcgggcggcttgtgccaaagtgaggagagtacgaagttaggcacagactgagaagattttatggtttgtgttttcactgttaagcacggacaagaccgcattggctaatgctttacggctcatataactgccgggcagttcagccgcattttcaattaaacggaaggtttcgccttccgtggtatttagcccgcacggacgtaaaatcgtccagtttagcgagctttcacgcagtaagttttccgcctgtgttttttcttgtagcgcttcacccaacacttgttttaccggctcaggtaaaaatgcccattgttcaccgcaacccatactggtaataaaaataaaacgagcggcaggtgcatatttcagcatggcacgaataatattgatattgccagcagcatcgctacgtacaccgtcttttttgccaccgatatagctgatcaccacttttggcgaatattgctgcatcacagcttcacaagcttctaaagacatcacatcggcaaccgctgtttggcgatccgtaaaaaacggatctgccgaaggttggcgcaacaccgagacgattggctgatcagccgccgccagtaatgcgcgtccggctaggccgttggctccaaataataaaatcattattcacccttgattaattgacgcataaagtcgatttggttttgacgtaagttacgtgcttcatcacgtccgacaaagattttaaacattgcgccgccttgatggttaataaagttaagcgatacggtatgtttgcccataaacggacgctcaagtaaataaatcgccgcacagttttcataacgtaggtggccgtgtacgccgccttcctgagcgtgatcaaaattgtaaaaacctctgccgatttgaccgcttggtagcttgccggtgacctcaaccaccgcatccggcgtatgtgcaataaaggtcaccgcatcttctagagtcgctaatgcttgcatgatttccacaaaacgtgcgccgtccgtttttgtaaccatttccgccggtaagcaactaattacttcttctaagctgcattgtttcataccggcaaccatttctaaaatttgtcccggattttcggcaagtgattgacgtaattcgcttaattgttcttcacttaatttaaccatgctgttctcctttttatcttctgtgggtagcgtgagcattaatttgcggatcaaggtcggtgaccagtatcgaccgctaatattcaagcgagcgatgccttcttgatcaatgtttaataaggataattgctgccattgcatcagcaatttcattgcttttgggttatgtctaaataacttaatatccagataacccagttctaaatcgtgttgcacgacaccaagcaacggcttatttgcaccgtgtttacttaaaaacgatagtgctttcttatctgccggtgtgtctaaataagtttgtagtgtggaatgtacttggaaactataaccgccgaaattaccgcctgcaccggagccgaaagccagacacggcatattggatttaactaacgtgttataacggtttcgttcccctcgattcgggaaagcaaagtggttattacttacttgttgccaaccggctttttgtaaattctctaccgcataggcgtaatgttgcgcttgtacctcaaaacttgcggcagcaggcagagaaccgtgttcaatcattttattaatcggtaaaaacggatagttattaaacgcataaatatccaaaccggataacggcaggctacttgccacttgaatatcattcgcccaaacttcatccgtttgattcggtaaaccgaaaatcaaatcggcaacgacaaccgcatccaattcacacaaggctttgaggtattcgtaagcttcctcgccgctatgtttacgtcctaaacgtttacgaatttttgagttaaaggtttgaataccgattgaaatacgattcacgccggcggctacgcaagcacaagccttttcaatatcaaaatgactaatacgaccttcaatcgtaaattcgcaatcgtccgctaacggtaaatattgatagcacgctttgattaagcggactaaatcttcggtatccagtgcggtcggtgttccgccgccaaaataaaccgctttgattttaccgttaccttggcggatacttgcttcgtacgctaactcttcaatcagtttatcggtatagattttgctatagtcttgtttccacgcattgcggtaaaaaccacagaaaatacaatgactggcacaaaaaggaatatggaaatacgctaaaccgtcttctttgagtgcatgaatagcagcttgtccccatacgttctgccattcttcttgcggcacagcttcaccaccccagatcggcattaatgcctgacgttcagggaatgcttttggagcagcttgggttgtccgccaatttgttgttgtaatcataatcactctctcgatcagtaatagaagaaggggagagttataccgaatctagttgtaaatgatattgatttttatcaacttttgtcaagttaacaggaattattcgcataaaaaaagcagagtattttgctctgctttttcacttacttataaagagttagccttttaaaccttcggcaatacgtaccgcatctacgccggcatttgcttctacacgttgcataaacggagaaagttgctcaaggtgtgagaaatccaatcctaacaggcgacaccaatttaacatgatgtaaagatacacatctgcgaccgaaatattttcaccgaagaaaatatggctttctaaatgctcattggcggtcgctagctgatttaaaatctgttctgccgcttgctgacgaataatacgagttaactcttcattaccttccgcatagctcggtaaacggaataacggtacaaatgatttatgtacatcactattaaaaaaggctaaccaacgagccgctttcgctttatcacgtaaggttttgctaccgaataatttcgcttccggatatttctcatctaaatagtgcaaaatcgcttggttttgtgaaagcgctaaatcgccgtccactaataacggtactgcaccacgtggattcaacgctaaaaattccgctgatttaataaaatcacggctcactagctccgcttgatattccgcacccgtccattctaatgcaacgtggggaacaaatgagcaagcaccttttaaacaataaagtttcatatctttctccaaatcaaatatcctcgaccatgactagccgaggaagtagaaatcttatggcaataatttctctaaacgccataaatccgcaaaacttgcacgtgctttaattaggtgtgcttgatcgccgtcaaccataatttcgaccgcttgcggacgtgaattataggttgaagacatcgctgctccgtaagcacctgccgaacgcattgcaatcagatcaccttgttcaatcgccaattctctacctttacctaaaaagtctgaggtttcacaaatcggaccaactacgtcataaaccgctttttcacgtacaagtgattgatctacctcggtaatttgcatataagcttcataaagcgccggacgaatcatatcgttcataccggtatcaacaatcgcgaaattacgatcttcattcgctttaaggtattccactttagtgactaagatccccgcatttgccgtgatcgcacgacccggctctaaaatgatctcaagatctgcatagccttttaatttttcgagtaatgctttggcatattcggttgggtgcggcggctcttcaccgttatacggcacgcctaaaccaccgcctaaatccaagtgatgcaactcaataccgtcttcttttaattgttccattaacacaatcaggcgatcagtggcatctaaaaacggttgtaattcggttaattgcgaaccgatatggcaatccataccggtaattttcacgtttggtaagcttttcgctaaacgatacacctcacgtgcttgagttacgcttaccccaaatttattttcttttaaaccggtggaaatataagggtgagtatgtgcatccacatctggatttacacgcaatgaaatcggtgcgattttacctaattgaccggcaacttcattaatgcggtgtagctcggcgattgattcgatattaaagcaacgaatgccaacttctaacgcacgctgaatttcactatgtgactttgccacaccggaaaataccactttgctcggctcgccacctgcagcaagcacacgttcaagttcaccttgcgacacaatatcaaagcccgaacccaggcgtgccattacatttaataaagcaatattggaattggatttcaccgcaaaacaaattaagtgcgggtgtgagccaaacgctttatcaaaagcgtgccagtggcgctcaagtgtggcacgagagtagatataagccggtgtaccgtattgattaatgatgtcggagacagaaacatcttccgcaaaaagctgttggtttttatagtcgaaatgattcatttatttacttgtccgttgtgtttgaaaaataaaaccacggcaaaatagctacactcgtatttgcaaaaaatcggataaatttaaccgcttgttacacaggtgcttctcaattgccgtggttagaaattattttgtttgctgttgagccggttgctgctcaggaaaataaagcgggccttttacaccacaagcagccaacccgaacgaagcaaccaaagccactaaaagtaattttttcatgataaatccttgagagtgaattgtctgctgattctaaaacaaattgcggtaatgaaaaagtaaaaaagccgtttcgcctgtttttaaataatcacccaatagccacgcacggcaagccgtacgtggttacgatcagcctacggctgagtgagccacgctgtggctccaaatttctctaagatggcgctcgtctttgacgaatgtttttattttccttatatatcgaccatttacctgaatctattgagagaccaaagctattcgaaaaatcatagcttgttaatatctaaaggaaatccccctctttagtaaagaggggataggggagatttggcagaattaaataacgaagaaaataacagtttaatatttaaaaaacgaaaaaataaatttgattaagataatgttaaattgagtggagtatataaatattgaatggattttaaataagattaaatataaaaggcttattttaaacagacaatttagacataatttcttattctttgttcattaaaaatagtaataatgtggtctaatttcaattatacaaattaataataaaatgaagttgcatattacttaatctaaagttgtgtgcattttagtcattgttgtattgctacattaaggagcattttatgaagaaaacatttttatcaaaagcacttatcgcaattgctgcgtgttcagtctttttctctgctactgctgcaaatgcagaagcaggtaagtggagaaaaacaggcttccactttctcggattatatcaatattgctataccgcatatccttatgattgtatgtggttacgcccataataaaccctaattttatataagagtatgaataaaataagcggtcttatttttcctaaactttgcaagttttaagaaaaatttgaccgcttgttctagaaagataaataaatattaaattattataaccattcagaatataagcgtaatgcattagctaacattgcttcttgcctatgtggtttatcgaaatgcaatgggatcattgacaagaaaagaagtattgttggagcaataatatctttattactaatatttggtaataaagtttttctcataaatacatcttgaattgcttctaagcgagaatcaatattaaagtgtaatttcactcctaatgattctgatttttctaatttaaatgaatccgcaataatgaaatcatataaaccaataaatgagtggcaaagttttgctaaatcataactttggtttccatagattgttaattcttgctgaatatttaatcctctcggatcaataactttaatattattgctacgagagtcatacattacattactgaagcataaatccccgtgtactatagctgggatttcaggtagttttaatgttcttgttacacactcagttgcgatttctctcaaagatggtaaatcaatgccgttatagcgagtcgattgatctagatctataccgctttgttcagcatatttttctaatcgttcataagtcttatctgaatagagtgataaagaatctacgtgtattttctccaatagatctttattttctttaggtaaatgtgctcgagattcactcatataaaatgtaattaaattgagtaccttttcccaaaaagcaacagggtttttcccatgaacgaaaatctcatttagaggaagaattgggagatattctgtctcataaaatggatttcccttaagtacaccagcattgattaattgaggagtaaagcgttttagttgtgcgggcaaattggcaaaccaatgtgcttcagcttcaatttttctagcaggtgtaccagatttccaaacaacgccatttccaatttttaatgaattgaatgctctttgtgtcgtaatagaagaacgagatctaaaataagtattaatatgacctaagtcataccattcattaacctctttatgaatggtatttggttcttccttagcatacatatgcacagattggacaaaatccccctgggttgtagcaagagccttaataaatttttggcttgatgtaaaagagaagtaaccacaccaaacgagtggaatatttgtatttgaatccacttcccattcgtaatcttcttgtgtactaacaagtgcaatgcagtcattttcgagaggaatattatttaggagagtatctccatgaagtaatcttagtacttcttcattatgaccaacagtgttcaatacatagagaacagccatacctaatgatattccttcaggtataaaaacaggctgaatatttaaattctgaattaattctttctcatcaatgcttagtgaataattcataggtaaagaaaccacgatatgttggtcattacctaggttttctcgtaaagcattaacttgaaaggttaatagtttacgattaccaattggtaaaaaacatgggggaatagcgccaaactcattacgaaattcagcattcacgtatgcagcggagttaattagaatcatattcaccatccatttttgttagttttcgaatttcttcgtaactcattgtagcaaattcatctggtctgatagctctatcatcaacataaaagccatcatgtccacaccaaggtttaccaacatagatttcatcatatggcacattatggcgatttagccaatctataataattggtaatgtgttaacattaatttttcccacatttccttcataagtacgcatattacgacttgaactaataataatttcaaagccttgtttcttatattctcgtaatttctcaattacatctaaaattggtttagcattacgataatcaccattctctgttagagtaattgtattatctaaatccattattaagcgcttcatttttcatttcctaataaagtaatatattcatctggtgtgccacaaaataaaatatcttctttttcaataagatcataaagaaccaatccattttgttttatgagatcattataaagaggggctatataatattcattctttgatgttatattattttttcttgcatttaaaaataatgattcaaaaattgatttctttttaaaataatataatccatcactacagagttcagatattctttctttttctgttgtgcgaattacacgtttagaattattttcagcaagagcaaatgaccagtgatcaccttctcccttaaagacttctaaatagccatcgcattcatttacccattctggttttataaattcaataattttagaatcaatattaaatatataaatttcctcatcactaggtaaatggttaataccttgatacacagtatctgcctgccctaaagtttcttctggtaaacagattaattcataatctgagatacctaatttttcgatttcttgctttaggaagtcttgcgtttcatatacatcacgatagataaagataaatttatctgttgtaaagtaacgttcaaaagatcgcacagaccatgaaaatactgtttcattaccaatttctaattggtattttggttttgtataaccggccttaaaaaagcgggaacttaatcctgccatgggaataataaacatattgtatccttttattaaaaattaaaaccaaaaggcgagaagtgatctcgccttttatttattatttagctttatctttgagaaactccattaaccatttagtttcctcagggaatttgtttcgattctcttgagtattatctttttctagggctgctaatagacctggtacttttaaagtttcaccaccaaaaatagttccacaagagaatttacaaggtacaggtcttatatcattttttagcaaccataaccctaataatttatgcgcatcccaatctctgaattcttcaaaaggacttaatctattagctattttcatttttttccataaggatataactcgctcatatacgcttctatttgcataaaagaaaccatcagatataccccatccagcacctgctggaacagctaaagagctattatctaaggcatatagatgttctggagatatagagttagaatttacaatagtatctgctcgtaagcgtataaaataatcatatctaaatccttctatatcttctttcctcttagctaactcaaagcatttatatagcccatagaacatttttatctgattgaatgtttctctagatttgaaattatcatttatatgatgttctcgcataaaattattttcattttcaatcaatatacttttagaaattatattatttttaacctgattaatatcgagtgatgaaaatacagaagataagagacatgagtatacattgctgtagtttttttctaaaaaagataaattttggatatttttaggcactaacgaattacttatattaaatactctaggccaaaagttatatctacgaacatctcccatccaatcttgctgtcgatcccaagtatggataaaaacatcagcatttagagggattgctagtttagtttgaatagtttttaagttggtcaaatctgacttaaacataccactaatacagatagctattcttggtttttctgtatttagcatattcaaattattattatcttgaattaatgaatatactttagacattaatgattttgcaccattttcattatttgagatggcataaattaaaggaataagcctaatatgaatagtatagatatgctttaaatcaaatagctccttagatagatcatgatttttggcaatgaaatctatcatggattttagtaaatatttttttctttgattatttattttgtttgaatttgcaagatggataataatttctcttgatatatctacatctaacctgttcttctcaataagcttatttaacgcaaagttaataatcatattattttctgcagaggtagaagagtttatatgtccacctctataagtggttaatagtgaaaatactttatcaatatttccagtaagagaaaacatatatagtttacaaaagtaatctggattgtttgcgtattcatttagtttcttattaaagaaagaattcaaattacggcagacagaaaaattttcatcatttgataattttttatatagcacaggattggattttatactatctattaatgatttagctatatctaaatgtcccgtgtctgctaaatacctacaatagtttggtatttgatccgaattattatcagagatatatctatgccattctagagcagcatcaaaatcccaattttctaaacagttctctatttgatagtgagtcatatcatattccttattataagatttctaagtataaaatattattttctgataatagtttatatttattttctgtatctgttctaacaatatttctactatcttttagcacagaaactttactaagccctttacttaattgaataccgagtgataattgatatttccctttaggtaatacagatatatctattcccttatattgataagttgtaaaccaagctttatcatatatagttaatgattttccattgaaaaattctcttgtcaatgctggtctgtgagctttagctaaatctaatttaatattagattctcctaattttaatactaaatagtaattaacatcagaatattcaatgagatcatttccttgcaaaaaagatactccttctaaaaataaatgactattaataattttagctacacgtaaatctatgaccatttcatttgtaggatttttatcactaaataataaacgtccaaagaaattcacctctccaccactataagtagggatagcatcggttgctaatgcataataaatacttaataacaatggaacatgatgactagtaacctgattatgttctctaacaaaagctgaatgtgtttttaataaattaaagttagtatatttttggaaaaagcttaaatatggaacaatttccgttgaatactgtacatctttttcagatgttagtagatagatattacgtgaaagaaaagtatcctgacataatagtttatataggatattatctaaataattcttatctactattgtatagtttttgcccatcatatgggatgctacttgtttccaattgttttcaatataactaccaattttcatttgaggaacactaactacaatattagaaaaatttaatttaagcccataatataaagcagcactccctcctttggaaaatcctgttagagtagcctgattcttattcaatcctaactcagatattttgctatatataaattcggtgatcgcttcttccactttaaaatccatattaatacacatgtaatatgtgtacattttttcaaactcatcatttatccaaatgatatcgcaagggcaatcatttaatgcattagaaaaatcatagtttccaggtgatgcgtttaagaaacctgaaaatacaaaaatgacgtgattgaaatcatatttggattttttatgcttatatttaactactatattatttgtagcattaaagttcatttctttcatttaattaatgtcctattttgattaaattattattaataatttatttttgtaatttattctttgattagatatattttcttttgctttcttctggaagatattctaaagaaaatttaaagaccttatttaactgatcgatacattttttataatctgcgcgttcatatgctaagtgagaaatttctatcctacatctagagcaatctttagtatgtttttcaaaagcaactagcatattatgggcttcattatatctttttaaatgcctatatgatttagctaataatagttgtggctcatatttttttagttcctctttagtaaacatggatatttttttacttaataagaatattacattttcccaatttttttgactcgcagatacataggctaaaataattgggtataaattttcattgaccttattaagcatcttaatagatattttttttgcgttgaaaaagtcatataaattagaataagagtataaaagcatgaataaatcaggttcagggctttgacttaataattctaaggccttctcatgttgatgagtttcatagtaaagcgataggattatatcgctatatttattattaggtataaatttttctatctcattaaaatgcctaatttttattattgatgctagataaattctagttacccattctttatcttcttctctaattaaatttaatttagataaataatttactctattatagattacaccccaagcttcattctggtatgctttttttatggattccaatataatttcgtaacaaaacttttgctcatctggtatatttgaatctagcttaactatagcttcatagactcttttgcaattatcttgatctctatgaataaaggtgtttctaattctagaggagtagatataatcaaaattatcagatttattaattaagaatctttctaaaatagcatttagttcatcttctgttcttgctacaggtccaaaaccatgcttgtcatattcaaaatatccttttctatatgtatgcgagccagaaaaaacttctttctcgtcaaattgataataaatggtatatttttctaggtaagccatatcaaatgcaactgatgaataatcagtaattagcatcattccttcttggaataatttttgaatatttccttctgaataacgccatgtattaatgtatttgggaatagtaaatacatccaaatattcttgaatattaggatgaggagcaaatattatattatatccatattgattaactagtttttttaccatatctccatttaagaaattatgccaatgcttagcataatttgtttccataaaatctgaattgaagtttcgtttagaaccatttactgaattacctataatattttgtcgccaagttggcataactaaaatatttttagtattgaaagtatttttagataataaggaatcatatcttggaaaacctaagaattttacttctttttttgtaaatcgatatggagaaccatcttcactaatagagttatattcatcttttgttgttgtaataaaaatagatatattttctttcgtatttaaccaaggggacatatcatcttttgttactccatgttgtagaaatatataatctttatctaataaactattgtcaccaaagtaatgagtaatatacccatctatatggctactaataattttactgcaattttttaatttattttcaaattctttagatttaaattctagtaatttgaacccttctttatttaatctatcccagtcttttgagtttttatttaaagcaaaatatatatctttttcaggatggttattcatcacatatctatataaatgttctgcattatcatcagcttgattatctctgtctataaagatccaactattttcttttttagttgatttactctgataaaactctcgcacaactttcatcgataaagtgttataccattttccattaaaagataattttgctattttaccatttagtaaaatagaaagatttcctagctcttgaacatttagccaaattctatattcatttgtaaagcgttcgtttaaaaagttataatgaatatcttttttaaagctaggcattctatcttctccgttaataagtagcgaatagtttgcgtcctggtacgagaagaagctaattagtacttgattttttattaaatcaaattttttgatataggcaatctggaaactaggttcagcttttttgaatagccctaaaaatcccactttatgataaaaccaagcccctcctaagttaaatttttctatagtacttttgtctattttattaaatattctatgaacaatttgtgagaattctagtttttcatattctgttaaatgagatagagcattctcattgttaacgattctcccaaaataccaatataaatgataaagtactgatcgttgaatatatgtcggaattttaccaaattgctgttctgctgattctagaatagagaggcagccatgctttaataccttactaaatagatttttattttgccacgcgccatctagggttgagctaccatcttctcgtttacggtaaaaatactgaatatcagaaataaatcctactttcccaataattctatttgttattagataatccattacaaatttagcgtcttcaaatgagggtttcatttcctcatcgaatttaatattatttattaatctagttttaaatagagcagtgctggcagatagctgaatgaaattctctagatcatttgttggaaaaattttattaccattagagaatctgtattttaatggatgagtatctttatagatttttttatcttcaaaataaaatattaacggaattccaactaagactaactcgttattcatgcttaagaaattatctagctctctaaagtagttgttgctaataaaatcatccggatcaataaaggtaacccattctgtttgtacgtattttagtcctaaattacgagcagaggcttgcccaccattttctttataataatagtggatattatttggatattttttttgccattttttgatgatgtttgctgatgaatcttttgagccgtcatcaactaagataatctgtatgtgttttttaaatgataaattttgtttaacgatactatcaaagaaatcatcaagatatttttctacattatatacagcggaaacaatcgtaaattgatgttttccttcatatttaacaggtaaatgtttttttatttttatagaatgtttgaaatacatatcactaaaaaacaacttaggatcacgtagtaattttctaaatttacgttttactttattcattatattatccttaactgtaataggagtttaaaaaagaaaacaattgattttgatagttgttaatacttttttgactattaaaatcatttgcgcaaaatgaattaggctgttcgcctatgttttttttatttaaaagttttttatattgtgtaagtgcatttggagatctaatattaaaataataacaaatatctattttaggcattgctttcccttcgaaatacattaaccaaggaataagaaagtttgcaaaatttaaatcgtgatttgttcttaatttattgggtaaaaatccaagaatttctttctcataacgctgccatgccaattcatacatactttttttcaatgggatataagtgtgtacgagtggtgagtcaatatttgtgttgtaatatttgtttagtaagcgaatactatattccgaagcagaaagagtcggtgtaatagtgcctctatcacgcatttgagtgaggcttttttccgacataaatatagaggcaatgccatttgcttggaaaaagtgttcagcttgtagttctcgtgcaataaagacatcatcattaaaatagataaaattctcgcttaaattaggaattttatgtagaaatgcttcaattacatgtgaattaaatgtaggaagatattctttatctataatatcctgatggctaattaacgtaattttttcttggtaagcctcatccaaccactttggcttttgattatctgttacaataaatatatgtctgacccaaggcataaatttaagtacagcatgtactgaataatataattcattatgatcttcaaatcgggcgatatctgttgcatacagagcagaatttgcttggtaatttggagcatactgatgatatttggattgccatagtggatcagatccatctacccaagtaaataccacgtcaatatcagactgacggagagtattcttttgaataatcttatctagcttttgatgtgcttcgattagattcgcttcttcagactccgcaaatggtagttctgtattttttatagggtattttttgtttagaaaatccctaaaaaaaatatgtggattttttagtaacttagaaaattttctattcattttgttcattatattatcgattatattttatataaattttggattataatgcttatctgcagggctctcctcttaatttactttctttgcaaatgatttgtttttatacatcttggttcttttatgtaaattttttatatttaatttctcttgattaggtaacttattaaaatcaatatttatgtagattttaaggtgtaccctattatgggtatttttccttaatatattgaagagatattagatgaaacccatcaaatttagattactcctttctgggctggttgccagtttagctgcctgctcaagcttacccacttcaggccctagccatagtgcgattttagaggctaattcccagaattcagataaacctttaccggaagttaatttagtggagttagataatggcttagttcagcagttgtatcagactcagcaaagtcagcaattttccggctttttaggcacggctggcggtgctggatatgccggtgcggtcaatgtaggggacgtgcttgaaatttcgatttgggaagcgccgccggcagtgttgtttggcggtactttcagttctgaagggcagggtagtgggcatttaacccaattaccggcgcaaatggttaaccaaaacggtacggttactgtgccgtttgtcggcaatattcgtgtagcgggtaaaacaccggaagcgattcagtctcaaattgtcggtgcgttgcagcgtaaggcaaatcagccgcaggtattagttaaaatagccaataataactctgcggatgtgacggttattcgtcagggcaacagtattcgtatgccgttaactgcaaataatgagcgtgtgttagatgcggtggcagcggtaggcgggacaacggaaaacattgaagatgtgacggttaaattaactcgtggctctcaagtaaaaacgttggcgtttgaaaccttaatttctgatccggcacaaaatattatgttacgtgccggcgatgtggtttcgctgttgaatacaccttatagctttaccggtttaggtgcagtgggtaataaccagcaaatgaaattctccagtaagggtattacgcttgccgaggctatcggtaagatgggcggtttaattgatacccgttcggatccgagaggggtatttgtgtttcgccatgtgccttttgcccagttgagtttagatcaacaagcacaatgggaggcaaaaggttatggtatcggcatggatgtgccgacggtttatcgtgtgaatttactcgagccgcaatcaatgtttttattacagcgtttcccaatgcaggataaagatattgtgtatgtttcgaatgcaccattgtctgagttccaaaaattcttaagaatgattttctcagtaacatcaccgattacgagtactactaacagtattcgtagctattaattgcggtcaatagaccttataacgataaatctatttagaggaaaggataatggtagcgattaccgcagaaaaaccgaataaacctaagaaaaaaagcttattaagaaagttaaatccattgctttggttaacggttatttttccaacattattttcagccatttattttgggctgtttgcttcggatatttatgtttccgaatcaagttttgtggtgcgttcgccacgtaatcagtcttcgctttcgggcgtgggagcgttgttacaaggaacaggttttactcgttcgcaagacgacacgtattcagtgcaagaatatatgcgttctcgtacggcattagaacaattacaaaccgaattaccggttcgtgatttctatgcaacaaaaggcgatattctgagccgttttaacggtttcggtttaaatgatacgcaagaggcgtttttccgctattttaaagatcgtttaagcattgatgtggattccgtatcagggattgcgactttacgtgtacaagcgtttgaagcgagtgaggggcagcagttaaatgagaaattgttaagactgggtgaagacttgattaaccgtttaaatgctcgaggtcgtaaagatacgctcgagtttgctgctcaagcggtgcaagaagcggaaaaaaatgttaatgaaactgcggaagcgttaagtaaatatcgtatcaaaaataaaatttttgatctgccggcacaatcgggcgtacagctttctttaatttcgagtctgaaaagtgaactgattcgtgtggaaacgcaattggcgcagttgcagtcaattacaccagataaccctcaggttgatgcactactgatgcgccaaaaaagtttacgtaaagaaattgatgagcagtcaaaacagctttcgggtaatacgggtagctcggttgcgaatcaatcggcggattatcagcgtttagtgttagctaatgaattagcgcagcaacaactgaccgcagcaatggcatcattacataacacccgaggcgaagccgaccgtcagcaactttatttagaagttatcagtcaaccaagtaaaccggactgggctttggcaccaagccgtttatataacattattgcgacttttattatcggtttaatgttatatggaattttcggtttattaatcacaagtgtgagagagcataaaaactaatgcaatatggtgaccaaacaacgtttcgacaatcgttagccattcaggggcgtgtgatttatgcgctgttgatgcgggagattattacccgctatgggcgtaagaacttaggctttttatggttgtttattgagccgttgctattaacatttttgattgtgttaatgtggaagtttttccgagcggataaggtttctacgttaaatattgtagcgtttacgattaccggctatccgatggcaatgatgtggcgaaatgtatcaaatcgagcaattggctcaatttccgctaacttaagccttctatatcaccgtaacgtacgggtattagatacgatttttgctcgtatgttattggaagttgccggtgcgactgttgcccagattcttataacggcggttttagtttttatcggctggatagatccgccgaaagatgtgttttacatggtgctggcttggactttaatggcattttttgcctttgggttaggtctgattatttgttcgttagcacaaaagattgaggtgtttggcaaaatttggaacacgttaagttttgtattattaccgctgtccggtgcatttttcttcgtacattcactaccatcacaaattcgtgaaattgcccaatgggtgccgatgattagtggtacggaaatgtttcgtcacggctattttggcgatttagtcccaacgtatgaaaatatcggttttttagtagtatgcgatttggcaatgctgttattggggctgattctcgtgcgaaacttcagtaaaggaattgaaccgcaatgatcagtgtaaaagatgtgagcaagcgctatcatactaatagcggttggaaaaccgtgttacagaatatcaattttgacctgcataaaggcgaaaaaatcggtattctggggcgtaacggtgcaggtaagtcaaccttaattcgcttaatgagcggtgttgagccaccaacaaccggtacgattgaacgccatatgtcgatttcttggccgcttgcgtttagtggagcatttcaaggcagtttaaccggtatggataacctgcgttttatttgtcggatttataatgctgatttcgattatgtgaaagcatttaccgaagagttctccgagcttggcgattatttatatgagccggttaagaaatattcctccggtatgaaagcccgactggcttttgctttgtcgctttcggtggagtttgattgctacttaattgatgaagtgattgcggtaggtgactctcgttttgcggcaaaatgtaagcatgagttatttgagaagcgtaaagaccgttcgattattttagtttcgcatagcccgtctgcaatgaaggaatattgcgataatgcaatggtgcttgataagggcattatgcataaattcgaaaatatggatgaggcttataagttttataatgccacgcaatagctcttagctaaccccacgcacggcgagccgtacgtggttatgatcagcctacggctgagtgagccacgctgtggctttcaatctttcctcgttgttattttatctatggcgaataccttttaaatgatcaccctctccccttgtgggagagggacagatttttcttcgtttagaagaaaaagcagggagaggggggaaatgtgaaaaagctaatttaaagccatctgtacgtatcgataaccaccattctcttgcggaacaaattcaaataaatgcgtaatgcaatttggggcgtccgcatcttgatgcgaaacaaatagcaacagggtttgactattagtcacaagctgttcgataaactgtttaactaatttgcggtttacgccgtccaaaccttgcagcggttcgtctaaaatcaaaatcggcggatgttttaccatagctcgagtaatcaataataaacgttgttgcccccatgaaagtgaacggaacggttttttcgccagattagctaaatgcaagcgttctagccattccattgcttttagctgtaaggcacttggcacttgttggtaaacgccgattgaatcaaaaaagccggataaaattacgtctaacgcagagcaattcacccgataatccatatgtaattggctgctcacatagccgatatttttcttaatatcccaaatcgtttcgcccgaaccacgctgacgtccgaataaatgtacgtaattagcataggcttgcggatggtcaccggtaataatcgaaagcaaggtcgatttgccggctccgttcggacctttaatccaccaatgttgcttcggcgcaaccgtccaagttaagtcatcaataatggttttatcgccgtaacgaatcatcacgttttttagttcgaacggattggtattcggtgggagttgaatcagcggtgcagcactgcccggtaacggtgcattcacattctgttctgcaaattttagctgagaatagaccgcttgttgctcaatcgcttggcgttcgccttgtaaaatcagttgcagattatctaacaaagcaatatgcgtggcacagtccgggatgtcgttaaagcggttagaaatcagaaccaccgccatttgctttccgagttgcgccataacgtcttgccaataagcgaccgaggcttggtctaacccttcgaaaggctcatctagaatcaataaatccggttcactaaccaacatttggcaaaataacactttgcggctttcgccggtggagagctgaataaacgggcaatctaataacagctgaatacgtaatttagccgcatattcctcgcataattgcgttttttcgctaccgtttaagataatttgacgggcagtcaatccgaaatcatccggtgaaaccatatcgttgttacggtgtttaaagatttgctcgatgattttttgttgctgctcgaaggaaagtaaagcgatatggtggaaattgttttgatattcgcccgaatatagtgaaagtgaattatgtagtgcttgggcgaaggcggttttgcccgagccgttaccgccgacaattacccaaaaatcgtgagtattgatttccagtgattcaatcgacagtttattgtgttgagcaagggaaaataaggcgttatggatgttgatgtttggcatattgtgttcctgttatgacggaaaacacaacgctaatggaataattatgctaagtgtgtgcgttatgttttccggtatcagagagtttttatatttttagagttgtttgcctactgcaaaccaatcggcacgtccgttaaggaagtcttgcacggacattggttttttaccggaaggttgtaattgagtgatatttaacacaccgtcttgcgttgcaatttgaataccatttttatccgcttgtaatactgtaccggcaaccttagcttgatgtggtaacacattcgcttgatacactttcacgctttgttctacgccgtccacctctaacgtgaggaaactaatcggccatgggttaaacgctcgaatattgcgttccagctgacaagcggtcaaattccagtctaattttgcttcttcttttgagagtttttccgcatagttggaaagcgcttcatcttgtttttccgctttaaatgcttggctttctaaaccgtttaacacctctaataacgccggcggtgcaagttcggctaatttggcatataacgaagcggaggtttcgtctgcggcaatcggtgtggtaactttgtgtaacatatcgccggtatctaagccgatatccatttgcataatggtcacgccggtttcctgatcgcccgcccaaatcgaacgttgaatcggtgccgcaccacgccagcgtggtaacagtgaaccatgtacatttaaacaaccgtatttcggcgcattcagtaccgcttccggtaagattaaaccgtaggctaccactaccatcacatcggcattcagtgcttttaattccgcttgtgcttcttctttacgtaaggattttggttgatataccggaatgttatgttgttcggctaattgttttactgggctggcttgcagttttttacctctgccggcaggtttgtccggttgggtataaaccgcaattacattatgttctgaatctaataatgcttgtaagtgttgtgcggcaaaatcaggtgtgccggcaaaaataatattaagttttgacataatttttcgttgataagtgaatggataacggaattgtaacagaagaaatgcagcagctgtgttttgtgcgaaatatttttaaccacagaaaacacggattgcacagaaagatagtgacagtctccctgatagataattgattgatatatgagaaaaataaaggtacttgccaaatacgagaagcatcgcaaagaagatttagagccacagcctgactcactcagctgaaagctgatcgtaacacgaagaaaaatctcgtcctctcccacaagggggagagggtgatcatttaaacggtactcgtcattggcaattataaccaaccacgctctttataatatttcgcagcgcctgaatgaagtggggcggagagggcgtttttgaccatttccgtttcggataaatgagcaaatgccggatgtgattttttgaagcgatcaaagttttcaaataccgcttttactactcggtaaacttgttcctcactcacatcgcttgaagtcactaaagttgcataaaccccgaaagaatcgaccgcttgttcaacacctttataaacttttgctggaatcgtcgctttcgcgtaatagccttgttccgctactaatttgctcaccacttcatcagccaccggaatcaagcgaatatcacaactattcgcggtttctttgagtgcagcattcgggtgaccgacattatagctaatcgcatccacatctttttcgcataatgcgttacccatttcagccggtgtgagttttaacgcttctttgaaattcgcttcagtccagcctttggtttttagtaatacattcatcgttgcttgtgtaccggaaccgtccacgccgacattgacttttttaccttgtaaatcatcgaccgattgaatagcggaatcgttgcgtactactaaggtaaacggctcgggataaattgagaaaatcgctcgtagtttgtcgttctgtttgccttcaaatgaactggtgccgtgataagcatgatattgccaatccgactgcacaatgcccatttctaactgactgtttgcaattttattcaaattatcgaccgaagcatcgctggcaagcgctttacaagcggtgtgattttcactgcgatttacaaattggcaaatcgcattgccggccacgaaataaagtccggtgtcactgcctgtgcctaatttaatttgggtttgttccgcctgtgcgaagcctgcaagtagcatggtggctaagaatgagagttttggtgggattttcatggaaatttcctcaaaatagaatggtgtttgccggttgaagatatccttttttgtacaatatatgcaacttttttctccattttttaaccgcaagcggtcaaaaatcgccaatttcttgcaattagggtatgatctaatcttttatttgagcatgatgacatatggaatactttatccctcaacagccggtaatttttgaggaagaaatcaaaaagagtcgatttatcacatacttacgtcatacggaaggtatggaacaggcgaaagcgttttgggcggaaatgaaaatgcttcatcctcaagcacgccattggtgctgggccacggtggcgggaatgccgaatgattcgcaacaatacggtttttcggatgacggtgagccttccggtactgccggtaaaccgatgctaaattatttattaggttcagggctgggtgaaattaccgcagttgtggtgcgctattacggcggtattcaattaggtaccggtggtttggttaaagcatacggtggcggcgtgcaacaggcgttattgcaagtggaaaaacagcgcaaagtattgcgccaaaattaccgcttggtatgcgaatacgatcaattcaacaccgtgcaacatttgctgaatagctacgatattgagttgcttgagcagcattttaccgaggtaattgagttgaatttggcgattaatccggcagatattgcgccgctaagtgaacaattgacgcaacgtttctccggtaagttgcagcttaacaaactggattaatttatgtatgggcgcttttttgctaaaatcccgccttatttaaccgcttatagaaacactttgagggctttgtgcagtttttaactattatccgcattgtcggaattttggtaatgagcttttcggttacgatgcttttaccggcgtttgtcgcactgatttatggtgatggtggcggtcgagaatttttacaatcgttcctactcacattttcggttggcgcacttttatggtggttttgccgagatcgaaaagaagaactccgctcacgggaaggttttttaatcgtggtcttgttctgggtggtactgggctcattaggggcagtaccttttattattttagagcacccgaatttaaatattagtgaatcgattttcgaatcgttttcgggacttaccaccaccggcgcaacggtgatcaccggtttggacagcttgccgaaagcgattttgttctatcgccaattcctgcaatggttgggcggtatggggatcatcgtattagcgattgcgattattccgttgattggtttgggtaaattatatcgcgccgaaatgccggggccgttaaaagaccaaaaaatgcgccctcggattgcggaaatttccaagttactttggcagatttatttcactttaaccatcttatgtacccttgcatttaaaatggcggggatgacatggtttgatgcgatttgccatagttttgctacgatttccatcggtggtttttcaacgcatgatgcaagtatgggctactttaacagtggtgcaattaatctgatcactgtggtgtttttattgatttcgtcttgtaacttcgggttacattttgccttaatcgatcgccttaaagataaaaatagtaaacgttccggtaatctgtttaagcgcttatattggaaggattatgagttccgttcgtttacctttattcagcttggcttatttctagtttgtttggcaattttgagcggttataactattttgaagattcgcagatgactttccagcaagcactgttccaatcggtctcgatttcaaccacagccggttttaccaccaatgatttcagccaatggccgtcatttttaccgatcttattggtgatggcgtcatttatcggtggttgtgccggctcaaccggtggcggcttgaaagtgattcgtgtgatgttactgtatttgcaagctaatcgagaaattcaccgtttcgtacacccaaattcggttaaaccgatcaagttaggtacgcatattttttcagatcgtattgaggaagggatttgggcgtttttctctgcttatgtgtttgtgtttattatgtgttggcttggcagtatcgcctttggtatggaaacttttgatgcatttaatgcggtgatcgcctcattaaataatttgggaccggcactaggcagcgtaagcagtaactttacccaagtaccggacggcgctaaatgggtgctgacgattgcgatggtttgcgggcgtttagaagtatttaccttattagtaattctaagtccggtgttttggaaagattaatcataaaaacggaatgaataaatgaaaaccctaattctctattttacgacggacgggcagacagagcgcattgcgcaggcgattgctgctgaaattgagcatgaagtggaattggtttcacttaagcaacaagcggtcgattttaccgaaaaacttgcaagtgccgatcaaattgtaattggtgcttcgattcgatacggacattttgatcaaacggtgtataagtttattgagcggtatcatccactgcttaaccaaaagccttctgcatttttcagcgtgaatctgactgcgcgtaaagagaatcgaaagacaccggagaccaacgtttatactcgtaagtttctcgctagaattaaatggaagccgacaaaagtggaagtgattgccggtgcgttgttatatcctcgctatacgttatttgatcgcctttgtattcagttaattatgaaattaactaaaggcgaaacggacgcaagtcgagaatatgaatatacaaattggcaacaagttgcgcaatttggacaaatgttaaacaaactcagatgagtgtaaatttagttaaatatgttaatcggattttaacgtttgctttataatcgcccgccattgcctaatggtgggcatagagtgttttattttcaaaggaaaagcaaatgagtatcttaaaagagtttcgtgaattcgccgttaaaggtaacgtagttgatatggctgtcggtgtgatcatcggtggtgcattcggtaaaatcgtatcttcattagtaagcgatgtagtaatgccacctatcggttggttaattggcggcgtagattttaaagatcttgcggttgaaatcgcaccagcaaaagaaggtgctgaagcggtaatgttaaaatacggcgcattcatccaaaacgtatttgatttcttaattattgcaatcgcagtattcggtatggttaaagtgatcaacaaacttaaaaaaccagcagaagctgcaccggctgaaccatcagcagaagaaaaattattaacagaaatccgtgatttattgaaaaaataattcggataaaaaagagggagcgtaagctcactttacctaaggaataaaaaatagcgagtagattactcgctatttttttagggttacggattgatacgatttaactcgtattttaataacacaattgctccaccgattagcaagaagtctttgaaaataaagctattaaagccgagttggaataacaaactaagcgtcacgacaccggtacctaataaacctaatgcaccgataattcccgctcttggtgagaaaattcctgcaaataagcttaggtaagtaatcccttcaattgtccctaatacatagcttgtgccatagaaaccaaaccaatcatataaaaaacttaaccagctatttgaaatcaacggcttgagtgcctccacctcaaaatcaaaccatttaaataccccgaaagtcgcaaatacaataaaaagcgataaacgtaagatcagaatatcaatatcagatttttgaaaacgacgaagtaagttgtgcataatgtctccttataaataattatgatacttataagggacgcaagaatagctaggctcttacacggaaatttgcaagtgccattatagagaaatttagagccacagcgtgactcactcagccttaggctgatcgtaaccacgtacggctccgtgcgtgggcaataagcgtttccctctctccctgatttttcttctgtacgaagaaaaatctgtccttctcccacaaggggggagggtgattatttactaaggtgcttgtataggcaaacgccattgtaggcgttcactagatatatatgaaaagcggtcaaaatccgcaaaaaatttgcaaattttgaccgcttgttatccgttaattaaagaataaaacgacttaaatcttcattctcaactacgtcatttaacgcatcttgtacgtatttctcatcaattacaattttctcgcctgagcgttcgcttgcgtcgaatgagataccgtccatcaggcgttctaacactgtatgtaaacggcgagcgccgatattttcggttttttcgtttacacggaatgccgattcggcgattttgctgataccgtctttggtgaattcaatttccaccccttcagttttcattaactcacgatattgtaacgttaatgaagcgttcggttcggtgaggatacgctcgaaatcttctttagtcagtgattttaattcaacacgaattggtaaacgaccttgtaattccggtaataaatctgacgggcgagctacttggaatgcacctgaacagataaataaaatatggtcggtttttaccataccgtgtttagtattgaccgtagaaccttcgataatcggtagtaaatcacgttgtacaccttcacgagaaacatcgccaccagagtgttcgccttttttacagattttgtcgatctcatcaataaatacgataccgtgttgttcaaccgcttcaatcgcttgttgttttagctcttccggatttaccagttttgccgcttcttcatccaccatcactttcaacgcatctttgattttcattttgcgttttttggttttgttcggcgacataccttcaaataacgattgaagttgcgaagtcatttcttccatacccggcggtgtcataatttctacgctcacttgtgccgcaacatcgatttcgatttctttgtcatcaagctgaccttcacgcaattttttgcggaatacttggcgggttgagttgttatcgctttcttgtacgttaccccattgatcttttgctggcggcaataacacatctaaaatacgatcttctgccgcatcctgcgcacgcatacggtttttctcgaccgcttgtgatttaactaatttcaccgctacatcggtcagatctttgataatcgaatcgacttctttaccgacataacccacttcggtgaatttagttgcttccactttaataaaaggtgcgttagctaattttgctaaacggcgtgcgatttcggttttacccacaccggtcgggccgatcatcagaatgtttttaggcgtgacttcttggcggagatcttccggtaattgcattcttctccaacggttacgtagggcaattgccaccgcacgttttgcttcgttttgtccgataatatgcgcgtctaattccgacacaatttcacgaggggtcattgacatattttttgttccttctaaataactcccctctttagcaaagaggggcagggggagatttggcagaatagcattacgctcatacgaaaatttgaccttgtcatcaaatctcccctaacccctcttttctaaagagggggacatttttttaaacttcttcgattacgtgattatgatttgagtaaatatcaatatcaccggcgatttttaatgcttccgccacgatttcttttgcagataaattattttgcgtgcgaagtagtgcaagtgctgcggcttttgcataattaccgccggagccgattgctaacacatcttgttccggctcaattacatcgcccgagcctgaaactaataaaaattcgctttcgtttgctacaatcatcatcgcttctaattttcgtagtgaacgttcggtacgccattcttttgctaattccaccgcagatttgattaagtgaccttggtgtaattctaattttttctcgaataaatcacgtaagataaacgcatcggcagttgaacctgcaaagccggttaccactttatctttgtacatacggcgcactttgcgtaccgtgcctttttctacacaattacctagcgttgcttgtccgtcaccaccgatagcgactttgccatctttacgaacacatacgatcgttgtcatattaaatccttgtcctttcttttagggaaaactgtggtgttaaatggggggaaatttgtctttttcaaggacaagcggtcagatttcacaagaaaattgcaaattcatcgccactggtttgtcttgtgctaattcgatctgggctttatacgccaacacttttaccccggtttttttcgcttgttcaaataaagcagcatattgtggatcaatctgttttgccacggcaaaacgttggataccggtatgtaaaattgcaaaaaatataaccgcttgttgcccagattcagcaatctcagccagttctcgcaagtgtttttgtcctcgttctgttttggcatcagggaacatccccaaaccgttttcagtaagtaaggtggtggattttacttctacaaaacagtcgggctgattgtccgcttttagtaaaaaatcaatgcggctgttttccgagccgtatttttgttcgggtaatatagtttgatacttggcgagttcggtgatccaacgcttttctaaggcctcttgcaccagctgattagctcgttgagtattcacacaaataaaatcgcccgcttgagtttgggtcagttcccaagtgtaagcatatttgcgtttcggattatcggaagtggaaaaccaaacgatatcgccggtagtggcacagccggtcattgcaccggtgttcggacaatgtagggtaatttgctcgccgttgggcagcagaatatcggctaaaaaacgtttataacgtttgattaatatgccgcaagaaagagaaggaaattgcataatagtctttgatttataaagaaaaaaaccgctttttgcaaagcggtttttgtgtcaagctgattaacggttggtcaggttgttattacctgactggcgggtcaggtaataacttaatctcgatcagctttgtttaacaatctgatataaggagaacgagaaatgaaagcattttggcttatcattatctttttagtgttattacttgtttgctcaccagcgcagtaataacctaaaaccaactacacggcaggtattcacttgccgtgttcttactataagtcgagttgcttaaattttcaacccttaaatttcataaaattctaacggtaaaccgtccggatctttaaagaaagtgaagcgtttaccggtcaaatcatcaattcgaatcggttcacattccaccgcattttttgctaaaaattcgaccgcttgttgcacatctttcacacgaaacgctaaatggcgcaagccgcaggcttctggcgtattcggtcgcttaggcggattcgggaagctaaataattcaatttgcgagccgtcggcaaaacgaagatcgagcttatagctttcacgtgctgcacggtaagtttcttcaataatttccgcaccgagaatttgcgtataaaaatgtttggatttggcataatcaccggcaataatcgccacatgatgaaagccgagaatgggtgttagcataaatttccttgtaaaagttttgcaaaaaaactgttaaatatgaccgcttaggttatgatgcacggcttgatattattttgatattaaaaggcttcgagtgaaaacaaaattacagtttcctttagcacaatctgatccggctcagccgtttgccaaagcagtattagcttggtttgcacagtatgggcgtaaacatttaccttggcaacaaaataaaaccttatatggtgtttggttgtcggaagtgatgttacaacaaacccaagttgttacagttattccatattttgaacgttttattgaacgttttccaacggtgacagacttagctgatgcacatattgatgaagttttgcatttgtggacaggattaggttattacgcacgcgccagaaatttgcataaagccgcacaacaaattcgagatcaattcggtggtgaatttccgaccgattttgatgatgttttggcgctttcaggtgttgggcgtagtacggcgggtgcgattttatcgtccgtgttaaatgcaccgcatccgattttagacggtaatgtaaaacgggtgctttctcgtgcatttgcggtggaaggctggagcggtgaaaaaagcgtagaaaataaattgtggcaattaactgcaagtgttacgccgaacagccaagttgccgattttaatcaggcgatgatggatctcggagctatggtatgtactcgcagcaaaccgaaatgctcgctatgcccattagtgaatttatgcgaagcgaatcggcttgaagcatgggataaatttccggcaaaaaaaccgaagaaagtgttgccggaacgacaggcttattttttgattatcaaatcgggcagcaagattttattggaacagcgtgaagcaaaagggctttggggcggattatacgtgtttccgcagtttgaagatgcggatacgcttaagcgctcactttccgaacagagtttgcaaatttcccagcagttaatcgcatttcgccacacatttagccattttcatttggatattaccccgattttggtagatctggatttgcaaaaaaatgctaaaaatcaaccgcttgtcgtacaagaaaattgcggaaattatcgcctttcagtatcttcaaccgctaattattggtatgatttacaattaccgagcgaaataggtttggcaacgcccgtaaaacgtattttggacgaactcagtttaacgctaactagcactaataaggaataaaaaatggctcgtattgtattttgtgagtatttaaaacaagaagctgaaggcttagattttcaattatatccaggcgaattgggtaagcgtatttttgattctattagtaaacaagcgtggtcggaatggattaaaaaacaaactatgctcgtgaatgagaaaaagttaagcatgatgaacccagaacaccgtaaattgctagaaacagaaatggtaaatttcttgtttgaaggcaaagaggttcagattgatggttatgttcctgtcgaacagaagtaataaggcattgatttttaatgaaaaaatatactaagtatttaccgttgttgttggtaattccgttcttagccgcttgtggtagcagtaccaaaaaagtgaaaagaactaaaacgaaagttgattacaccaaagacactaacggtttagatattttaaccggacaattctcgcataatattgatgatatttggggaagtaacgagcttttagtcgcaagtaaaaaagattacgtaaaatatacggataagttttacactcgtagccacatttctttcgaagacggtcaaattacgattgaaactttgggcgatcaaaatcacttacgtaatagtattattcacaccttattaatgggatcagaccctaaggggatcgacttatttgcttccggtgatgcgccgattagcagcaatcctttccttgccggtcaggtgaacgaccaattcggacgtgatattaataatgttgctattgccaatgactttgcgacctatttaattcaaaataaattacaaactcgccgtcttcaaaatggtagaacagtgacttatgtaactattaaaatggtagcaggacatattgaagtgcgtgcacgccaatatttgccgttggtacgtaaaatggcgaaacgctacggcatcgaaccgagcctgattttaggtattatggaagttgaatcggcattcaacccgtatgcggtaagttatgcgaatgcgatcggtttgatgcaggttgtgcctcgtactgccggacgtgatatttttgctcgtaaaggatttggtggtcagcctgatcgcgcttatttgtataatccgacacagaatattgatgcagggacgttatacttaaccattttacgggatgaatatttagacggtatcaccaatccggtggcaaaacgttatgcaatgatctccgcttataacagcggtgcgggagcagtgcttaaagtatttgattatgataaatatgatgcgattgatcgtatcaatgatttatctccggatgcggtttatcgtattttgacaaccgcgcacccttcaagccaagcaagaaattatttgaagaaagtaacgaaagcgcgagaaaaatatttacacgttcgataatttgttgttttttaaagcaaaaagtacaaaaaaagcacgtttaaaccaagttttttaaatttttaaaaaaagtgtttgacgaagtggggtgaaatcagcataatgcaccccgcaacaagacgttgcctcgatagctcagtcggtagagcaggggattgaaaatccccgtgtcggtggttcgattccgcctcgaggcaccatctattcctccttagttcagtcggtagaacggtggactgttaatccatatgtcgcaggttcgagtcccgcaggaggagccatatttcgaagccctgatgattttcattagggcttcactttattagcaatttgcttttgctagcttttcaaaaagttatcttggagagcttgacgctgagttaaaataattgcataataaactctcgcaatcaacgagatgcctcgatagctcagtcggtagagcaggggattgaaaatccccgtgtcggtggttcgattccgcctcgaggcaccattaattgcaaaaattcaattcctccttagttcagtcggtagaacggtggactgttaatccatatgtcgcaggttcgagtcccgcaggaggagccatattcagaaaccctgatagctaaataactatcagggtttcgctttttctagaggctgaaaagcgcattttctatatgctaagtgccattgttgaaattttgtgatctctctccaatttttgaaaaaaacttgaaatttcccttcgcaaaattgtgtgagacagagtatcattagcgaaacaataaaaatgattcctcgaatatcgtcaattttgcgacatcacttttaatacgagtgatgtcgcattttttatacctgaaaatccaccttttatcctgtcataaaggtggattttttgtataatgaaaataattttccgctgaagctctcttgggcttaaaacttaaaaagaaaagcggtctgattttagaaaaattttgcaaagagaaaattatgtttgaaaacctatctgacagactatcgaaaaccttgcgtaacattaccggtaaaggtcgtttaactgaagataatattaaagatacgctgcgtgaagtacgtatggcgttattagaagccgatgtagcgttaccggttgtgcgtgaattcattaataaagtgaaagagcgtgcgattggtgaagaggtaaataaaagtttaacgccgggtcaggagtttcttaagatcgtacaaagcgaacttgagaaagcgatgggtgaggcgaatgaggagttaaatcttgcgacccaaccgccggcagtaattttaatggcgggtttacaaggtgcgggtaaaactacttcggtcggtaaattagcaaaattccttaaagagcgccacaagaagaaagtattagtggtttctgccgacgtttatcgtccagcggcgattaaacagcttcaaaccttagcggaagcattaaaagtcgatttcttcccgacagagacaagccaaaaaccggttgaaatcgcggaacttgccttaaagcacgcaaaactgaatttctttgatgttttaattgtggatactgcaggtcgtttacacgttgacggtgagatgatggaagaaatccagcaaatccacagcgtattaaatccgattgaaacacttttcaccgtggatgcgatgaccggccaagatgcggcgaatacggcaaaagctttcaacgaagcattaccacttaccggtgtaatcttaaccaaagtagatggtgatgcacgtggtggtgcggcgttatctattcgtcaaatcaccggcaagccgattaaattcctcggtgtgggtgagaaaactgatgcgttagaaccgttccatccggatcgtgttgcttcacgtattctgggtatgggcgatgtgctatcgttaattgaagatttacaacgctcggttgaccaagaaaaagctgagaaaatggcacagaaattcaagaaaggtgatgacttcacccttgaagatttccgtgaacagctcatcgaaatgaaaaaaatgggcggtatgatgtcgatgctggataaactgcctggtgcgaagaatttacctgatcatgtaaaaaatcaggtggatgataaaatgttcgttaaaatggaagcaatcatcaactctatgacgctgaaagagcgtgcgaatccggatattattaaaggctctcgtcgtcgtcgtattgcgttaggttcgggtacacaggtgcaagacgtaaacaaattgcttaagcaattcgatgaaatgcagcgtatgatgaagaaaatgcgtaaaggcggtatggcgaaaatgatgcgtggcatgaaaggcttaatgggcggaggcggtttaggcggcctcggtggcttaggcgggatgtttggcggtaaacgctaattagctacgttccaagcggtcggattttgtagaaaatttgcaaaatccgaccgcttttttatgccttatttggcgagtgcttgacgcaactttccgcgatgcacagaaagtaattgttcagcagtagttttatccgaatcactcaaaatcatcataattgctaattttgcgttgttttcggcaatttttagcgcattttcggcaactgttcgatcacattcggtggcttccatcacgattttaatcgcacgggctttgagtttttcgttgcttgcctgtacatcaaccattaaattggaatagcatttgccgatcatcaccatggaggcggtggtcagcatattcaacaccagcttttgtgccgtaccggatttcatacgacttgagccagtcagcacctccggccccacaatcgtatcaatcgcaatctctgcaatttgtgccatagctgaattcgggttgctggcaatcgaaacggtagtcgagcccaaagatttggcatattccaacgcaccaatcacataaggcgtgcgcccgcttgctgcaatgccgaccaatacatctttttgtgaaaaattgaccgcttgtaaatcggctttgccttgttccgtgttatcttccgcaccttcaatcgggtggcgtaacgcacgttcgccgccggcaataataccgaccaccatttccggcgaaacaccgtaagttggcggacattctgaagcatccaatacacctaagcgcccactcgtaccggcaccgatatagactaaacgtcccccattttggaacgcttgtacgattttttcgactgcttgagcaatttgcggcaaacatttttccaccgcaagtgggacttgtttatcctcttgattgatcactttcactagctcaagtgcagagagctgatcgatattcattgagtgaggattgcgttgttcggtaatcatttttgacaacgcggttaataaatttttttctgacatttttatctccaaccaccttttacttttggtgttttatacaagtgaggaagtgattacttaggataaattacccctaaactcaccggctgttttgctccggttacacttggtaagttgctcgttaaattatgcactcgttgataagccagccaagcaaaagcagctgcttcgacataatcaatatccaatccgtactcatcagtggtagccacctgccattttggcagtaattctgaaaatctctgcattaacaatgggttgcgtgcgccaccaccacacacaagtaacaagcattgcttttcactttctaaagtttttaactcgtttacgacactttgtgcagtaaattccgccagtgtccgttgtacgtcttcagggcgataagcggttaaatttggcgatttttttgcaagccattcgagattaaataattctcgtccggtgcttttcggggcaggtaatttgaaaaaaggctcatcaagtaaactgttgagcaatgccggaattagtgtcccggtttttgcccattcggcatttttgtcatagcgtttagcttggtgcagctctatccacgaatccatcagtgcattgccgacactgacatcgtagccaatggtcggctgctgtggcgcaagtaccgaaatattggaaataccgccgatatttagcactacggttaagcgttccggcgaggcaaaaatcccttcgtgaaaagccggcactaatggtgccccctgtccgccgaccgccatatctttgcgacggaaatccgcaatagtggtaatgccggtatgagcggcaaccaaattcatatcaccgatttgcatggtaaatgggaatttgccgtttggagaatgccatacagtttgtccatgacaaccgattgcttgaatatcacttgcagtgagatgatgttcgactaaaaagcgattgatactttcggcatacaacaggcctaaacggtgatcgatttcacctaatttttgtaaggaagtttcaccgcttttgagtaagtgcgataaatcggtgcgtaaatcttccggcataggtgtaaagctgcaagcggtcagttttggcggattttttgcaaaatccattacacataaatccacgccgtcaagactggtgccggacatcacgccaaggtagaggtttttagtcataaaaatgaaaggaaaggaaaatttgttgaattatatcgaatatccgccacaaaagcggtaagatctcggctgatttttacaaatttatctctttatgaaccttcaaaaacttttattgattcgacgatttttctccactcttgcatttttctcaatgcaaaccgtgttttttatctatttacagaaaaaaggcttaagcaatagcgaaatcgctttttcgttgtctttattattcttttgtaatcaagcattggcaattttagccggcatttggggcgatcgttatggcttggctaaaatgatgttactaggctgtttgctggacgtgttggcttatattttcttcctctcagcggataattactggttattattgttagctactacttgtttcgggctaggaagctgtttgtttggtaccaatgcgaaggcgtgtttattggctttggcaggcgatgaatatagtgagaaaacccgtttgcagggtaaatatctgaaagtgaccagtatgtcttcgatgtttgcaccgttactggtgattccgtttattaaatttgagcaaattgagttattaatttgggtttgttttgcgatggaggcggtgctatttgcgctgatggtcaagccgttttatcagattcaaaccttacaaactttagtcaaattccgcttcggacagattcgagaaattattactaaagagtttttatttgtgcatttgatgctgtttattccgctatcaattgccacttcgttttttgtgattttcccgtttttatttgataacaaattagctgcaccggaacatagcccaatcgcattatttgtgaacggtttgatgacggtatcgttacaaagctacttctcgcgtaaaattaatctcactgcgaagcaaaccgtttgggtcgcaccgctgttggcgattggtatcattgtgccgtggtttattaccttgcattacatttcgctgtttagtgcttatgtctatttggttatttttaccgtgattgaggtgtatgcgctgacagcaatggcgaatctgttagtgaaatttgataatggtaccaatcgaggcttcatttttggtgcatcacgtctgctgctttcgattgcgacggtagtggtgatgaatttaattcctcatttgtttttggtgtagctatgactattctttggattactctcggtgcggtgttaggcgcaatttctcgctggcaattaggcgtatggtttaacggttttctcagccagtttgcctttggtacattgttagccaatttgctcggctgcttcttaattggaatcgccattggcttgcatttgaatgacgggcagaaattattgtttattactggttttctaggcagcttcaccactttttcgagcttttcattagaagtaagtgaaaagttactggcggagaaatattaccaagccttcggtattatcggtttgcatttggttgggggaattttgtgtacagtgataggaattttgctagtacgcctttttacaagcggtcaaaattactaaattttttgcaaaaaaatgccctcacgacttaaagttggagggcatttttcgttagctaattaaagtaaaatatttgctaataaaagaccgaagccaatgctgaaaatcatacttaataagcccggtaacataaagctgtggttaaagatatatttaccgattttggttgtaccggtggtatcgaagtcaattgaggcgataatcggaccgtagttcggaataaagaaataaccgtttactgccacgaataccccgattaataccggtgctggaatgccgattgcaatcgcaagcgggaagagtgttgccacagttgcaccttggctgtttactaataccgataaaacaaataatgcgaaagcaaatgcccatggtgcggtttctactaagccttgtaccatgcctttcacttcagtcatatgaccttgcattaacgtatcacctaaccatgcgataccgaaaatcgcaattaccgcacgcataccggcatggaaaatcgaacctttagtgatttcatcgccgtccggtttgcagaataagataattaatgcaccgacagaaagcatcacgatttcaatcgtatgcgccatacccatcggtttgccgtcaaacacaggacgaagtgacggtaccgcacccattaatacaactaataatgcaccgaataagaataaacctacagaagtttttgcggttgatttaatttgaatatctgcaggatcgacagaagtgtgattttcttttacgtaatcaggatcttgtaataatttttggtaatgcggatcgtcttttaactctttacccattttatttacgaatacacaagcaagcattaaaccaagtaaagttgccggcacggttaccattaatacatcgcctaaagtaatgccttgcggctctaaaaatgccactactgcaactaccgccgccgcaatcgggcttgctacgatcgcaaattgtgaagcgattactgccattgagagaggacgctctggacgaataccgttatggcgactaacttcagcgataacaggtaatactgaatacgctacgtgacctgtacccgctaacacagtgaatgtccaagtaacaagcggtgcgataaaagtaatatattttggattacgacgtaaaatgtttgtcgccagtttgatcatatagtctaaaccgccggccgcttgcattgccgctgcggctgcaactaccgccatgatcataaacattacgtcaatcggtaagccagctggttttaaaccaaacacgaaagaaaggatcgctaagcctaacccgccaaatacccctaaaccgataccaccgacacgggcaccaatcaaaatgcatagtaaaactatggcaaattgcaaaagaaacattgcagacataatttgattactccattgtaattcagtaaaaaaatcctcatacttgaggaaatagtccttagagataagccttctcaaagcagaattaaactctttgaaaagggtgcttaatatagcaataaataaaactaatcgctataagaatcaataattaaatttttttatgataggaaataatatgcaattttcaaaaatgcacgggcttggcaatgactttatggtgattgatggtgtaacgcaaaatgtctatcttaccgaggatgtgatccgaaaattagctgatcgtcataccggcgttggtttcgaccaattattgcttgtagagccgccttacgacccggatttagatttccattaccgtatttttaatgcggacggtagtgaagttgcacaatgcggtaatggtgcgcgctgctttgcccgttttgtcacgctaaaaggtttaaccaataaacaagatattcgcgtgagtactgccaaaggcaaaatggtattaactttaaaaggtgaagaaaaagttcgtgtgaatatgggggaaccgatttgggaaccggcacaggttccgtttacggcaaataaatttgaaaaaaattatattctaagaacggatttgcaaacggtgttatgcggtgtggtttcaatgggcaatccgcattgcgtgttacaagttgaagatattaagacagcaccggtaaatgaattaggacctttgttggagaatcatgaacgttttcctgagcgcgcgaatatcggctttatgcaagtagtgaatcgtaatcatattaaattacgagtatttgaacgtggtgccggcgaaacgcaggcatgcggtagtggtgcttgtggtgcggttgcagtaggtattatgcaaggcttgttggatagtaatgtacaagtcgacttacccggtggttcactccaaatcgagtgggaaggtgtcggtcatccgttatatatgaccggtgatgctacccatatttatgacggttttattaaactctaaattaaactaagtgcctttaaccacagaatacacggatagcacggaaattttgttttgtatcattagcgtatgctgtggtttttgtatcactacaagcggtcaattttttagaagatgtcgccacggaattcacagatagcatggaaattttattcagcgtagtccgtgtgttccgtggtttttaattatctaagcactttccacaccaaatgccattacttcatcaattttctcagcattcattgcaatcatcatcaaacgatccacgcctaacgcgacgccggaacaatttggaatccccgcttttaatgcagccagaaaacgagtgtctaactgctgagccggtaggcccatttgtgcacgttgtacgttatcttgttcgaagcggcgcatttgttctttcgcatcacttagctcatggaagccgtttgccaattctaagcctttgtaataaacctcaaaacgttccgcaacacggtgatcttccgaactgatttgagccagtgccgcttgcgacgacgggaaatgatataccgcagtcgggcgctctttaccgatattcgcttccacaatttcactgaatagaaattgcaacaaagtatctcgattctcgtcatcttcacatgggaagccgtgcttacgggctttttcaactaattgtgcgcgagttgccgaaagcggatctaaaccggcataggtttggaacacgaactgatagctataagattccgctggttcacaatccagaatttgctgaagtaaatcgtccacttcattgattaaacgatacatatcaaaatgcgggcgataccattccaacatggtaaattccggattatgacgcttgccggcttcttcattacgaaacacgcggcacaattggaaaattgaaccgctacccgccgccaataggcgtttcatatggtattcggggcttgtcatcagatgcagcgttttcgcttcgctggcaaagggcgaaaggaattgagtactaaaagtagaaagatgcacgtctgttacggaaaactcacttagcgcgggtgtttccacttctaatacaccacgatctttaaaaaactggcgaatttccgccatgatttggctgcgtttgattaggttttggatggaagcagtcggtttccattcaacattttctaaaattaattcattcattacagagatcatcgaacgttaaaaaagagattgtagcggtatttattttagtttgtgaagtttaatttcaattttgtaggcggcttaccggcgaatttccctaaaatttttgttatatcattggtaaaattttggtcaaatttgaccgcttaatgcgacaaattcttatctgtaattacgagtaattatcaataccgcataaaggttttgtaccttttttgaggtagatcacaaaacatattttttgtgccgtgaaaacgtaaaataaacttatattgtgcaaaaaatagtggcaaaatgcgaacaagttatattgattaatttatctattattttggagtgcattatgcaaagtgttaattttgatgtcgcaattatcggtgctggcggtggcggtttacgtgcagcaatcgcagcagcggaagcaaatccaaatcttaaaattgctttaatttcaaaagtttacccgatgcgtagccatactgtggcagcagaaggtggttcagcggcggtaattaaagatacagactctttcgataaccactttaatgataccgttggtggcggtgactggttatgtgaacaagatatcgtagaatattttgttgagcattcaccgattgaaatgactcaattagaacgctggggttgtccttggtctcgtcgtccggatggtgaagtaaacgtacgtcgcttcggtggtatgaaaatcgaacgtacttggtttgcagcggacaaaaccggtttccacttattacacacacttttccaaacttcaatcaaatatcctaatatcgtacgttttgacgaacatttcgttttagatattctgaccgacaacggcgaagctcgcggttgtgtggcgatgaatatgatggaaggtacgctcgttcaaatcaacgcaaatgcagtcgttatcgcaaccggtggcggttgccgtacttatcgtttcaatactaacggtggtatcgtaactggtgacggtttatcaatggcgtatcgtcacggtgtggcattacgtgatatggaattcgttcaatatcacccgaccggcttaccgaataccggtatcttaatgactgaaggttgtcgtggtgaaggcggtatcttagttaataaagacggttatcgttacttacaagattacggtctaggtcctgaaacaccaatcggcaaaccggaaaacaaatatatggaacttggtccgcgtgataaagtttcacaagcattctggcaagaatggaaaaaaggtaacactttaaaaactgacaaaggtgttgatgttgttcacttagacttacgtcatttaggtgaaaaacacttaaccgaacgtttaccgtttatttgcgagttagcgcgtgcttatgaaggtgtagatccggtaacttcaccaattccagttcgcccggtagttcactacaccatgggtggtattgaagtggatatgaatgcggaaacttcaattaaaggcttatttgcagtaggtgagtgtgcgtcttcaggcttacacggtgcaaaccgtttaggttctaactctctggcggaattagtggtattcggtaaagtagccggtgaaaatgcggctcgccgtgcacaagaagctacacctcgtaaccaagcgcaaattgatgcgcaagcacaagatgtcgttgcacgcttacacgctttagctcgtcaagaaggtaatgaatcttgggcggatattcgtaaccaaatgggtgacgcaatggaagaaggttgtggtatctaccgtacacaagaaagtatggaaggtgcggtaaacaaaatccatgagttaagagagcgttacaaaaatatcagcgtgaaagataaatcaagcgtgtttaacaccgatttactctacaaaatcgaattaggcttcattttagatgtggcgcaatcaatcgcttgctcggctgttgaacgtaaagaatctcgtggtgcacaccaacgtttagactatacagaacgtgacgatgtgaattacttaaaacacacccaagcattctacaacgcagacggcacaccgaccattaaatattcagatgtgaaaattactaaatcacaacctgcaaaacgtgtatatggtgcggaagcagaagcgcaagaaaaagcgaaaaaagcagcagaacaggcacaaaaataggagagcgataatatggcaaatttaaacaaaatgaccatcgaagtgcttcgctacaatccggaaacagatagcgaaccacatttagacaaatatgaagtgccgttcgatagccaaacttcattattagatgcactcggttacattaaagacgaacttgagcctgagctttcttatcgttggtcttgccgtatggcgatctgtggctcgtgcggtatgatggtaaacggtaaaccgaaattagcatgtaaaacattcttacgtgattacagcggctttatgcgaatcgaaccgcttgcaaacttcccgattgagcgtgacttagtggtggatttaagccattttattgatagcatcgaagcaatcaaaccttatgttatcgataataaagcaccggaaggtcagcgtactaaacaaacaccggcacaattagagaaatatcgtcaattctcaatgtgtattaactgtggtctatgctatgcagcttgtccgcaatttggtttaaaccctgagtttatcggtccggcagcgattacccttgctcaccgttataacttggataaccgtgataacggtcgtgagcaacgtatgaaactcttaagctctaaaaacggggtatggagttgtactttcgtcggttattgttcagaagtatgtccgaaacatgtaggtccggcttctgcaattaaccaaggtaaattagaaagtgcgaaagattacgtaatttcaatgcttaaaccaaaaggctagggggcaatatgacaacagcaactaaacgtaaagcgtatgtacgcgaaatgaaagcgaactggtggacaaaactcggtttctacaaaatgtacatggtacgtgaagcaacctgtttagcaaccgtatggttctgccttgtattgctttatggtgtaattagtctcggtggggaaggtttagaaaactttattagtttcttacaaaacccaatcgtatttattttaaacgttatcagtattgctgcattgctttatcatgcagcgacactttatgtgatgacaccgcaagtgcttactttcattgtgaataatgaacgtgttaacccaaacattttaagaaatgtactttgggcggtaaccggcgtagtaagcttagttgcgttagtatttacttatatttaggggaggaatggcaatgagtaaacaagatccgaaacgttctaatgagccgcctgtatggttaatgttcagtgccggcggtacaattagtgcaatttgcttccctatattaatcttaattttaggtgtgttgttaccgcttggtttagtgccggtggataatatcgtggcatttgctcacacttggttaggtaaattagtgattttggcggtaactattttcccaatgtgggcaggtatgcaccgtgtacaccatggtttacatgacctcaaaattcactttcctgcgggtggctgggtattctacggattatcggctctctactcagtgattgtgttctttgcagtaatcgcactgtaatcaatataacgtgaataaagccatccgtcaggatggcttttttgatgcgtgaagtttgcaaaaaatcgatcaattttgaccgcttgttatgtgcgatatttatcggtttaacttaaaatttcacgacatttatccgttacttgctgcaaaatagcagcgtaatcagtgtcttttaagccaacacaaccgaagtagtgcatttttacttgttcaataccgcaaaagttaaacagcccgttacccatggtatgttcgaaagcttgtaaaaaacctttttgttgatacttttcattcggattacctaaggtaacgaattgctgcatttttttacctttcaataaaccgatgctttcaatttcgccattttgataagcgaatccataacttaacactcggtctaagtagccttttaagattgccggaaagcccatccaccatagtgggtaaatcaaggtaatgacatcggcttgttgccaatatcggtgttcgatttggatttctgtcgggtactgcctggtgaggctggactgaaattcttgccaagctaagttcggatcaaaatttaattgatataaatcccgtacgataacttggtggccttggcttgcttgaacggcttgcgaaagaagcgcgtggttaaaactttgcggattcggatgtgcataaataatcagatggttcatcatatttctcggctaaataataacggttcctaattatcgctaaaatcttgctttacatacaaaacttcctctaattattctttgacaattatcaatctttcctgttgttcctcagcaaatacctccttcgagtaataaaagcagaccagtaaaaatcggataatgccgaccatttaattagacttgtaatggggatgctttgtccgattttagccaacaatcattacctcggcgcagttttttacgtggacattttttaaacgcgttacaaacggagcaggtaaagcaacaaggacataatgcgattcgcccgccttggacaaatcttgcagatttttatcaaaaatgcaccgcttgtaataactgcatatctgcttgcgaaactcaaattatcatcaaaggcgccggcggttatccggaaatagattttaaccgtggcgaatgtactttttgccaagcttgtgtgaaaagttgtgagacggatgttttcttagcgataacggaacaaccttggacgcataaagtggaagtgcaagacagttgtttgctaaaacaacgtgttgagtgccgttcttgtggtgatagttgcgaaagtagagccattcgttttcgtccggcattgggcggaattgcaaatttagtgctggatttgaccgcttgtaatggttgtggcgcttgtttgagtgtttgcccgaccaaagcaattagaattaatagggaaaataatgagtaatttagaaagccagaactggtatgtctgcagtcttgtggtacaagcgaagccagccaaacttgagcaggtgaaagcggatatcttaacgattccttatgcagagattcatggcgagaaagccgaagaaggtaaattagtagtcacgctagaaagtgacagacagcttgcgcttgccgatttaattgaacaagtgaaagatattagtggtgttatcgtagtatcacttatttcaaattatattgatgagcaataatttttaatcattttaataaacgtgggaaacattatggaactcaatcgtagagattttatgaaagcaaacgcggcaattgctgcggctgctgcggcaggaatgacgattccggtcaaaaatgtttatgctgctgatgacggtattaaatgggacaaagcgccatgccgtttctgtggtacgggttgtagtgtacttgttggtactaaagacggtcgtgtggttgcaacgcaaggtgacccggatgcagaagtaaaccgtggtttaaactgtatcaaaggttacttcctttcaaaaattatgtacggtgcagaccgtgtacaaacgcctttattacgtatgaaagacggcaaattccataaagaaggtgattttacaccggtttcttgggagcaagctttcagcattatggcggaaaaagttaaagcaactttaaaagcgaaaggcggtaatgctgttggtatgttctcttcaggtcaaacaaccattttcgaaggttatgcaaaagtaaaactttggaaaggtggtttacgttctaacacaattgacccgaatgcacgtcactgtatggcgtctgcggcagtggcgtttatgcgtacctttggtatggacgaaccaatgggttgttataacgacattgagaaaaccgatgcattcgtgctttggggttcaaatatggcggaaatgcacccgattttatggagccgtatttctgatcgccgtttatctgacgataaagtaaaagtcgtagtgatgtccacttttgaacatcgttcgtttgaacttgcggatacgccgattatcttcaaaccgcattcggatttagcgattcttaactatatcgcaaactacattatccaaaacgataaagtgaactgggatttcgtgaataaacacaccaagttcaaacgtggtgaaaccgacatcggttacggtttacgtccggaacatccgctccaacaagcggctaaaaatgcgaaaactgcgggcaaaatgtacgattctgattttgaagaattcaagaaaatcgttgcgccttatacattagaaaaagcacatgaaatttctggtgtaccgaaagatcagttagaaactttagcgaaaatgtatgcggatccggaacaaaaactggtttcttactggacaatgggctttaaccaacacactcgtggtgtgtgggtaaaccatatgatgtacaacgtacacttactcactggtaagatttccattccgggttgtggtccattctcattaaccggtcagccgtcagcttgtggtacggcacgtgaagtaggtactttcgtacatcgtttaccggcagacatggtggtaaccaatccgaaacacgttgagatcgtagaaaaagcgtggaaattaccaaaaggcacaatcccgactaaaccgggttaccctgcggtaatgcaaagccgtatgttgaaagacggtaaattaaatttcttatggcagctttgtactaacaatatgcaaggtggtccgaacattaatgaagaaattttccctggatggcgtaatcctgaaaactttatcgtcgtttcagatccgtatccatctgtaagtgcggtcgcggcagacttaattcttccaacttgtatgtgggtagaaaaagaaggtgcttacggtaatgcggaacgccgtacccaattctggcgtcagcaggtgaaaggcccgggcgaatctcgttcggatttatggcaaattgttgagttctcaaaatacttcaaaaccgatgaagtatggggcgaagaactattagcgcaaatgccggaataccgtggcaaaaccctttatgaagtactttatctcaacggtgaagtaaataaatataaagtgccgactaacgtcccaggttatatcaatgatgaagcggagcacttcggtttctacttacaaaaaggtttatttgaagagtatgcacaattcggtcgtggtcacggtcacgatttagctgatttcgatacttatcaccaagttcgcggtttacgttggccggtggttgacggtaaagaaactttatggcgttaccgtgaaggtttcgacccgtatgtgaaagcaggcgaaggtgtatcgttctacggttatccggataagaaggcgatcatcttaggtgtaccttacgaagcaccggcagaaagcccggatgaagaatatgatttatggctatgtaccggtcgtgtacttgaacattggcataccggtacgatgacacgtcgtgtgccggaattacaccgttcgttcccgaacaacttatgttggatgcacccgacagatgcgaaaaaacgtggtttacgtcacggtgacaaagtgaaattaattacccgccgtggtgagatgattacccacttagatacacgtggtcgtaataaatgtccggaaggtttagtttataccaccttctttgatgccggtcagttagccaataaattaactttagatgcgacagacccgatttcaggcgaaaccgattacaaaaaatgtgcggttaaagtggttaaggcttaatgagacattttactctctccctttatgggagagagacaggctaacgaaacgtttagtgagttagccagagagagggtaagcggttaaatttaatctgaattttccctctccctgataaaaattgtcttacgcaatttttatctgtccctctcccgcaaggggcgagggtaagataaggatactactatgaaacttgacccaaatcgccgtcaatttttgaaaaatgccactagaacggcagctggtatttgcggtgttggtgtgattctcggattacagcaacaacaagcgaatgcaaaagaaggtgtagcgcttcgtccaccgggtgcattacctgaaaaagactttttagcggcttgtacccgctgtgggcaatgtgtgcaggcttgtccgtacgatatgttgcatttggcgagcctgatttcaccgatggaagctggtacgccttactttgtggctcgtgataagccgtgtgagatgtgtgtggatattccttgtatgaatgcttgcccaagcggtgcattgagcgaggaactcaccgatattaataatgctcgcatgggattagccgtgttgcttgaccacgaaacctgtttgaactggcaaggtttacgttgtgatgtttgctatcgtgtttgccctctgattgacaaagcgatcacattggaagaagtacacaataatcgtactcaaattcacgcgaagttgattccgactgtacattccgatgcttgtactggttgcggtaagtgtgaacaggcttgcgtgttagaagaagcagcaatcaaagtattaccgatggatcttgccaaaggcttactcggcagacattaccgcttaggttggaaagaaaaacaaaatgcaggtaaggcattattggaggatcaacatccggacgggttacgcccagcgttagatgcacgtatgccggaaggaatgagcgaaccgacttaccaatttatgcaggttcagccgaatcagaaagtagcaacgccaaatcgtgccacttacgattacgtaccgaaatccaccaccgtaccggaagcggaacatttccctaacttagatctaaacattaagggggtgaaataatggctgatgtgaaatacgtaccgaataaacctaaagatgctgggcttgaggctcgacaaaaattaggttggtggcgagcttatcgctttctcattctgcgccgtttgagtcaattaagcattatcttaatgtttttaagcgggcctttttggaatgtttggattttaaaaggtaactatagcggcagtatgctgtttgatagcgtgccaatgagcgatccgctaatgacggcagaaagcctagcgaccggttatctaccggaatggacaacgattttaggcgcactgattatcgtggcattttatgcgattgtggcaagtaaagccttttgtagttgggtttgcccaatgaatatggtgaccgatgccgctgcatggctgagacgtaagttaggtattcgccagagtgcgaaaatctcacgcaatttacgctatgtaattttggcgatgattttagtcggaagtgctatctcaggaaggttattgtgggagtggattaacccagttgccgcattaggacgtgcctttgtcttcggtttaggcgcaacagtctggttagttgcagtcattttcctgtttgacttactggttgtcgaacacggctggtgcggacatttatgtccaatcggcgcaacttatgccttgatcggcgcgaaaagtgtcgtaaaagtaaatgtggtggatcgcaaccgctgcgaccgctgcatggattgttataacgtctgcccagaaccgcaggtgctaagactccctttacatggcaaacctgaagatagccaaattgtgctttctaaagactgcatcacttgcggacgttgtatcgatgtgtgcgcggagaaagtctttgcattcggtacacgctttaaaggcagtattgatgtgaaaaatgtttaacaaaactcccctctttgaaaaagaggggcagggggagatttaaaaatctcaaatttataaaaatttggcggaaatccaccgcttgtaaaatctcccctaacccctctttactaaagagggggacttataaccctttttaattttaaaacggagtgatttaacatgagaaaatatctcaccctcttattgaccgcattagcgggttttgccgtggcggaaacgcaagtggcaaaaagtatcgatagtacagtggaaagtgttgcccctgcttataccaacgcacagaaagatgcgggcaacattcctgtgactttcccccaccaaccgccgcttgtgccacacagtattcgtggcttacaggtaaccaaaaataccaaccaatgtttaggttgtcacagccctgaagttgcaccgacaaccggtgcgacacgcgtgccggcaagccactttatggatcgtgacggtaaaccgaccgaaggtacttcaccacgtcgttacttctgtctacagtgccacgtacaacaaacggacgtaaatccgattattcaaaacaaatttgacacgattcgtcagacacaaagtaaataaggagaaaggtgatgattaagaaattttggaactggtttcgtacgccgagtaaaatggctgccggtacactcattatcatttctgcgattggcggtattttagcgtggggcggttttaaccaaggtttagaacataccaataccgagcaattctgttcagattgtcatatgaatgacgtagtacctgaatatcgtgcttcggctcactattcaaaccgtagtggtgtgaaagctatctgttcagactgtcacgtaccgcacgaatttattgataaatggaaacgtaaaattatcgcttcaaaagaggtttacgcacactttaccggtaaagtggataccaaagaaaagtttgaagcacatcgtttagaaatggcagagcgtgaatgggcgcgtttgaaagctaatgattcgcaagagtgtcgtaactgtcataactttgaagatatggacttcactcaacagaaaactgtggcgcagcaaatgcatgccatggcacaagatcaaggtaaaacttgtatcgactgccataaaggtattgcacataaccttccacatatggaaaaaattcaaaagagcttcattcctgaagatatgctgaaaaaagaacaaccagcggaaggcaaataacaagcggtcggatttttattcgattttacgatccccgagtacggtgtacttggggatttttttgcgaattatgctatactttgcgcaatttttgttacggatcaatcctttatgaaacacagtttaactcctttccatacatttcatttagcggcaaatgcaagcaaaatcgttgaattcagcagtgccgaacaattacttaacgaatggcaaaccgccgtaaacaatcatcagccggtacttattttagggcagggctcaaatgtgattttcttagatgattttgacggttgcgtattcatcaacaaattaaaaggtatcgaacatcacgaagatgaacaattccattatttgcatgtgcaaggcggtgaaaattggcatgagctagtaaaatggagcttggcaaataatatcgccggattggaaaatttagccttaattccgggcgttgccggttctgcaccgattcaaaatatcggggcttacggggtggaatttgagcgagtatgtgattttgtcgaagtactgaatttacgcaccggcgacattttccgtttaaccaaacaagagtgccaattcggttatcgtgaaagtgtgtttaaacaccagtacaaagatgaatttgcgattctgtcggtcggaatcaaattggcaaaagcgtggcagccggtattaagttacggttcattaactcaatttgatccgcaacgtgtaacgcctcaacaagtgtttgacgaagtgtgtgcggtacgttcggcaaaattaccgaatccggacgagtttggtaatgctggtagtttcttcaagaacccagtgattgatgctgcaaaatttgcgcaaattcagaccgcttacccgaatattccaaactatccgcaagcagacggcacagtaaaattggcggcgggttggttgattgaccaatgtgaattgaaaggctttcaattaggcggtgcggcggtacatgaaaaacaagcgttggtattgattaataagcaagcggcagctggttcagatgtcgtggcgttagccaaagaagtacgccgccgtgtacgtgaaaaattcggggttgaactgcatccggaagtacgttttatgggcaaaaatggagaagtgaatagcgaagaagtcacgagataaccaaaataatgagcaaattaaaccaatctcagatccaaacggcgttattgtgtgggcaagcgttggtgtttgatgaaattgattcgaccaacgaatatttgcttaaacactatcaaaccttgccgcaaggttcagtatgtttggcggagcaacaaaccgccggcagaggcagacgtgggcgcacttggtattcgccacaaagtgaaaatgtctatttttcgattttatggcattatcccactgaagacgctgcgcatatttcttcgctgagtttggtgatttcgttgattattgccgaaagtttgcaagcgcaacaggttgaaaatatccaaatcaaatggccgaatgatatttattattgtggcaaaaaaatgggcgggattctgattgaaaccaaagcggatcgcagtggtatccatttagtgatcggcatcggtttaaatttgggaatgaccaaagtggatgaaaatattgtggcccaagcgtggtctgatttatccgactatcaatttgatcgtaatgcactggtgtgtcgcctcgcttatgaattgcaaaaaaatcttaaaatttacccgcttgttggctttgaacattatgccgagcgttggcaagcatttgatatttttcgtgatcgaccggtaaaactggtcacagaaggtagtgaaattcacggtatttcacgtggtatcaatcaacacggtgaattactgcttgagcaaaacagtgttattaccccgttcggcattggtgaaatgtcattgcgctctgacgaaacttaataatctttagacaagcggtcaattttttgcaaagttttgcaagaatcagaccgcttacttttccctgatttataattcattttttactaagaggaaagcaacatgaattcaacattctctccattatttgaaagctataaattaaataacggcgttgaaattaaaaatcgtttagttgtggcgccgatgacccatttcggttcaaatccggatggtactttaggtcaaaacgaacataaatttattgaaaaccgtgccggcgatatcggtatgtttattttagccgctacactggtgcaagacggcggtaaagcgttccatggtcagccggaagcgattcataccacccaattaccgagtttgaaacaaaccgcagacttaattaaagcacaaggtgcgaaagcgattttgcaaattcatcacggcggtaaacttgctttaaccgaattactgaacggtaaagataaaatctcggcaagtgcggacgaagaaaccggcacacgtgcagcgacggtagcggaaatcgaatcattaattgcagcatttgctaacgcaaccgcattagcgattgaggctggctttgacggggtggaaatccacggtgcgaataattacttaattcagcaattctattccggccattccaaccgccgtgaagacgaatggggcggctcaagtgaaaaacgtatgcgtttcccattagcggtggtggatgcagtggttgccgaaaaacaaaaagcggcaaaagcggattttattatcggctatcgattctcgccggaagaaccggaagagttaggcttaacgatggaagacactttcgcattagttgatgcgctaaccgcaaaaccattgcaatacctacatatttcattatgggatttctacaaacaggcgcgtcgtggcgcagatactaaccttagtcgtatgcagttaatccatgagcgtatcgcaggtaaattaccgcttatcggtgtaggtaacttattcagtgcggagcaaatcgcacaagcgtttaataccggttgggcggaatttatcgcattgggtaaaactgtaatgattaatccgacgattgcaaccttaatcaaacaaggacgtgaagcggaaatcgtgaccgagcttgacccgaataaagcggatcaatatggtatccacggtattttatgggacttatgtattcagggcggtgcttggttaccaccggtaaaaggtcaagaatggcaaccgttagatagataaatagcgataggaaatctttatgcataaaaccatgcaacaaaaagcggcggaagcacataatatgtgtaagctgaaaggcgattcaatgttggataatagcgaccgtcaaattgcctttgaagcgctgtatgatagtgaaggacaagcgctacaagcggtcgaattttttacagaaaaagcaaaatcggtggaaaccgaagcttgtgttattcagcatagcattagccaagtcgaagatggttttttaatgcaaatgcagattgaatttagctgtcaggcggaagtgatattattccaaatggcaatcagataaaaaataaggggcaacaaatgttgtcccttatttttttgttttatgatttaacctttaaacattggtaacatttcatacattgaaaggaaatggaacacagcggtacagacaccgaataagaagaccaatccaatcataaacagattaccttttttcgctttataagctaataatgccggaatcatacaagtccacagtgttgctaccgcacctgcataaccaatcgcttttaaaaagccaagcggcgagagtaatgagaatactagcggaggtaagaaagtcaccgcccatgctttggttctgcctgatttactctcatcaaatttaaagaaatctgctaagaaatcaaatgtacctagtccaactccgataaaagaagacagaattgccgccatagaaaacgcattaatcgcttgtttcacatatggtgactgcacaacttcaccaatcgtatttaataatacgtctaaatcaccgttacttgcgataaccggtgcaaattgcgcacgtggcagattaccgaaaatgctgattacccaaagtaaataaagcactaacgcaataaaagtccctccagcaattgcatattttgctttttttacctcaccataataggctcgcattgaggagactgagtggtgataaccgaaagaggtcaatgcaaccggcaacattgctaacgcatatttagcgtattcgccattatcgttttgttgatcgaataaaacagcagtatcaatattgctgactaaacccgaaatactgaatgtaaacgacaatgccataaagataattaataacaccgaaatacgatcaactaaacgggtagagtgccatacaaagaacgagaaaatcagcacgaatagcacagaccaaatgcgagagccgaattcaccgaaatcgatcgctgatttggttaagttttccaaaattccaccggaagcggtggtataagcataaagtaaaattccgccgacaaaataaaccgcaaggttatttaacgcattgatcttattgcctaataagtctttggtaacagtattgaatgaggcacgtaagtcatagcttttatagacatcaagtaacaaccagcctgaaaatgtcatcacaaccatggtaaaagcaagcgcaagcaccgaccacattgtccaagcacccgcaccggaagttggaagcccgagcataccggctcctacgcagacacctgcgatgatacaagcgccaccaaaaagtgttggctgttttttcataaaatatcctattgaagtagtacattaaagtaatagtattgtgccataaactaacttattaaaaaatagtcttatagagaaaaagtgtatttttatcatcgtaaaacgctatttttacctaaatagtgaatactaaaactttacgcttttatatggattatctaaaatagatccaaaattagatccaaaggaacttattatgctgaagatgaacgatctttctaaattaactaatacgcctaaatcaaccattctttattacattaaagagggattgttaccggaacctttgaaagataaaccgaactttcacttatatgatgaaagcaatatccaattaattgaatttattaaatatcttcaagcaaactttaatgcaaccatttcacagattaaaacggtatttgctcagccggattttgatctgaataatccttataaaagcttaatgggctcgttggacattctaaacggtacggaaggtgaacgcttattagtgagtgagatctgttcggaatttggtattaccgaagttgaattgaatgaatttgtggaaatgggtttaattaatccgacccatggcgactttagtgcgaaagatcgtgatatgttggctattcttagccaatgtgatgcgcaggaattccaattattagaaagttatgcggaagtagcgaaaaatttagcgcgtcaagaaatggcaatcggcggggaaatcttgatgcaagaagaaggtcaagaagagcgtttgaaacacttttttaatattttattactattaaagccgtatatcctaaattcacaattagttaagtattaactcttacttttcactattttagcgatatctatcatgttacaaacggtcaaatttgcaaaattttctgcaaatttgaccgcttgatttttgattaaggcagttctgggaacagcatttttaacacggccttggttaagcggcgagattttccttggtaagggaaaatatgcatcatcatcatcggattaaaatttgcttcaatcacgccccatgaacgcagagacggctcggctgctttggttaaatccggaatgattaaatccacaccgcagacttttgcccccatcgctttggcaataccgactgctaattgtttatagctgtcgtgcatttgatcggtcatatcaattgaatcgccaccggtactaatattagagttggcacgtaattgtacaatttgtccttcagccggaattgaatcaggtgttaaaccttgttctttgagctgaagcaattcaatgtcacctagggcaatttttttcaatggcgaacgagagccgtcgcctcgtagcggatcactgttttttgcgtccaccaattcacgcaccgtatgtatgccgtcaccttttacattcgccggtacacgtaacaataccgccagtgtttcatcacctagcacaaagaaacgatattcggtaccgactaaatagtcttccaccatcacttctttatcttcacggaacgcaatttcaatcgctttggcaaaatcggctttatccgttacgccttgttggaaaatcgtaatgcccaaaccgtaattggtcgatttcggcttaatcaccaccgctttaccttcaaataacggatagtgcgccaccgcttgttctaccgaggtaaattcaacgcttttcggcacattaaaaccggctttcgccaacacttttttggtcacgactttattttccataattaatggcgaaatgtactgatcgtgactggtcatattgccgttttttacatattcgagatgatcaccgaatttgagtgcaaggaactgatcgttttcatccagcaattcgatctgtaagccttgttgggtcgcatcaaataataaagcctgtgtagaaagctccatattatcgaaagcggaaatcgcataaaaacgctcgaacgcttgtgctttatattgttgagcaagttgtgcaccgagtgctttatagctgccggcttgttcaattgctgctaataaacgaccgtttaccgtttggcttggatcagcaaattgagctagtttttgttgtaataactctttctcgctttgtggcactgaaagatcttctaacattgccagcattaggttaaggatagcttcaccctctgcttggaatacagtgtgcgaacgaggatcttcaagtgcaacttggtatagtttttgtttaccaagttcgacttctttttgaccgcttgtttcatctatccataacatagcaagtaagaacagatgaataaatttggcatcggcgagctcgataccgtaaggcgagaacgggttgagatcaaataaacggaattccgcatatttaacccctttttcaagtaattcacgtgcttttttcgcgccacgtaaacgtacgtttgaatagaattctttttccgctaataaatcaccgtttgccacaaaatgttctaatgattcaacatattcttgcaagctatcgtgattgattactacatgaggcgcatttacatagccatacgggctagagcgtaaactacgcactaattgtccttctgcaagcggtcgattttcgccaaaatattgcgcttctacggttggtgttgcagcaagcaaatagacaagaatccattgataacgtaaaaagttattggctaatttcatatataacgcattgcggaacgcaattttatcactgtattccgtttgtaacgcaaaagcgctctcgacaaactcgtcagaaatctggaaattgtagtgaataccgctcaccatctgtttgtatttgccataaatggcagaaaggtgttcacgatatttcacatcccattcgttatctaattgtgcttctttgatctcggattccggtggtaaaccggcaggcatactgaatgggaaaatatattcatcatcaggtaatgaacgtaacgttacctcgtgaatagccgatagccaacgatatgtgtcttccaatttatcgtttggcggtgtgattagctcaagttggctttctgcaaaatcggtttgaatatatgggtgataactgcggttaccaaaaacgctaggatgagcagtagtaacaatattcccttgattatcaatacgttggctttctttttcaatgccgaatttgccttgttgaaacagcaaaccgagttgatgagttttaattagttgttgtaatttcatagctttccctttcgcgataaatgcgttagacgaagttctgcccctaaaataacatacttttttgattgggtttatagctgattgataagagaatagatgatttggttataaaaaagcacgattattataatcgtgcttaattaaaaaagattatttaatcacttttgccaagcgctcgcccattcgagtttctacgccggcttgtaggtgtgcttcgaattcaacgcaatctttcgggaagaggttaattacggttgaacctaagcggaaagcccccatttcctgaccttttttcaggtgtacggcggtttcaccagtggtttcatagtgatataccacaacatctttggcacgaggcgggttaattacaccttcccaaaccgtactcatacttgctgtaatagttgcgcccactaaaatttgtaccatcggcccgaattcggtttcaaattcacagattacacgttcgttacgcgcaaataaatttggtacgtgttcagctaagaacggatttactgaaaataattcacccggtacgtaaatcattttgcgtaaggtcgcatcacacggcatatgtacgcggtggtaatcgcgtggtgataaataagtggtaataaaatgaccgtctttaaacttatttgccatttcttgatcattcgctagtaaggtttcaagtgtaaagaaatgaccttttgcttgtagtaaacgatcgtcttcaatcttacctgattcacttactttgccgtctgccggtaaacaaagcgcctgtgcatcttggttaatcgggcgagcgttttcttttaacggacgaataaagaattcattaaacgttgcgtagtcagatgcattgcttttttgtgcttccgataaattaacattatattgtttagcgaatgcacggataataaagtgggtcacaacaccccatttttgttctgccagccaacctgctaaacgggtaacaggtaattgtgggaagatatattgaaatgcgactttcgcacgttgccaataagtcggcatcgaatagggtttaagagacattaagttgtatcctttttattcaattatacaaagaggcgcgaagtataacagaaagaaaagtgaattacctaatgttatcaaaaagtgacaaggcgctgagttaagatgtggcataaagatagaggaagtaagccacatattgccttaactcagcaaatgttatacgagaaggaagagattattgcaataggatgcgatcacgatttttatccagtgtagctttgccgataccggatacatcggtaagttgctctaggctactaaatgcaccgttttttgtacggtattcaacaattgcttgtgcttttttagcgccaataccgactaatttatcttggatttccgctgctgttgcgatattgatattgactaaatttgcattgtttgtcatttcagcatggctatgttcagggctggttgcttgtgcgttttgaaccacgggagtgggttctgtgacactaggctttgttttttcagcagctaatacaccggtagataacataccgattaacagacttaagccaagttttgaaggtgttttcataaatgtctccttttctttttagattgctttttaagatgattttgcttggaactactttacaagttaaataaattagagagcaattctaggaaattatttttgcgatcaagatcgagaaaattgtttatcttatggtcagaaataaggaagagaggatataaatacgtggtgagcagtgctgatttagtgtttttgtaaaatatttaataaatattaccgcttgtaggcataattttctgaaaaatcgtgtgctgattaaagagaaatactttaaaatggggataatttattcagcgggaaatttcccattatattttcacctaaaattggaaagttaaatgtcacaaaataattttcgtaaagagccaacttttggcgagccatccgctgcacaatcagcggagcaagtagcagaggcaatcattaattcggatagtgcaaaagcggttgaggcggtcaaagcggttgccacgaatgcaactgtatcattacattcaaataaagcgccaagttatacctttacaccggtaatgaagcgttctgttgatgaaactacgccattaaaatcgattgaggatgctcaaaaggtgaataatacagaaacgccagagtcagctttaacggcggaagagccaaaagttgcacaaaattcaggtttcgctttttctccggtagcggatgaagcaacggaagaatctaaaaaagcagagccggagcaagttgaaaaattagttacagaggaaaagccagcgatgaatacaagtaatgaagatcgtgtgattcctgccgtgaatccgactaccgccgccgaagctgttgcagttgcgagcgtgccgtctaaattccgtcgtttaggtttagttgcgattttagcggcaattttagcagcaatcttcttctggttaaaaccaagcgcaccggaaacagttgaagaattacagtctcaacaaggtagctcattaccaattgaattccgtccggtagatgaagaggaagcgaaacgagcggaagcgcaagcaaaagccgagcaagaagcgattgctcagcaacaagcacaacaagctcaacaaattcagcaagatatgaatgttgcgacaacacagccggcaacaacggagtcagcagcaacgacatcagcaacttctacaacggaaacagcggtagctccaactacggatacgacagtggttgcggaagaagcgaaaactgaaccgactcctgcttcggttgtaaataaaccggttgtacaaccaacagcggttaagcctaaaacacaaggcagcgtgattcatcagtctgaaacgcctaaacagccgaaagtgaaagcaattactgcggatgaattcaacgcgaaaaaagcgaagaatgcacaattagatcagcttgtgaagaacgtagaagcaggtaagcctgtggcaaaaacagctgctcctgcagcagctaaagcagcgtctgcaccggcaaaacctgctgcggcagcatcagtggcaagtaaaacaatgacagtgccaaaaggtacatcactcatgcaagtattccgtgataacggtttaaatatctcggatgtgaatgcgatgagcaaagtcaacaaagtggtaagcaatcttaaagtaggcgagcgtgtaagcgtgcgtttagataaaaataaccgcgtagttgaaatgagtatcggctccggcggtaagtttactcgtcaagcagacggtagctatagctttaaataattaaaatcaaagggcaacgctacagacgttgctctttttttctcaaaattttgagaaggagagtagttgtaaaatgagtgttttttttaagaagccgttttgcttagccgtttgtgccggagtgatagcgttaacgggttgtaagtctttagaagcgccgattgaacaggtgcagcgagctcaatcggccatacaacaggctcaaacggaaattaagccaacggaaaaagtgacagtagtcaagaatcagacctcaatgcagtttatttgtcaaaatgatgttgttgtgaaggtacagcgttctaaagccaaaaaggtgaataataaagcgaaacgaaaagtggtgagccagcaagcgattttggtcacttacggtaacacaacgcatacgttatcgccggcagtcacgagagacggtaaaaagtatagtaatatccgctggacgtggcgagaaagtcgaaatggtgaagcttctcttacagataacagcaataatgttctcgccagcgaatgtaaacttaaaccgtagagagcaagcggtcatattagcttaattttttgcaaaaagtgggctaaatttgaccgcttgtcatttgaatgaaaggaagacaatgaatatcttaattattggcccgtcttgggtcggcgatatgatgatgtcgcacgcactgtatcaacaacttaaaattcaatatccgaattgtcaaattgatgtgatggcaccggattggtgtcgtccgctgctcgctcgaatgccggaagttcgaaaagcgatttcgatgccgattgggcatggttcgttccgcctgtgtgagcgttatcaattagggaaatcgctgagaaatcaatatgatatggcgattgttttacctaattcgcttaaatcggcatttattccgctatttgccaaaattgcggtgcgccgaggttggaaaggtgaaagtcgctatttctttttaaatgatttgcgtaataacaagcaagattacccgatgatggtacagcgttatgtggcgttggcttttgagaaaaatgctgtgccggatgctaaagctttgccaatgccgctaccttatctacaaacgcaagcggctgagatcaccgcaaccaaagcaaaatttgccaaacagtttgaatatgctgaacagcgtccggcaatcggcttctgcccaggggcggagttcgggccggcaaaacgttggccacattatcattatgcaaaattggcagaaatgctgattgaaaaaggctatgcggtacatctgttcggttcaaataaagataaagaagtcggcgagcagattcatgcaagtttagcggagaatttacagcgttattgcattaatttggcagggcagaccgatttgaatcaagcggttgatttaattgctgattgccatgcggtggtaagtaatgattccggattaatgcacattgcggctgcattgggtaaaccgctggttgcactttatgggccaaccagtccgcaatatacgccgccgctttccgataaagcggtgattatccgtttaatcgaaggcggtttgattaagattcgtaaaggcgaagccgccgaaggctatcatcagagcttgattgatattcagccggaaatagtgattgagaaattagagacgctattaggctaattgcaagcggtcattttttgcaaaaattttgcagatttcgaccgcttgtttgtattcacaataaaagataagtaaatgaaagttttagttgtaaaaacgtcctcaatgggggatgtgattcatactttgccggcattgacggatgctaaaaatgcgcttccgaatattcaattcgattgggcggtggaagaaaattttagtgaaattccacattggcattcggcggtagataaggttattccgttagcgattcgccgttggcgcaagaacttgtgtcagcggcaaacttggttggaatggcaacattacctaaagcaacttcgctcggaagaatatgatgcggtgattgatgcgcaaggattgattaaaagtgcggtattggtaaccaagcagtcaaagggaacaaaatacggctacgacaagcattctgctcgagaagggttaagcagcctgttttatgatcaaacttttaatatcgcttaccaacaacacgccgtagaacggattcgaaagttatttgctaactctctgaattatgtacttcccgatggattaggtgattatggcattgccacacattttgcaaaaaaatctgaaaattcaaccgcttatctgcttgcgattcatgcgacaacgagagcggataagcattggaaagaagattattggcgggaagtgattcgagagctaagcatacaagggattgagatacgtttaccttggggcactcaacaagaaaaagagagagccatgcgtttggcggaagcgagtgccaatgtgacggtattaccgaaattgtctctcactgaattagcggaacaaattgccggtgcgaaagccgtgttgtcggtggataccggtttgagccatttagctgcggcattggataaacaaaacgtaattttatacggcgcaaccgacccgaaattaatcggcgcttacggcaaaaatcaacattatctgatcggaaacggtatggcgaatattttaccttatcgtgtcttgcaaaccttagaaacgctgatcacagaataatcaatttatcccgtggcgaatacttgacttttagtccgtataacactagaatctaccgtcctttcgtctttgaaaggatgtttttttaattttatttttaataattttaactggagcttttaaatggcaactatcaaccaattagtacgcaaaccgcgtgtgaaaaaggttgtaaaaagcaacgttcctgcattagaggcttgcccgcagaaacgtggcgtgtgtactcgtgtatacactactacacctaagaaaccgaactcagcattacgtaaagtatgccgtattcgtttaacaaatggctttgaagtaacttcatacatcggtggtgaaggtcataacttacaagaacacagtgttgtattaatccgtggtggtcgtgttaaagacttaccgggtgtgcgttatcacactgtacgtggtgcacttgactgtgcaggcgttaaagaccgtaaacaaggtcgttctaaatacggcgttaaacgtcctaaagcttaatggatctccgttaagtaaggccaaacgtctaaattaatcaaaaaatttaaaccataaactccagtcaatcgtgatgtgctatcacacacaatagatgagttttggattatcctgaatatataaacggagtatttgcaatgccacgtcgtcgtagtgttgaacctcgcaaaattcttccagatccgaagttcggttcagaattacttgcaaaatttattaatgttttaatggtagatggtaaaaaatctactgcagaatcaattatttacggtgctttagaaactttagcgcaacgtactggtaaagaagctttagaagctttcgaagcagcgttagaaaacgtgcgtccaacagtagaggttaaatctcgtcgtgttggtggttctacttaccaagtaccagttgaagttcgtccagctcgtcgtaacgcattagctatgcgttggattgttgaagcagctcgtaaacgtggtgacaaatcaatggcattacgtttagctaacgaactttcagatgcggcagataacaaaggctcagctgttaagaaacgtgaagacgttcaccgtatggctgaagcgaacaaagcgtttgctcactaccgttggtaatcgcttagcgttatatcttaaaggcttcatccaaatgtgtggtgaagccttacccttattaagaattttaatttaaatcccaaacaaggtaataaataaaaatggctcgtacaacccctatttcactttaccgtaatatcggtatcagtgcgcacatcgatgcgggtaaaacaactactacagagcgtatcttgttctatacaggcgtaagtcacaaaatcggtgaagttcacgatggtgcagcaacaatggactggatggaacaagaacaagaacgtggtatcacgatcacatctgctgcaacaacagcattctggtctggtatgtcacaacaatatccacaacaccgtatcaacgttatcgatactccgggacacgtagacttcacaatcgaagtagaacgttctatgcgtgttcttgacggtgcggtaatggtttactgtgcggttggtggcgttcagcctcaatcagaaactgtatggcgtcaagcgaataaatacggtgttccacgtatcgcattcgtaaacaaaatggaccgtacaggtgcaaacttcttacgtgttgttgagcaaatcaaaactcgtttaggtggtaacgcagttgcattacaacttcctatcggtgcagaagacagcttcacaggtgtggttgacttaatcaaaatgaaagcaatcaactggaacgaagctgaccaaggtatgactttcacatacgaagatattccggcaaatatggttgctgaatgtgaagagcgtcgtgcaatgttagtagaagctgcagctgaagcatcagaagagttaatggaaaaattcttcgaagaaggcgatctttctgaagaagaaatcaaagcggcattacgtcaacgcgtattagcaagcgaaattatcccagtttgctgtggttctgcattcaaaaacaaaggtgttcaagcaatgcttgacgcggtaatcgactacttaccggcacctacagatatcccagcaatcaaaggtatcaacgaagacgaaactgaaggtgagcgtcacgcaagcgatgaagagccatttgcagctcttgcattcaaaattgcaacagacccattcgttggtaacttaacattcttccgtgtttactcaggtgtaatcaactctggtgatacagtttacaactcagttaaacaaaaacgtgaacgtttcggtcgtatcgtacagatgcacgctaacaaacgtgaagaaatcaaagaagttcgtgcgggcgatatcgcagcggcaatcggcttaaaagaagtgggtacaggtgacacattatgtgcacaagatgcgccaatcattcttgagcgtatggaattcccagagccagtaatctctgtagcggtagaaccaaaaactaaagctgaccaagagaaaatgggcttagcgttaggtcgtcttgcacaagaagacccttcattccgtgttcacacagatgaagagtcaggtgaaactatcatctcaggtatgggtgagttacacttggatatcatcgttgaccgtatgcgtcgtgaattcaaagttgaagcgaacattggtaaaccacaagtatcttaccgtgaaactatccgtacacgtgttaacgatgttgaaggtaaacacgcaaaacaatctggtggtcgcggtcaatacggtcacgttgtaatcgacttatatccattagacccagaaggtcctggttacgagttcgtgaacgagatcaaaggtggtgtgattcctggtgaatttatcccagcggttgataaaggtatccaagaacaacttaaatctggtccattagcgggttacccagtagaagacatcggtgtacgtttacacttcggttcataccacgatgttgactcatctgagttagcgttcaaacttgcagcgtcattagcgtttaaagcagcgttcgcaaaagctaacccagtattacttgagccaatcatgaaagttgaagtggaaactccaccagactacgttggtgatgtaatcggtgacttaagccgtcgtcgtgcaatggttaatggtcaagaagcgaatgagttcgttgttaagattaatgcagaagttccattatcagaaatgtttggttatgcaacagacttacgttcacaaactcaaggtcgtgcatcttactcaatggaaccattaaaatacgcagaagcacctacaagtgttgctaatgcaattattgaagctcgtaaagctaaataatttatcttttaacttaaagcctcagcaatagggcggaggcttatttctaggaagctatcaaagtgtctaaagaaaaatttgaacgtacaaaaccccatgtaaacgtgggtacaatcggtcacgttgaccatggtaaaacaactttaacagcagcgatcacaactgtattggcgaaacacttcggtggtgcagctcgtgcattcgaccaaatcgataacgcaccggaagaaaaagcgcgtggtatcaccatcaacacttcacacgttgagtacgatacagaaacacgtcactacgcacacgtagactgcccgggacacgcggactatgttaaaaacatgattactggtgcggcgcaaatggacggtgcaatcttagtagtagcagcgacagacggtccaatgccacaaactcgtgagcacatcttattaggtcgccaagtaggtgtaccatacatcatcgtattcttaaacaaatgcgacatggtagatgacgaagagttattagaattagtagaaatggaagttcgtgaacttctttctcaatacgacttcccaggtgatgatacaccaatcgtacgtggttcagcgttacaagcgttaaacggcgtagcagagtgggaagaaaaaattcttgagttagcgaaccacttagatacatacattccagagccagagcgtgcgattgataaaccattcttattaccaatcgaagacgtattctcaatctcaggtcgtggtacagtagtaacaggtcgtgtagagcgcggtatcatcaaatcaggtgaagaagttgaaatcgtaggtatcaaagaaactacgaaaacaacagtaactggtgttgagatgttccgtaaattattagacgaaggtcgtgcgggtgaaaacgttggtgcattattacgtggtacaaaacgtgaagaaatcgaacgtggtcaagtattagcgaaaccaggtacaatcacaccacacacagacttcgaatcagaagtttacgtattatcaaaagaagaaggtggtcgtcatactccattcttcaaaggttaccgtccacagttctacttccgtacaacagacgtaacaggtacaatcgaattacctgaaggcgtagagatggtaatgccaggcgacaacatcaaaatgactgttagcttaattcacccaatcgcgatggacgaaggtttacgtttcgcgattcgtgaaggtggccgtacagtaggtgcaggcgttgtagcgaaaatcatcaaataattaggttttaggcttaatatttgagagcgaaatgctcgagaaaggcgtgtcgaaaggcacgccttttttgctttgctattaggctataccctaaggcttaaaatgatcatttgtaataaatgatcctaatattttttgatactacttgtttatgttttctctcaaattaaaaaagcagagtttaataatatcaaactctgccgagaagatttggttctagtgctagaagcactatgtaatacgaattatcctaaaaaaatacctaagctaaacagcaagttagtgatcagagcaagtcctgccatttgacctaaaatcgggagtagctcaatcgggtctttatgacgatagacaaacaatccgtgttttgccagtaacggcacggcaagcaagaaaaggaagctataccaatgctgaaattcactgattgcaaaaatcagataagaaacgaccgctagtattaatagcgtaacatgataaattcgcccgttttggctaccgatacggacaattaaggtatttttacccgcctgtttatcttggttaatatcacgtaagttattgatatttaaaaccgctactgataacaaaccacagccgaatgccggaataaaaatcatcgctggaatgctatgcgcttgtaagtagaatgtaccgatgacagcgacaaacccaaagaaaatcaatacgaataaatcgcctaatcctagatagccataagcttttttaccaaccgtataggtaattgccgctacaattgaaataacacctaaactgataaacacaattaaatcttgaatagattggtaagcgtaaaccgtcagccctacgccagcaataaaggataaaatactgagcagaatcactgcatttcttaattgcccaccggtaattgcaccgtgctgaattgctcgcaaaggcccgattcgttctttagtgtcggaaccttttacatgatcaccatagtcattagcaaaattagacaatacttgtaataaaatggtggtaataaaagcaagtagtgttgtgattacatcaaaatgtcccgcccagtatgcaagtgccgatcctacgatgatagacgccagagccaaaggcaatgttcttgggcgagcggtagtaaaccaaattgaaaaagcggagtgtttatccattaatcattctcttcctgtttttgtttgaactgttgaatctctttctgaacttcttctaaaagtcgttgttcactcggtagatagaggtggtattgactcgcataaatttgctgctgatgttcaggcagcgtaaattttaccacagcatcgtttttatgcgtacagagtaaaatgccaattgttggtgtttcatgagggagtttttcaattcgatcaaaataattgacatacatttgtaattgcccgatatcttgatgcgttaatttatgtgttttaatttcaactagtacgaaacattgtaacaagcgattatataatactaaatcgacaaaaaattcatcgccttcaatatgtaatcgtttttgacgggccacaaaagaaaatccattaccaagctctaatagaaaatcttgtaaatgggttaaaatggcactttctaaatctttctcatagtaagcgctttctcgtttaagcccgaggaattccaatacaatcggatctttaataatttgtttcggatcactggggataacttgatttttcgccacggctaaaacgctttctttatcattacttaataataagcgttcatagagattactgtaaatttggcgttcaagttgtcgagaggaccaattattttttaccgtttctgcaatataaaattctcttttaacttgatctgaaatacttaaaagtaacttatattgagtccaatttaattgcgtccgcagtgcggacacaattgggaaagtacgataaaactgacggtaacgctctaattgtcttttagaaaatccgctgccatactcaggttctagctgctcggcgagtgatttaattaaatatttaccatattcggcacgttcttgttcttgttgctcttctttaaaaattcgttctccgatatgccaatacataatgacgcgctgaaaatcaaccgagcgaatcgcttgttcacgagcttgatgaataatggttttgatatcgctaacaataagtggatttgctaacatatttgtctccttttgatttttaattatattgtaaataaatacagctaatgagtttatcacaattaaccttaactccaatagggattattcatagcccttatgatgaaaagttttcagtgccacgccaaccgaatttggttaaagaaggcaaaggcatactgaaactattgccaccttataattcgcctgatgccgtaagagggcttgagcaatttagtcatttgtggctgattttccaatttcatcagattcctgagcgagaatggcatgctacggtacgcccgcctcgtttaggtgggaatgaacgagttggagtatttgccagccgagcgacacatcgtccaaatccaattggtttatctaaagtagcgttagaaggcattgagataaataatggagaagtgttattaaaacttggcagtgtggatttggttaacggcaccccgattctagatatcaaaccttatattgcttatgcggatagtgaacctgatgcgcgttccggctttgcgcaagataaaccacaagtcaaactggtggttgagttctcggaacaagcattacaagcggtcaaattttgccaaaattttgcaaatttcggtattacacagccacttgattttattcgcaatgtgattgagcaagaccctcgtccggcttatcaacaaggtaaaatcactgagcggatttatggtatgaaccttgcgggctataatattcgttggcaaatttgtatgcaaaatgccaataaagccattgttctgagcatcgaaaatgaacttaacgagaaaacacacctctaagctaacactttgagttgaactcataatcatcaaggagacaggatgaaattacaaaaaattcttgcaattctaccgcttgctttcaccagtatggtaagtcatgccgaagaaaaagagataacaacaaacagtatgccaactcaattttctttctctacggaagtgagtcgtacggtagaaaaagacttaatgcgagcaatggtttatagccagaaagtcggcaagtcattatcagaactcaaatcaacgatatcgacaaatctgaacaaagtgattgcggatgctaagccttatatgggcattaaaattcagacggaaggtgtaagtagttatcctaattataatcagaaaaataaagtagatggatgggtggtagaaggccgaattctatttgaatccaaagattttgctgcgatggcgaaagttctggacaatttaggcgatgacgtagcgattagtcatatttcatttagtgtttcgccggaaaaaatggcggcgctggaagatgaaatgaccttagatattattaaacaatttcagcataaagcggaagtggtgcagaaaggcttaaatgcaaaacgttataccttaagccaagtacaattagaaacgccgaatggcgaaggaatgcaccagcgtccgatgatggcaatggcaaaaagcagttacgctgcacaggaaagcggcttaccgctggaagcaggcagtgaaacgatttcagcaagagcctccggtacggtgacatttgagtaaaatttatctttttctaagaaaatgtgtaatgttattagcattagacgttttttagaatggctattcaatttaacttaagtggatagcattggaaagcacagacacatctgtgtcatttaattttatttttaaggaaaatataatgaaaaaatatttcgccgagtttttcggtacattttggttagtatttggtggctgcggtagtgcagttttagcagcaggtattcctgagttaggcattggttatgcaggcgtatcacttgcattcggtttaaccgtattaaccatggcttatgcagtaggtcatatttcaggtggtcactttaacccggcagtttcgatcggtttattaatcggtggtcgttttaatgcaaaagatttagtaccttatattattgcacaagttgccggcgcaattgcggcttcagcggtattatatacaattgcttcaggtgcggcaggctttgatgtcacggctggttttgcaagtaacggttttgcagagcattctccacacggttattcaatggtggcggcacttgtgattgaagtggtattaactgcattcttcttaattatcattatgggtgcaaccgacaaacgtgcaccggcaggttttgcaccgattgcgattggtttaggtttaacgttaattcacctaatttcaattccggtaaccaatacttcggtaaatccggctcgttcaaccggtgttgcgttattccaaggttcttgggcaattgagcaattatggttgttctgggttgcaccaattttaggcgcaattatcggtgcattagtgtatcgttttattgctgaagaaaaataaactttagtatcgtataatgataaatgcagcgctatttcggtagcgctgcattttgtatataagagatatgggataaatatgaaatcattattcaaaattttggtgcttactgtaggcagtggtctattaagcggttgtttagtcacttcggttgtgagtggtgttgtcggtacggctgttgatgtggttgatacggttacaccggatattattgattaaatttgcaaatttcgtgcaaaatcagaccgtttgttttaactaagcggtcattttatttctatatttttgcaaaccttttgcaaatctgtgataaaccgctacaatgaatcgtatttttacctaaatatataaaaaggaatctttaatgaaaatcgcaaaaaatgttgttccaagcattgcttatcaagttcgtacacaagacggtgtattagttgatgaagcaccggtaaatcaaccgttagaatatttacacggtcataacaaccttgttgaaggtttagaaaaagcgcttgaaggcaaagcggtaggcgatgtttttgaagttcgcgttaaaccggaagaaggttacggcgaatacaacgaaaacatggttcaacgcgtaccaaaagatgtattcatgggcgttgatgaattagaagttggtatgcgttttatcgctgatacggatttaggcccgttaccggtagtaatcactgaagttgacggtgatgaagttgtggtagacggtaaccatatgttagcaggtcaagagttattattctctgttgaagtggttgcaacacgtgaagcgacattagaagaaatcgcacacggtcacattcattctggccacgaacacggcggttgctgtggcggtcatggcgaagaaggcggctgcggatgtggcggtcacggacatgaccatgatcacgaccatcaccacggccacggcggttgtggctgcggcggtcaccactaatttcgattgatatcattattggcgcaagcggttatcgcttgtgcctttttagttttttcaaatcaacctgacgtacctctcaatacgccgatagttaaagtataaaaatataaaaaatacagagcagtgttatgagcaatccaacaattcaatccggcaccgattatctgcgtgctatcttaagttccaatatctacgaccttgcacaagtgacgccactccagaaaatggaaaagctttccgagcgtctcggcaaccaaattcttatcaaacgtgaagatcgccaaccggtacatagcttcaaattgcgtggcgcttttgcgatgatctcaaatctttcagctagtcaaaaggcggcaggtgtaattaccgcttcagcgggcaatcatgctcaaggtgttgcgctttcggcaaaacatttagggcttcgtgcacttatcgtgatgccgcagaatacaccggcaattaaagtggatgcagtaagaggattcggcggagaagcattgttatttggtgcgaattttgatgaagcgaaagcgaaagcattagaactttccgaagaactcggtatgacttttgtaccgccttttgatcacccgatggtgattgccggacaaggtacaatcggtatggaattagtacagcaacgttccgatttagattatgtgtttgtgccggtcggcggtggcggtttagcggcgggtattgcggtgttgattaaacaggttttaccgaatgtaaaagtgattggtgttgaatccaaagattccgcttgtttgcaacatgcgttgaaagtcggtaagccggataacttggaacgtgtcggattatttgcagacgggattgcggtaagacgtatcggcgatgaaactttccgcttatgtcagcagtacattgatgaagtggtgttggtcgataatgatcaaatttgtgcggcaatgaaagatatttttgaaaacgtacgtgcggtggcagaaccttccggtgcgacttcgttagccggcttaaaaaaatatgtgaaagaacatcagcttgaaggcaaaaatttagcttgcgtgctttccggtgcgaatttgaatttccatacattacgttatgtttcggaacgttgtgaaatcggtgagaaacatgaagccttattagcagtaaccattccggaacaaaaaggtagtttcttaaaattctgtgaaattttaggtaatcgtgcggtgaccgaatttaattaccgccatgcagatgatcatcaagcttgcatttttgtcggtgtgcgtattaccggcagcacagaaaaggctgagattattcgggatttacaacaaaacggctacgatgtcacggatctttcagatgatgatattgcgaaaacacatattcgttatatggtgggcggacgtccaaccaatcttgcgaatgagcagctttatagctttgaattccctgaacaaaaaggtgcattattaaaattcttacaaacgctaaccgattgggatatttccttattccactatcgtgcgcacggggcggactacggtgatattttggcggcgtttgcgttaaatagtgaagatgaaaccaaatttaaacaacatttggaacaacttggataccgttatcagaatgtaacggagagcccagcgtatcgttattttttaaaataaccggctagcagcgaattttttgtttaaattgttgtctaagcttttgcaatttatagcttttttcttattaattttttctactctctttcgaggatttaaatatggcagaacgtaaatattttggtacggacggtgtacgtggcaaagtaggtcaatttcctattactccggatttcgcattaaaactaggctgggcagcaggtaaaattcttgcaacacaaggcacaaaaaaagttttaatcggtaaagatactcgtatttctggctatatgttggagtcagcattagaagcaggtcttgcggcagcaggtctttcagctgcatttgtaggccctatgccaacaccagcgattgcttaccttacccgtactttccgtgctgaagcggggattgtgatttcagcatcacataacccatattacgataatggtattaagtttttctcgaatgtcggtgagaaattaccggatgaagtagaagaagcgattgaagcacttttagatcaaccgatggattgtgttgagtcagcacaattaggtcgtgcaacgcgaatcaatgatgcggcaggccgttatattgaattctgtaaaggaaccttcccggcaaacgcaagcttgaaaggctataaaattgtagtggattgtgcgcacggtgcaacttaccatatcgcacctaatgtcatgcgtgagcttggtgcggaagtgattgagatcggtacgaaaccggacggtttaaatatcaatgaaaaatgtggtgcaaccgatattaccgcattacaaaaagttgtcgttgaatcaggtgcggacgtaggtcttgcttatgacggtgacggcgaccgtatcatgatggttgaccatttaggtaataaagtagatggtgaccaaatcctatttattattgctcgtgaagcattacgttcaggcaaattacacggtggtgtagtcggtacgttaatgagtaatatgggcttagaagtggcattaaaacacttagcgattccatttactcgtgcgaatgtcggtgaccgttacgtattagaacaattaaaagaaaaaggctggaaactgggtggcgaaaactcaggtcacattatcgtgttagataaaaacaccactggtgacggtattatcgcttctcttgaagtacttgcagcgatggaagcgcataaaatgagcttaaatgatcttgcgcgtgcagtgccgttattcccacaagtgttacttaacgttcgttttgaaggcggtaaaaatccgttggaaagcgatgcggtaaaagcggtggcggcagacgtggaaaaacgtctagcaggcaaaggacgtattcttctgcgtaagtctggtacagagccactcattcgtgttatggtggaatgtgaagacggtgcattagcacaaagctgtgcggaagaaatcgttgaagcggttaaaaataactaactaatgacaagcggtcgaatttttgcaaaaatttgcggaaattcgaccgcttttcttattgcgactttcttggtcagtagccgaaaagaagcatagcgttttactctcatcttaaaataatactaactaaaaaaggattcattatgacccaacaagaaatgaaaaaaattgctgctcaagctgcgcttcaattcgtaaaaccggatactatcgtgggggtggggagcggttctaccgtaaattgttttattgatgcattagcgtcaatgaaagatcaaattaaaggtgcggtggcagcatcaaaagcttctgaagatcgcttacgcgcgatcggtattgaagtgtttaacgcaaatgaagtgattgaattagacgtatatattgacggtgcggatgaaattactcctcaaggcgcaatgatcaaaggcggtggtgcggcattaacccgtgagaaaatcgttagttcattagcgaagaaatttgtttgtatcgtagatagctcaaaacaagtggatgtactaggttcaaccttcccgttaccggtggaagtgattccaatggcacgttcttacgttgctcgccaattggtagcgttaggcggttcaccggaatatcgtgaaggcgtagtgactgataatggcaatgttattttggatgtacacaatttccaaattcttgagccattaaaaatggaacataccatcaataatattgccggtgtcgtgacaaacggaatctttgcacagcgctatgcaaacgtaactattgtcggtactcctgaaggtgcaaaaattatcgaataatcgtactctttgatacacggaatgtaatgataaagcttataacgataagttctgttaaagtgaaaaatattccgtgtatttcgttaggcaatgtgataaaagtaaaagcaaacaaaacacacaaggacctaaaatgacaactcctatcgacaaatctcaaataaaatttcttttgctagaaggcgttcatcaaaatgcattagacgtgctacaggcggccggttataccaatattgaatatcataaaaaagcgttagacggtgatgacttaattaatgccattaaagatgcgcattttgtaggcttacgttctcgtactcatttaactaaagaagtattagcgcatgcgaaaaacctagtgtcgatcggctgtttttgtatcggtaccaaccaagtcgatttaaatgaagcgaaacgtctcggtattccggtgtttaatgcaccgttctcaaatactcgttcggtagcagaattagtattagccgaaattattctcttaatgcgccaagtgccgaaagcgaatgcggaagtacatcgtggcgtatggaacaaatccgcagccggctcaaatgaagtacgtggtaaaaaattagggattgtaggttacggtcatatcggttcgcaattaagcgtgatggcggaatctatcggtatgcaagtgtatttttatgatattgaaaataaactgccgttaggtaacgcacaacaaattgcaagcctcgatgagttgcttgctagctgcgatgcggtttcattacacgtaccggaaaatgcttcaaccaaaaatttaatgaatgcggctcgtattgcgcaattaaaagaagattcggtgttgatcaatgcggcgcgtggtacggtggttgatattgacgctttagcagcacgtttagcgcaaggtacgttacgtggggcggcgattgatgtattccctgtagagccggcttcagttaatgatccgtttgaatcaccgctatgccaattcgataatgtgattttgactccgcatatcggtggttcaactgcagaagcacaagcgaatatcggtacggaagtggcaagcaaattcgttaaatatgcggataacggctcaactctttcagcggttaacttccctgaagtatcgttaccgattctgcacagcgatgcgaaacgtttgttacatattcacgaaaaccgcccgggtattctgaataagatcaaccaagtattcgtagatggcaacgtgaatattgccggtcagtatctacaaaccgatccgaatatcggttatgtggtcattgatgtggaattagacgatgcaagcgaagcgttagaacgcttacaacaaattgacggcacaattaaagcccgtgtgatttcataatatttatatcaaatgacaagcggtgaaatttgcaaagttttctgcaaatttcaccgcttattttttatctttcgattacttcaaacattgactgaattcatcagcaatcgcttgtaagaattgcggataagcggtttgacttaattcgatttttgcgccaagcggatctaattgtccgactttaacttgcgtacctttgctgaggctttcaatcactttcggtgtgaattgaggttcggcaaataaacattgcgccttgtgttcagcgatatttttcttaattacgcttaacgttttcgcacccggtgctacacttgggttaatggtgaatgaacctaatgaatttaaatcgtaggtacgctcaaaatagccataagcatcgtggaaagtataataacctttacctttcactacagctaattgttgacgaatttgttcactcttagtggttaaatttgctttaaatgttgcaagattctccgcaattttcgctttttgctccggtaattgtacgcttaggcgtgctgcgatctgttctgctgcggcaaggcttgcttcaggcgagaaccaaatgtgccagtctttatcatggctgtggccttcgtgatcatggtgatgatcatgaccttcatgagcgtgttcatgatgctcatgtttgtgatcgtggtgttcgtgtttatgaccgtgttcatgcttatggtcgtgatcatgctcatgttttttatcgtcatcatgatcatcatgtttttcagtcgcatcgacaattgctttaattgccggtacatcatctaaactaagcactttctctttcggtaatttgtcgatacttttttctaaaaacgtttctaaatcttcacccacccaaaccacaagttgcgcagattttaactgctctacatcagatggctttaagctgtaatcatgcggagatgcggtcaccggcaataacaccttgctctctgtaacgccttctgtgattgcgcttgcgataaagcctaatggtttgaccgtagtaagtacatcggcatttgcgactgcggttgtgcctagcatagctaatgctaaagcggttttcttaaacatagtattctccttttggattaaagttgagcgattctatcaaactttcgtaaaattgctatatagtttagcataaattttttatgggtatttttcatttgttgttttctatatactagcggtcagatttttctgattttttaccaatatgaaatacaaagatttacgtgaatttttagtgctgttggaaagccaaggcgaattagtgcgagttaagcaggaaatcgatccttatcttgaaatggcggaaatttccgatcgcacattacgcaaaggcggaccggcgattttatttgaaaacccaaaagattatcaaatgccggtactctgtaatctgttcggtacaccaaaacgtgttgcgttaggtatggggcaagaagatacacacgccttacgagagctggggaaattattagcgtttctcaaagagcctgagccaccgaaaggttttaaagagctgatcgggcaattaccgcaatggaaacaagtgttgaatatgccgagtaaagtcttgggtaaagcggattgccaacaaatagtattaagtggcgatgaagttgatctgtataaattaccgattatgcattgtcacgaaggcgatgttgcaccgcttgtcacttggggattaaccattacccaagggccttataaaaaacgccaaaatcttgggatttatcgccagcagctgatcggcaagaacaagctgattatgcgttggttatcgcatcgtggcggtgcgttggatttccatgaatggaaggaagctaatccggataaaccgtttccggtttcggtggctattggtgccgatccggcaactattttagccgcggtcacaccgattcccgatactttatcggaatatgcgttcgctggtttattacgaggtcagaaaactgaggtggccaagtccattagtaatgatttggaaataccggcaagtgcagaaatagtgttggagggttatatcgacccgaatgaaacggcactagaaggcccgtacggcgatcataccggctattataatgaacaagagtattttccggtatttaccgtgacgcatatcaccatgcgtcgtgatgcgatttatcactcgacttacaccggtcgtccgccggatgagccggcagttcttggcgaagcgttaaacgaagtatttattccgattttgcaaaagcaatttccggaaatcgtggacttctatctaccgccggaaggatgttcttatcgccttgcagtggtgacgattaaaaaacaatacgccggccatgcaaaacgggtaatgatgggcgtttggtcgttccttcgccagtttatgtacaccaaatttgtgattgtctgtgatgacgatgtaaacgcaagagattggaaagacgtgatttgggcgattactacacgttgtgacccgagccgagatacgactttaatcgatcatacaccgattgattatctggatttcgcttcaccgattgcgggcttaggctcaaaaatggggattgatgccaccaataaatggcagggcgaaaccagccgtgaatggggtacaccgattaaaaaagatccgaatgttgttaaacgtgttgatgaaatttgggatcaattagggctataactttaacaatacggtgaaaagttcgctgaaaatcacaagagcaagcggttaaatttccttaaaaatttaccaaataaaaacagcttatttcagcagctttcgccgtgtttgatttttattttctattaccatttattaaaggagaacttatgttactggtaaatcttacctttgttagcttttttattgtccgtttgtatagtttgagcatttcgattagaaatgagaaagtgcttatccaaaaaggtgctacgcaacacggcactaaaaattcaaaactattatctattgtgcatgtcctgttctatttttctgcgttgtttgaagcgaattattttgcccatcattgggactatctcagcacgatcggcacagttactttatttttcgcctatattgcgctcttttgggtgatcaatgaattaaaagaaatttggacggtgaaactctatattttgccaaaccataaaattaacacttcaacgttattcagaacgattaaacaccctaactatttcctaaatatcattccggaattaattggcgtggtgctactttgtcatgcatggaacacattgatgtacttattccctatttacctcgttgtattaggtattcgcatttatcaagaagaaaaagtgatgaagccgctgtttgaacaagttaaataagtaccaaataacaagcggttaaatttgcaaaattttctgcaaatttaaccgcttgcttatatgacttaattactcattttcagcttggatatgatccggtgctaaatcgtagccgtctttcggtttacgttgatattccgtattgagtaactgattaatttcgtaccaaggtacagtcaggctgatttcaccttcagcgaatgggcctaatgcatacggcggataaataaatttcaccccatcatcggtaaataagaaatcttccgaaacataaaagtcttgtttcggggtaaaggtgctgtatttgccgtttgcatccggtttgttacgctgttcgtaatgactccacaaaatcgcagagagttccacttgttttgctggagagagtaagtcatccagtaaaataatacgttttttatttacatcgatattaaaatatttggtgtggtagttattatgtgcgccgccgctgtattcgtcatagttttggaaaaaggtcacgatattatggcgttgtcctaaataaatcgtttcggcggtgcgagaaataccgagtgtcattccttcttttaacgtttctaaactttcctgataatctttttctaataccgttttcaactgatttaactcatcaccgtttatcgcattacgatcgattttactgtcggcatccgccggaacaggctgatagctaattaaaatctgtttcgccaataaattatccaaccaatcaaaaccagttttggcaaggctgatgaaataatattgttctgcggaaagaatcgcttgttcttgattcgcctccggtttgaattttatgcgctccgctttagcaaaaaatggataaatttcaacgtgtaatgccggaaaagtagctaatgtatcacctgtttttcccgcaatcgattgctgtaaagcggtcaattcttgctgagattttgcaagctgttcatttagttgagaaattttttgttcggcttgttgtaattgtgttgtagtagatgcagaatttttctcatcgcaagcggagactagcatccccattgcgaccactattgctaataatgactttctcattaaattctcctttaaaataaagcttaaattccatacaaaaatagcaaaaattcaacaaattgcaatattttctaaataaataggctactcaaaccagcgatatttgccttgcctattaaggccttaaaatgcaataatggtacgctttttcttgtcataaaaattgcacggcaatttagtaaaaaatgacgcaaaaagcaccgcttgctaagttgcaagtagaaaagctaagtgattgattctgcggttaattcgagacaagaagaatgaaacgtaagacaaaatcagcacaaattgagccacttaattaaaacctactttttgacagtcgggagactgcccgaaatccaataagaatacaaaggtatttcagataatataagaaggatttaattcagcgtattaatgcttaaaaagtatgtttaattggagcggcaatttaagaacaaaaaacaaataatgagaaaacacaatgaaaagaatgttaatcaatgcaactcaaaaagaagagttgcgcgttgcactcgttgacgggcaacgtttattcgatttagatatcgaaagcccgggacacgaacaaaaaaaatcaaatatctacaaagggaaaattacccgtgttgaaccaagccttgaagctgcattcgttgattatggtgcagagcgtcatggtttccttcctttaaaagaaatctctcgtgaatacttccctgcggattatgtattcaacggtcgcccgaatatcaaagatattatcaaagaaggacaagaagtgattgtccaagtgagtaaagaagaacgtggtaacaaaggtgctgcgctgacgacttttatctcacttgccggtagctatttagtattaatgccgaataacccgcgtgcaggcggtatttctcgccgtattgaaggtgatgaacgcttagaattaaaagaagcgttagattgcttagatgtgccggaagacgttggtttaatcgtgcgtaccgccggtgtaggcaagtcaccggaagagcttcaatgggacttaaaagtgcttttacaccattgggaagcgatcaaaaaagcggcggaatctcgtccggctccattccttatccatcaagaaagtgacgtgattgttcgtgcgatccgtgattatcttcgtcgcgatatcggcgaaattttaattgataacaaaaaaatcttcgaaaaagcgaaaaaccatattcgtttagtgcgtccagatttcatcaatcgtgtgcgtttatatgaaggtgaagtaccgttattcagccattatcaaatcgaatcacaaatcgaatcggcgttccaacgtgaagtgcgtttaccgtcaggtggttcaatcgttattgacgtaaccgaagcgttaacggcgattgatattaactcatcacgctcaacccgtggcggcgatatcgaagaaaccgcactaaataccaacttagaagcggcggatgaaattgcacgtcaattacgtttacgtgacttaggcggtttgattgtaatcgattttattgatatgaccccggtgcgtcatcaacgcgaagtagaaaaccgtatccgtgaagcgacacgccaagaccgcgcgcgtattcaattcggtcgtatttcacgttttggcttgttagaaatgagccgtcagcgtttaagtccgtcactaagcgaagcatcaagccatgtatgtcctcgctgccaaggtacgggtaaagtgcgtgataacgaatcgattgcactttcgattttacgtttattagaagaagaggcgatcaaagaaaataccgcccaagttcatactattgtgccggtgcaaattgcgtcttacttactcaatgaaaaacgtaaagcgatctcaagtattgaaaaacgccatgatgtacaagtggtggttgtgccgacagaaagcatggaaaccccgcatttcagcgtatatcgtttacgtgaaaatgaagtgttaccaacacttagctacgatttagcgaagcactaccatgctcgtgaagaagatactcaaccgaatacacatacagtttcggaagaagcgttagtgacacgtaatgaaccggtgattaccgtagaatcagtgttacaaagttctgagttaaatcttcaacctgcaccgacaccggtagcaccggcaaaaccttcactcctaagtcgcttaattgcaaaagtgaaaagcttatttgcaacggaagaaaaagttgaagaaaaaccgaagccgaaggctcgtaaccaacgtgagcgccgtaaccgtcgtgagcgtccaaatcgtgcagaacgccaagagcgtaaacagcaacaacaagacgagcaaaaggcacagcgtcaggaacgtaaccaagagcgtgcggaatcgaagaaagctcgccgccaagtggttgaagaagttgcaggcgctccagaaactcaaacggaacaagcacaacgtccgcaacgtgaaaatcaagtagcggaacgccgccaacgtcgtgacttacgtaaaaaagtacgtgttgaagcgaatgacaacaacgctattgaagcaaaccaagcagcggtaaatccggttgtagcaaaagctgctcctgaaaaagccgtagcggaagcgaagcctcaagcatttgtgagtccggaagtgatttcagctgtaacggagagcaaaccgtcagacgaaagtgtgaaagctgctgtgcaagacagcagttcggatgttgttgcggaagaacgtacggagcagcgtgaaaataatcgccaacgtcgtttacctcgtcatttacgtgtgggtaatcagcgtcgccgtgaaaataaccgccgtgaacattctgcggtagcagcaatgcctttagctgcagcggttgcttctctggaaatggcaagcggtaagatttgggtgaaatttagcaaccaaccagtggctacaaaagctgcaccgaaggtagaagagaaaccgcgtttcttatctgtagatgaaatgttagagcaacaacaagagccggaagttgtaccaacagcgccaaccgttgagaaaagcgtgaactctgcagcaccttttggcgcttttgttacccagcattctgatcgtgatttagtgaaagaaaacaaagaacgtgcgcagcatattgtatctgatgagccgaaagaagatgcgcagttggtggaaaaagcaatggcaaaacacgttgcgccactaggtggttttgtttctcaacatactgatcgtgatttagtaaaagagaaaaatgaacgtgtacagaaacaccaagcgcaagcaacttctgcaccggcacttgaaagtgtaagcacagaagagattgttgctccggtatcaagctatgaaagtagctatagtttctctggtcatttaggtacattctctcgtgtacaacatacaaaagctgcgatgacggtggcatcagcaccggcagaaatgcctgccgaagcaaatgtcacggagtggactcagtcaaaatattacttccatggtaaaggttttggtggtcattccagtgcggtaagccatgtacattcagcaccacgtattgcaggtgcagaagtggaataaccgttaattcatcgttttcaaaaagccaattgtttagtcaattggcttttttttgtgcaataaagctgttatagttgcaacttctgagaataagctcagtctaaaaatcccgaatgcgcttgatttaataagtcgcagactctctttttacataaggaaaagcaaatgaaaaaatctcttttagcattagtattaggtgcagcgtttacattaagcgcttgtgatcaagcaaaccaagcgaaagacgctgcagcggcaaaagttgaagaagcgaaagtagcaactcaagaagcagcacaagcagtagcggataaagcggctgaagtgaaagatgtagcagcagctaaagctgaagaagcaaaagcagcaactcaagaagcggcacaagcagtagcagataaagcggctgaagtgaaagatgcggcagcagcgaaagcagaagaagcaaaagcggcaactcaagacgcagcacaagcagtagcggataaagcagcggaaatgaaagatgcggcagcaaataaagcggctgaagtaaaagacgcagcagcagcgaaagcagaagaagcgaaagcggcaactcaagacgctacacaagcagtagcggataaagcagcggaaatgaaagatgcagcggcaactaaagttgaagcagccgctgaagctgtaaaagaaaaagcaactgaagtaaaagaagcagttgaaactaaataattcttgctaaggtatctccaaaccaaagcaaaaaagcccgcaattttgtgggcttttcttttggaaaattattctatttgatcgttttaatgtgaataacttgtgagtattaaaaagccggatatttctatccggcttttatgttttaattacaacgcttcaatcgctttatattgcccttgcaatttctctaaaccattttggtactcttgcattttttcacgctctttagcaatgactgcttccggtgcttttgccacaaaggcttcgttgctgagtttgttttcaatgcgagtgatttcaccacgcattttctcgatttctttggttaatcgagcaagctctgcttctttgttgataaagccagccattgggataagtacttctacgttacccactaatttcgctactgaaagtggggcagtttcgtccgcacttagcacttgtacgctgtctaatttcgccatcgcttttaacaagcggtcattttccgctagaattttgcgttgctcgtcagatacgttgcgaacaaggaattctaagcctttgcttggtgcaatgttgctttccgcacgaatgttacgcacagcgatgattaactctttaatccagccgatttgcgcttccgccgcttcgtctaattcgctttccacgactttcggtaacggttgtaacataatggtatccgcatcaatgcccgcaaagcctttcactttctgccaaatttcttcggtgatgaacggcataatcgggtgtgctaaacgtaataatttttcaagcacacgcacaagcgtttggcttgcgccacgtttttgcgcttcggtaccatttgcaaatactggtttggttaattctaaataccagtcgcagaactcattccatgtgaagtcgtaaattgcgtttgccgctaagtcgaaacgatattggcttaatgcgtcacggaatgtgccagctgtgcgattgaacgtagattcaatccagcgatccgctaagctatattccacttcgcctgctgataaatctaatttatcattagttaatacgaaacggcttgcattccataatttattacagaagttgcggtagccctctaaacgtttcatatcccagttgatatcacgaccgttacttgctaatgccgcaagggtgaaacgcaatgcgtccgtaccgtgtgcagcgataccgttctcaaactctttgcgagtcgctttagcaattttttctgcaagttgtggttgcatcatattgccagtacgtttttcgagtaaatcctcaagtgagataccgtcaatcatatcgattgggtcaagcacgttacctttcgatttcgacattttttgaccttgctcatcacgaatcaaacccgttacatacacggttttaaacggaacttgtggtttgccgttttcatctttcacaaagtgcattgtgaacataatcatacgcgcaacccagaagaagatgatgtcgaaaccggtgattaacacgtcagtcgggtggaacattttcagttctttagtttgctctggccagcctaaagttgagaacgtccacaagcctgatgagaaccaagtgtctagcacgtcttcatcttggcgtaacgcaagatctgccggtaaattgtgtttttgacgcacttcttcttcgttacgagccacatacacattgcctgcttcgtcataccacgctgggatacgatgtccccaccataattggcgagaaatacaccagtcttgaatatcacgcatccaagagaagtaaaggttttcgtattgttttggtacgaattgaatttcgccgtcttccaccgctttggttgctacttccgcaagtggtttcacactcacataccattggtcagttagcattggctcgattggcacaccaccacggtcgccgtaaggcactttcaaatcgtgcggtttgatttcgtctaataaacctaacgcttcaaaatccgccaccacttttttacgcgcagcgaaacgctctaagccttgataatccgcagggattttcgcttcataagtcgttagtggtttaccgtctgtgccgataatttccgcttccgcacggatatccgcattcatcgtcatcacgtttaccattggcaagctgtgacgtttacccacttcatagtcattgaagtcgtgtgcaggggtaatttttaccacacccgtaccaaactcacgatcaacgtattcgtctgctacgattggaatttcacggtttgcaagcggtaatactaccgttttaccaattaatgattggtaacgttcatcttcagggtgaaccgccaccgctgtgtcgcctagcacagtttcaggacgagtggtcgccaccactaaataatctttaccgtcagcggttttcgcaccgtttgccaacggatagcggaaatgccaaagtgaacctttgctctctttgttttccacttctaaatctgaaattgcggtgtgaagtttcggatcccagttcacaaggcgtttaccacgataaattaagccttcttcgtgtaagcgaacgaacacttcttttaccgcattcgataagccttcatccatcgtgaaacgttcacgatcccagtcgattgagttacctaaacggcgcatttgttggctgattgtgccgcctgaatacgccttccaatcccagattttattgatgaaagcctcacgcccataatcgtggcgagttttgccttcttccaccgcgattttacgctccaccaccatttgggttgcgatacccgcgtggtctgttccggtttgccaaagggtgttattaccttccatacggttgaaacggattaaagtatccatcaaagtttgttggaaagcgtgccccatatgcaatgaaccggttacattcggcggtggaattgcgatacagtaacttggaacgtcaggattctcagtcggcttaaaatagccctgttcttcccagtgtttataaagtgcttgttctactgcagacgcatcgaaacggtctgccatttggaggttttgggtcattgtttttctctttgatataaatttgtgtaggtagcttacaacccacgcacggcaagccgtacgtggttaggatcagccttcggctgagtgagccacgctgtggctcggtattttttctaactttcagccctagcagggctgagttatgcttaacctagtacggctttgccgtgctaggatttatcggcatactcaatcacttcttcacgtccatccacgctttaaattgaatttgtagttggcgttgttgttctctaatttgttcaattttggtcatttgatttctccaaaatttgtaaaattttatggaagttcaaccgcttgcaacccacgcacagcaagccatacgaggttacgatcagccttcggctgagtgagctactctgtagctcggttttcaaatctccccccagcccctctttactaaagaggggagttgtcttgtggtaatgtggagaacgctattcttccctaaaccagttcccctctttagcaaagaggggttaggggagatttgtccaataccatatccaaataaggtatgctgtttttctggtaaatcgccgaaaccgcttaaaatttctagccctagcggggctgaactatacgtaacctagtacggctttgccgtgctaggatttatcggcatgttttatgacttcttcgtggccatcaggataatgtcgaacaatatttccattcggtcgctgaaacgttagcacttcacgctttttcttatcatccatccacgctttaaattgaatttgcagttggcgttgttgttctttaatttgttcaattttggtcattttctttctctaaaatttgtaaaattttacggaaattaaaccgcttgctcagctgtgctaggcatcggcattgccttaacttttagcctgttcttgatttgccggtgtttgatggcattcttttaatttaaacacgtgttggaattccggatctcgagctttctcgtagaatgcgtggaattttcgaatttcatcttctaagttaaccgtacgaataatttgttcttggatataatcgtgtttatttcggtttgcttctaaataacaggtgatggttaccgtttcgaattcaacttgtgcgctgagttgcagatctttataaggaatgcgtagcgcatggaaattgtcttgtacatatagccttaggtgttcgctaagttgttcattaaaaaagttgaagaatttatagttattgacatattcgtaatagtctatgtcgaaaatattttcacagctaaagcgaaaatacatcatttctctatcaatttggcgatatacataatatgccgcactcaataataaaatgatgagaataaggtaataaagattgtccatcatcaattctttccatacatacaattgttaacgtgttaacgccatatccaaatgcgggatgttatcttccaaataaacatcggaaatcgcattaaaaccgagtgattgataaaactgggctaaatgagattgtgcttggatatatatagtgtgctgcggccaagtttgtttagcgtaagcaattgctgtttgcattaattcacgagctaagccagaacctcgagcttcaattgcaaccagcactcgaccgatatgtacgccatcttcttgcaggaagatacggcaataagcggtcaaattctgttgtttttttgcgaaatggtgataagcgataagatctttatcatccacttcttgataggggcaatcttgttcaaccacaaaaacggcagtgcgtaatttgtagatttcaaataattccgttgtggaaagttgttcgaacgatttggtttgccacatattatgcttgtactgtttcaagttgccagccaagttggcgatattgtttgtaacgttcgcgcgcttgggctttctctgcctcatccgccggtacaaaatcaataatttgattaaagctattaataaagtccggtagatttttctggagcgaaataagcaaatcacgacgctgtgcattgcgtttgccaggccatgatatttctattggcgtggcatattgggtaacttcgccagaaagattatgcggtacaaaagaatcgggatctctcgcccataacgcttcatcaatttttagggcttgttgttcggtttcgcaggcgatcagcactcgtttgccgagtttccaagcctgagcacttaattcacaagccattgcttcggcggcgctgagatcttcagaagacgcttggctcagtaaataaaatttaacttgtttcacctaactgccctaataaaataatcaaaaataacaaaagggattaattttagccgaaaatgtggaaaatttgaaatgtaagcggtcatttttgcaatattttttgcaaatttaaccgcttgttgtttgaatttagtgaaatctatctgaaatgaagtttgtgttaagtgaaatttgtgatgctttgcctattgaaccaatcttagttttgcggttctaactttgtgatttggctatttcaatcaccttataatggtgtaaaatatagcctcccttaaacctaactttagaggactttaccatgggtttatttgattttgcagcgaatatcggcaaaaaactttttaataaagaagaagaggcatcacaagccgtaacggaacatttaaatgaagacaatccgggcgttgagaatgtacaagtaaccgttgaaaacggtgtagcaaatttaagcggtgtggcggcaacggcagctgcggtagaaaaagcggtgttaatggcgggtaacattgaaggtatttcagaagtgaaaatcgacggtgttcaaattgctaacggcgaagcgcttgcaggtgatgacgaattctatgtgattcaaaaaggcgatactttatgggaaattgcaaccaaagcttacggtaacggtgcaaaatataaagcgatcgttgaagcgaataaagaagtgatcaaagacgagaacaagatcttcccgggtcaaaaaattcgtattccaaaaagcttataatcttttaggaaagaaggcgtaacctaacgctattgcaaaaaatcagtaaaatcgcaccgcttgttcggtaaattttgctgattttttcatttctgcgccatcatttggcagatgttctgcgcaatattcctcgacagcccattgacataacgttacaatggatgtctatttctgtatcttttatatacccacaacttgaggtttaagaatgtcaatttctattgaaactttagaaggcttacaacgccgtgtaactattactgtagctgcagacaaaatcgaagcagcttataaagaacaattaaaaggctatgcgaaaaacgctcgtgtagatggtttccgtaaaggtaaagtaccacacgcaattatcgaacaacgtttcggtttagcggctcgccaagatgtattatctgatgaaatgcaacgtgcattctttgatgcagtaatcgctgagaaaatcaaccttgcaggtcgtcctacattcactcctaacaactaccaaccaggccaagaattcagcttcactgcgacttttgaagtattcccagaagttgaattaaaaggtttagaaaacatcgaagttgaaaaaccggttgtagaaatcacagaagctgatttagacaaaatgatcgatgttttacgtaaacaacaagcgacttgggctgaatcacaagaagctgcaaaagcagaagaccgtgttgtaatcgactttgttggttctgttgacggtgaagagtttgaaggcggtaaagcgacagacttcactttagcaatgggtcaaggtcgtatgatccctggtttcgaagagggtatcgttggtcacaaagctggcgaacaattcgatatcgatgtaactttccctgaagaataccacgctgaaaacttaaaaggtaaagcggcgaaattcgcaatcacacttaagaaagtagaaaacatcgtattacctgaattaacagaagaattcgtgaaaaaattcggttcagcaaaaactgtagaagatttacgtgcagaaattaagaaaaatatgcaacgtgaacttaaaaatgcagtaactgcacgtgttaaaaaccaagtaatcaacggtttaatcgcacaaaacgaaattgaagtaccggctgcagcagtagcggaagaagttgatgtattacgtcgtcaagcggttcaacgtttcggtggtaaaccggaaatggctgcacaattaccggcagaattattcgaagcggatgcaaaacgtcgtgttcaagtaggtttattactttcaactgtaatcggtactaacgaattaaaagttgatgaaaaacgtgttgaagaaacgattgcagaaatcgcttcagcttacgaacaaccggcagaagttgttgctcactacgcgaaaaaccgtcaattaactgaaaatatccgtaacgtggtattagaagaacaagcggttgaagcagtacttgcaaaagcgaaagtaactgaaaaagcaacctctttcgatgaagtaatggctcaacaagctcagggctaattctcaaatacaaagctctccgttttggagggcttttaattagcattttataagcggttgattttagaaaaaaatttgcaaaaatttctctaaaaataaccgcttttattttaaccaaaagagaatttagtcatggatttaacctttactcagcaacttcaacaatttgttagcgctcacccgatccttgtgtttgcgtggattgcggtatttgttgcagtgctatttagtctttataaaggcgctaccagtaaatttaaaacaatcgaacacgcacaggcgacccaacttgtgaacaaagaagacggtgtattccttgatttacgttcagaagatgagttccgctcaggtcatatcgtagatagccaccatattctgccaagcgaaatcaaagcgaataatgttcacccgattgaaaaatataaagatcgtccggtgatcttggttgatactaatggtttttctgccgggacaagcgcagatttacttgcaaaacaaggctttagcaaagtatatgtgctaaaagaaggtattttaggctggcgttcggcaaaccttccaaccgttaaaaaacataaataatttagttaattaaggaaatattatggctgaagaaaatcaagttgctgctcaagaagaacagctcccatttgaacttcaaattcaacgtatttatatcaaagacgtttcgtttgaagcaccgaacttaccaactatttttcatcaagagtggaaaccgcaattaggctttgagcttgatactgaaacaaaacagttagatgaagacctttatgaagtggtattacacattaatgtttcaaccacattagaagatagtggtgatactgcatttatttgtgaagtaaaacaagcgggtgtatttacaattaagggcttagaaggccttcaattggcacattgtttagcatcacaatgtcctaacgtgctttatccttatgcacgtgaattaattgctagcctagtaaaccgtggtacattccctgcattgaatttatcaccggtaaacttcgatgcactgtttatggattacttacaacgccaagaagcagagcaaaacgcagaagcgccagcagtaaactagtcttttttaaaggtatgcaattttgcatacctttttctttacctctccaattctgcttatcacaacgtaaaactttgtataggtttaagttgcctgaattgacggattcacatcaaatgatatattgagcctttctattttagttagtccattttgattccaatctctaaatacttcattgcataaggataatattaatgagtgaaatatattccgcgcctgtcacggttttaggtgcaggttcttatggtacagcactagctattgcgctggctcgtaatggtcataaaacttatttatggggacaccagccggaaaaaatggcaattttggccgcggaacgaatgaataatgcttttttaccagatatagcttttccggacgctttggaagtggaaagtgatttagctcaagcgcttgccaaagcaaaggatattttgattgttgtgccaagccacgtgtttgctgatgtattgatgcaaattcgtccattattgaatgctcatcatcgtattatgtgggcaacgaagggattggaacgtaataccggaagattattacaaacggttgccgaagaaattcttggtactcaatatccgctagcggtactttccggcccgacttttgcaaaagagttagcacaaggtttaccgactgcaatcgctttagcctcaaacgataagcaatttgctgacgaaatgcagcagcgtattcactgttccaaggcttttcgtgtttatttaaatagcgatatgattggcgtacaattaggcggtgcgattaaaaatgtgattgcaattggggcgggtatttctgatggtatgggatttggagccaatgccagaacagcgttaattacccgtggtttggcggaaatcagccgtttaggcgcatcacttggtgcaaatgctaacacttttatgggaatggcggggctaggcgatttagtgttaacttgtaccgataatcaatcacgtaaccgtcgtttcggcttaatgcttgggcagggtaaatctgctgaggatgcaatggcggaaatcgggcaagtggtagaaggtttttacaataccaaagaggcgtatttactggctcaaacccaaggggttgaaatgccgattgttgaacagatctaccagatgttattttgtggtaaaaatgcacatgatgttgttgcaactttattagggcgtgaacgcaaaggcgaataaagaggttttacatgaacgaaagcgaacttaatcaaatttggcagaatatccgagaagaagcgcaggaattggttgatagtgagccgatgcttgccagctttttccatgcgactattttaaagcatagtaatttaggtggctcactgagttatatcttagccaataaactggctaacccaattatgccagcgattgcgttaaaagaaattattgaagaagcctatcaggctaatcctcaaattattgctagtgctgcctgtgatattgatgcggttcgtactcgagatcctgcggtagataaatggacaacaccactgttgtatttaaaaggctatcatgcgatccaaagttatcgagtcacccattacctttggcaacaaggtcgtaaggcattggcaatttatctacaaaatgaaatctctgtagcatttgatgttgatattcatccggcagcgagattaggctgcggcattatgtttgaccacgcaacaggtattgtagtgggtgaaactgctgtgattgaaaatgatgtctcgattttgcaaggcgttacgcttggtggtacgggtaaagaacacggtgatcgtcacccgaaaatccgagaaggcgtgatgattggcgccggtgcaaaaatcttaggtaatatcgaaattggacgctattcgaaaattggggcgaattcagttgtattacaaccagtaccggatcatgcaaccgctgcaggtgtaccagctcgtattatcggacaatcttccgtacaaaaaccggcgtttgatatgaaccaatattttgaagatatcgaagggacttatggagatggtatctaggctaaaaagtaaccacgatttttagggattaaaagggctgaatccggcaatattctggattcagcccttaatgttagaatgctatggaaagtcgtaagacaagcggtcaattttaaatgctaaatgacgaaccgcagccacaagttgaacttgcattcgggttttgtactacaaagcgagaaccgtccaagccttcggtgtaatcaaccgtgccgccgattaaatattgcagactcattggatcaaccactaagccaacattctgattctcaatagttaaatcaccttcattaatctggtcgtcaaaggtaaaaccgtattggaaaccactgcaaccaccacccgtaatatacactcgtaaacgaagattcgggttatcctcgccctcaattaaactcttaactttcttcgccgcagcatcggtaaagataagagggatttgaatatcgttcattttttcttctcacaccaaactctaggtaagtcttcattatgtactaagattaagcattgggcaataggtttagaggcaaaatagtagtgaggctaccagaatagattttgtcaaaataatggaattcttgtataatttacaacacatatattgtccattttagtacagcgtacttatggagtaacaagaagttatttacaaataaacaattaaacatttggtcgaattatgcaaaattttaaaggaaaattaagaaaagcaataaatgatccagtttgggcatttaaacgttcattatctttaactaaagaatattatcattctaaaaatctaaaatatagaaaatatattccattaaaacataatggaaatttcggatatacagtcgtatctgcggtatataatgtagaaaaatatttagatgaatattttgagagtttggttaaccaaactttggattttaagaagcatattcatcttattttagttgatgatggttcgaaggattcatcggcagaaataattaagaaatggcaagagaaatatccaaataatattacttatttatataaagaaaatggtggtatctcttcagctagaaattttggcatgaaatatgttaaaactgaatgggtaacatttattgattcagatgattttgtatcaccgaattacttccagctagtagatgaagaactatctaaagatagctctttggaaatggtagttggaaatttatattattatcatgataaaactaaggttgcatcagatacacaccctcttaaatatcgcttcaaacataatgtaacaaaagttcccgttactaatatggataactatattaatttattcgtaacagtaacattctttaaaactcagcatttaaaagactcagggattgaattcgattcacgaattaagcctcatttcgaagatggaaaatatttagcagactaccttttatatgtatataaaggaaatattgcctatattaagaatgctattttttattatcgtaaacgtggagatggtaattctacgattgatactgcatggcttaagaaagagaaattctatgatctgctgcaatatggatatattaatttacttgaggagcataaagctaaattaggttttattcctaaaaatattcaatataccgtattaatggatttatcttggcatgtgaaagagttatggaataatccgggtagaatggatttagcattgttaactccttttgaaaaagaacgctatttttctttaatgaaacaatgttttgcttttattgatagccaatatattaaagaatttaatatgattgggatatgggaaatgcaaagagttggtattcttggtcttaaggatgataagccggataattatacagcatttgtagaaaatattgatattgctaaaaaacagattcttgtttgttattttgtggcaaaagatactcttgctcaatttaatttaaatggtatagacacaattccacaatttattaaatcaaaaatgaacacagtgggttatatgccatttgtaatggaaaagcgttgttgggttccatacacagatgagtcagaaatcctttcggtaaatattgatggtaagttatcaagcctatctatttggaataagcattataaacaactctcaattggtgagatattaaagaaattccatcaaccaagtaaaaagtatgcatctgataatagctgggtccttatggatagggatgtacaggcggatgataatgcagaacatttataccgttatattagtaaacattatcctatgcaaaaatgttactttgctttaaatagagattctcatgattggaatagattagaaaaagaaggattcaatctacttgagtttggctcggatagttttgaaagacagctaagaaaggcatctaaaattattagtagtcattttgatggatatattcaaaattattttaaagatgaatatgagcattctaaaaagtttgtatttttacagcatggcgtaactaaagatgatatgtcaaatattcttctttataaaagaaatatgctttgtatgttgactgcaacacatgctgaatatgagtcgattattaaagaaaatagtggatatcaaattggtctaaaagaagtcgctttgactggcttccctagacatgatgctcttttaaaagaaaatattactgataatcagcaaattttaattatgccaacttggagaaattatattgttggagaggctctagaaaatagtaataaaagagctataaacccagattttatgggaactgactatgcacaacattggtcttctttgctaagaagcccaaggttagaaaagttagttaaagatcatggttataaagttgtttttgctcctcataaaaatattgaaccatatttatctcaatttcaaattccggagtatattgacgtttggtctgcaggaacatcagaattaagtatccagcaattattccagtcttctcaattgatgattacagattactcatcagttgcgtttgaaatgggattattagagaaaatggttttatattaccattttgatcaggataaaatctttgctggaaatcatattgctcagaaaggatatttttcttatgaacgagatggctttggtccggtggcaactactgagggtaaggtattagacaatttagagcaattattacttaataaaggtaaaccatttgagccgtacttatctcgtattatgcaaacttttccatttagggatggaaataattgtgaaagagcttttcaagctatcaaaaatctcgatgtttatgatgatagtataaatttggacctcttagagcaatatactaaattagcatatactgaaaaggcatggtcattatttaatgagcgttctaataaattattagaattaggaaatcaagaacagcagcagtttgttattgaatcaaaattaaatgctttacagactcaattaatagatttagtaaataattgtggtattgaaaaatcacatttaagtactatgaatcctaatattgatcctaaacagcgtaaattattagatttattaacagaagtagctagttaggtggcttgaaaggggctgttttagtcccttttaaaatttacagaaagtatattgttatgattaataatttaattggaaaattccaaagattctatgcatttgatgagctactaaaacaattagtatttagagatattaaattaaagtatagaagaagttatttaggatatctatggagtatattaaatccattgatgctaatgattgtgcaaattattgtgttttcaaatgtatttaagtttgacactcctaattttcctttatatttaatatcaggccagattatctttaattttatggttgaggcgacaaataatgcagtttggtcgattagaggtaatgcatctctaataaagaaaacctatgtgccaaaatatatttttactatttctaaagtaggaagctcacttgttaacttagttttttccttaggagcattacttttagtaatgatcgttactaatgctgcgttttctctaaatttattattttttccatttatactattacaattatttatttttgtattaggtgttagtttatttctcgctgcgtcaacagtattctttagagatattcaatatttgtggggggtatttatttctatgtggatgtatttaacaccattattttatccagtaagtattataccggaaaaataccaatctatttataaaggtattaaccctatgtattggtatattgagcagtttagagatattgttttatatgctaaatttccatctctactagcaattagcattggaacaattacagctttattagcacttataatcggtgcatggtattttaataaaagacaagacgaatttattttatatatatagttatggaaaaagatactgttattaaagttacaaatgcaacagtgcgttttaacaaagctacagaagattataatggtctcaaagagtattttataaaaatgcttaaaggacaattaatgtttcaagagtttttcgccctgaaggatgtcactttcgaagtaaaaagaggggagtcttggggattaattgggacgaatggatcaggtaaatcaactttgctaaagcttatttgtgggattcttaagccttataaaggaactgttgaggttaatggtaatattgctccattaatcgaattaggtgctggctttgatggcgaattgaccgcccgtgagaatatttatttaaatggagctttattagggcataagaaagcttttatggatcagcattttgatgaaattatcgagtttgcagaattacaagattttgttgatgtacctttgaaaaatttctcttcagggatgtctgctcgcctaggctttgctgtagcaacaattgtgaaaccagagatccttattgtagatgaggtgttagctgttggggatgcagcatttcaagagaaatgtaagaaaagaatggaacagatgctgtctggtggcacgacattattatttgtatctcattcaattcatcaagttaaagaactttgccagaaagcaatttggattgataaaggtgtaattaaagcttgtggtaatgcagatgatgtcattccattatatgcaaaataaggaagataaataaatgtcaaatccgattttagttagtattgttgttgttgcatataatgttgttgagtatttgtctcaagcgattgattctgttctttcacaatgggatgataattgtgagctaatcattgtcaatgatggtgctacggatggagcttattctttattagaagagtataaagcgcgtattgcttcggataggtttgtactcattcataaagaaaatgggggggtatcggatgcaaggaatgttggcgttaaagcggctcaaggtgaatatatagcatttcttgatggagatgactttttagtaccaaatagactaaagttaattaagaatgtgttacaagagaatttacctgattgtcttgtcattaattttaattattatacggactctaatatagagttcaatcctattcagagttcatttaaagagcgtaagctaatgaggaactcagatgataaatcagatttcttagtatctgtatataaagatgctcagctttatccatggaaatatataattagaagaaatattctaaataaataccaatatcctgttggtaaaacctatgaggatgtagcttgtttgcctcttcaaatactagactgtgagacactatattacctgcctttagatttcattcagtatcgtcaacgttctggtagcattatgcgggtgaaaagcgaggaaaatattttgagcttatcttcgtctttgtcgacagtaacaagtagtattcgcaagagatataacgataagattccgaagcacttggcattagaacattctatttttagtttatatttatttacttgggcttgtggtgattcattagcaaatagaaatttagatgtcagagtattatataatagatataaaagtgattttgattattctaatttagttcttatttcagaattaaagtcggcaatggatagagataaaaagaattggcgcaagttttggcttttctattatattccaaattctttttatcttgctcattaccttcgtcatcattttaataaagcatataaacttttaaataaagttcgagaattggtttataaaacataatatgaaatttctcctagtcggcgcaggcttttcaaatgcagttattgctcgtgaacttgcagaacaaggttatcaagtaaccgttattgaccagcgtaatcatgtggcgggtaactgccactctgaacgtgatgctgaaacgaatgtgatggttcatgtttatggcccacatatttttcatacagataacgaacgtgtgtggaattatgtaaatcaatttggcgaatggatgccgtttgttaatcgtgtaaaaaccattagccaaggtgcagtgtattcattgccaattaatttgcatacgattaatcagttctttggtaaaacttgttcaccaagtgaagcgaaagcgttaattgaaagccaagcggatatgtcgattaccgatccgcaaacgtttgaagaacaagcgatgcgttttgtcggtcacgatttatataaagcgtttttctacggttacaccaaaaagcaatggggtgtagagccgaaagagttaccggcaagtattttaaaacgtttgccggtgcgttttaattatgatgataactactttgcgcataaattccaaggtatgccgaaagacggctatactgtgattgtggaaaatattttaaaacacgagaatattgaagtacgtttagcgacaccatttactgaaagtatgaaagcggaattcgatcatattttctggtctgggcctctagatgcgtattttggctttgagctaggccgtttaggttatcgtacgctagattttgaagcattccgcactgaaggtgatttccaaggtaatgcagtaattaattatggtgatgaagaggttccttatacgcgtatttcggaacataaacatttcgcaccgtgggaaaatcacgaaaaaacgatttgctatcgagaatttagccgtttatgtgaagaaaaggatattccatattatccgattcgcttagtaaaagataaagccttattacaacagtatgttgaaaaagcgaataaagaaacgcaagttacctttgttggtcgtttagggacatatcgttatttagatatggatgtaaccattaaggaagctttagaaactgctgatgatataaaacaagcgttagcgtgtgagcagaatttacaaccattttatgtaaatatggatgtgtaaaattctttggaaaatagaccgcttattttgaagcggtcttttattgatagattaacttatgcagaataaagccatttgtgcagttgtagttacgtacaaccgcaaagaattattactaaattgtttacaagcgttgcaagctcaaagttatcctctggctcatattgtagtggtaaataatgccagtacggatgggacagtggattttttgcgtactaaaggttggctagataatgataagtttacacttttaacgcttgatattaatcaaggtggggcaggtggtttttatgctggtattgagtttgcttatcaacgtggctttgattatatttggttaatggatgatgacggtttacccgaaaaagatagtctggctgagttaatgccgtacgcaaatgataatacttatattggtcctttagtattaaataataagaatccgaaggaacttacttttactctacgtttaccaaatagtaaaaaagtattaatgggtttagaggatgtagaaaaagcaactgttgataatattattcctgatattgttatgccatttaatgggattttattttcaaataagatggtggaggaaataggctttcctaaagcatcttattttatttggggtgatgatatggaatacacttggcgggctaagaaagcaggctttaaggtatttacggtaacttcctctaaattttatcatcctaaggaattaacattaggtacaccaatgttttttaatttattaaaatttaatgatactgaatctaaattaaaactctattgtatgtgcagaaataatcttcgtaatctgattgattataaagggagtttaattgctgccttattttgtattaaggtaggttggttttttctcttcactaaaccaaatttaaccaaattgaaaattgggttaagaggtatttggcatggtttagccaagaatttctcccatcatagagaatacttataaatattatgagcagagttaagattctaattgcaactcataaacagtatgagtttcctaattcagcttcttatgtaccaatctatgtcggaaaagtacttcatcagcagcaactagatattcaaggtgatgatacaggcaataatatttcttcgaaaaatggttcgttctgtgaattaaccgctttatattgggcttggaaaaataatgtattcccagagagtgattatataggattagttcattaccgccgatattttaaaggtaaagaggttgtgttaaaagggaatacaattgcttcggaaaatgaattattagtagatttagctcaatatgatgtaattgttgctaagaagcgaaattattatattgagacgatttatgagcattataaaaatgcacatcatattaaagatctagatttaactaaagaaattatcaagcaagattttcctgaatatatgattgcatttgagaaagtaatgtcaggaaaaacactgcatctatttaatatgtttgtattaaatagaaagcatttcacacaatattgtgaatggctgttccctattttatttaaattagagtcacaaattgatattactcattatgataattatcagaaacgtgtttttggatttcttgctgagcgtttatttaatgtttggcttgtacatcatggtttaaaaataaaagaagttaatgtggtttcactagaaggtgaaaatttatttaaaaaagcattaggcttattaaaaagaaaatttctaaaaaataaaaggtaactaaaatgaaaaagcagatgttatgtaaatacattcttgcatttactgattttttgctcttttcgctttcttttttactttccttagagttattgcagctatggactggggatttagataaatactttccctatgatcaaattgaagatcgagtaattatccatctttttcttgcagtaatttgtgttgcttggtttggtattaggctaaggcattatacttatcgtaagcccttttggtttgagttaaaagaagtcgtcagaacactagcaattttagcggtgattgaattagcgaccattgcgttttctaaactttatttttctcgctacttatgggttttaacatggtcgattgcattagtgtttgtgccattaggacgtatcttagttaaaaactatttgattaaaaccaagctatatttgaaagataccatcattattggtggtggaagaaatgcgatagatgcttattacgctttgatgagtgaaccttatttagggtttaaagtaaaatattttattgcattgactgaagctcctgagttaaagcagctaggtgttccggttattaatgaaacacggcaaagtttgtgggagttagtaacaaaaaaatcggatcaatttattattgcattggaagataatgaaaatgatcagcgtgatagctggttaagatatttatctaagcagtgctatcgttcggtatcagtaatacctacgttaagaggattaccgttatatagtacggatatgtcatttttatttagttatgaagttatcctactacgagtaaataataatttagccaagctctcttctcgagtgttaaaacgagcaatggatattgttggttctattttattgattatttttacctctcctattttaatttggctttattttacgattaagagagacggtggtaatgcaatttatggccatttgcgaatcggacaaaatggaaaaccatttaagtgcttaaaatttcgttcgatggtgttgaattctgagcaagtgcttaatgaattattggcttgtgatgaaaccgccaaagctgagtgggaaaaagattttaagctgaaaaatgatcctagagtgacaaagatcggcgcttttatccgtcaaacaagcttagatgagctaccacagttatttaatgttcttgtcggacaaatgagcttagttgggcctcggccggttgtaacagatgagcttgtttattataaagagaatttagattactacctgatggcaaaaccaggtatgacaggtttatggcaggtgagtggtcgtaatgatgtggattacgatacacgtgtttattttgactcttggtatgtgaaaaactggtcattatggaacgatattgcgattctttttaaaacaattactgcggtgcgtaagcgagcaggagcatattagaaaattaaaagcagaaagatcttctttctgcttttttattgctcatataaaatagaatatatctttaatttgtgatgtatttatgaaaacgatctttattaccggcggagcaggatttattggatcagctgtaattcgccatattattaatcatactcaagatgttgtcgttaacattgataaactaacctatgccggaaatcttgcctcattggaaggtgtgagtaacagttcacgttaccattttgagcaagtggatatttgtgatagcggtcgaatttcgcagcttttttgcaagtatcagccggatgctgttatgcatcttgcagcggaaagccatgttgatcgctcgattgacgggccatctgcgtttattcagacgaatgttattggcacttatactttacttgaagcaactcgtaactattggaacggcttgagtgtagctaaaaaagccgcttttcgttttcatcatatttcaacagatgaagtttatggcgatttacacggcatggaagagctatttaccgagcaaacgccttatgcgccaagtagtccgtattcagcttcgaaggcagcgagcgatcacttagttcgagcttggtttcgtacttatggcttaccgacactcgtcacgaattgttcaaataattacggtccttatcattttccggaaaagctgattccactgatgattctaaatgcgctagaagggaaaccgctgccggtttatggcgatggtttgcaagttcgagattggctgtttgtagaagatcatgctcgtgcgctttataaagtagtgtgcgaaggtaaagtgggcgaaacctataatattggcggtcataacgaaaagacaaatattgaagttgtgcgtgcgatttgtcagttgttggaagaatttatccctaataaaccaagtgctatagaaaaatatgaagatttgattacttatgtcaccgatagaccggggcatgatgttcgctatgcaattgatgcgagtaaaattgctaatgaattagattggcaaccacaagaaacgtttgaatctgggttacgtaaaacggtgcaatggtatttaacgcatcgagattggtggcaagcaattttagatggcacatataaccgtgagcgtttagggttgcgggaggaatcatgaaggggatcattttagctggcggatccggtacacgtttgtacccgattacgcgaggtgtctctaagcaattactgccggtatataataagccgatgatctattatccattatcggtgttaatgttagctggcatccgagaaattttagtgattaccacaccggaagataatgagagttttaaacgcttattaggaggtggatctgatttcggcattcagctttcttatgctattcagccaagcccagacggtttagcgcaggcatttttaatcggtgaagactttatcggtaaggataatgtttgcttgatcttaggagataatattttctacggtcagggcttcacaccaacattacgtaaaatttctgagcgtgaatacggcgcaacgattttcggttatcaagtgaaagatcccgaacgattcggcgttgtggaatttgatccagcttacagagttctgtctattgaagaaaaaccagcgcaaccaaaatcggattgggcggtcaccggtttatatttttatgataatcgagtaatagattttgccaaaaaagtcaccccatcagtacgaggtgaattagaaattacctcgattaatcaaatgtatttacaagacggatctttaaatattcagttacttgggcgtggctttgcttggttggataccggtacgcacgatagtttgcatgaggctgcttcatttgtgaaaacgattgagcatgtgcaaaacctacaagttgcttgcttagaagagattgcttggcgtaataattggttgagctccgagcaagttgaagctttagcgaaacctatggcaaaaaatgcgtatgggcaatatttactaagattgattcagacaagcagagatatttaggatcatttaagatcctaaaagccttatgattgagttaatgaacaaaaatagatgaaaaaatagtaagttttgaaccattttctaggtgaaattaccctttactttaaaggctagctgcggtaaaatgcgctaccttttttagttctatgtcgccaaaaattgatgtgcgactttatttaaacatatatttcctgaggtgatggcatatgccagtaattaaagttcgtgaaaatgaatcatttgacgttgcattacgtcgtttcaaacgctcttgcgaaaaagcaggtttattagcagaagttcgcgctcgtgaattctacgaaaaaccaactacaattcgtaaacgtgaaaaagcatctttagctaaacgtcacgctaaacgtaatgcacgtgaaaatgcacgtaacactcgtttatactaattagcagtctgctatttagcttaaattaactaaaaccgtgaaaccttttggaatcacggttttagtgtttttagtgaacccacctatgtaacctattagtaaataagcggtcaaattttcataattttttgcaaaatttagcgtaattttaaccgcttgccactatgacaaggagaatcaatgaaaggcacaattcctcgttcgtttattgatgatcttgttgcgcgtactgacattgttgagctgatcaatagccgagtcaaactcaagaaagcagggagagattatcaagcctgttgtccgtttcatcacgaaaaaagtccttcgtttaccgtaagtcaatctaaacagttttatcactgttttggttgcggtgcacatggtaatgcgattagctttttgatggattacgataaactggaatttccggaggcaattgaagaacttgcggcgatgcagggtttggaagtaccgcgtgaaaatgtgatcgctcgtgacggcaagcctcaggcaagttataaaactaaacgtaatttatatgagctgttagaagcgattagtcagttttatcaacaaaacttaactcaagatattcctagccaaagctacttacaaagccgtggattatcaccggagatcattgctcgttttgagatcggctttgcacataattcaatggattcggtattacgcaaattcggcacgaatcgtgatgaagtacagaaattgttcgatacgggcatgattacgcaaaatgatagcggtcgaatttatgataaatttcgcaatcgagtaatgttcccgattcgtgataaacgtggacgagtgatagcctttggtgggcgagtgatgggggatgaacgacctaaatatctgaattcaccggaatcggcgacttatcataaaggtaatgaactgtacggtttatttcaagcgttgcaacagaatgaaaaccctacctcactcgttgtggtcgaagggtatatggatgtggttgcattagcgcaattcggggtagataacgtggtagcgtcactcggtacggcaactaccggtgagcaaattcagcaaatgttccgtgtcaccgaacaagtgatctgttgttacgacggtgatagagccggacgagaggcggcatggcgagcgtttgaaaatgcattgccatatttgcatgacgggcgtcagctgaaatttattttcttgccggacggcgaagatccggacagttttgttcgagcgcatggcaagcaaggctttgaggcatatttgcaaaatgcgatgtcgcttagtgattttctgtttgattcactgattgcgcaggtcgatctctctagcaaagaaggtaaatcgaaattggcggcattagccgtgccgttgattaaccgtattccgggggaaatgttgcgtgtttatttacgcaacattcttggacaaaagcttgggattttagatccggcgcaattggaggcaatgttgccaagtcgagtgcaatccgtacagaaaccggcggtacaaccattgcaaattaagcgaacgccaatgcgtttattaatcgctttattattgcaaaaccctgaattagtgaaatttgtgccagatatttcagcccttaaaacgttggatgaaccgggctttgagttattactggaattggttgatgtttgccaacaaaaagtcggtgtatcaatgggggctttactcgaacattggcgagataaaccgaattatcgcactcttgagttattagcgaattgggatcatctggtgacaccggaaaatattgaaagtacctttatcgaaacacttgattttctttatgcaaaattagtggaaaaacggatcgaagtattgattgctaaagatcgcacagtaggcttaaatgcagaagaaaagcaagaattggtgatgttaattgcacagtaattaagcggtcatttttaagaaattttttgcaaaactatcaagaaaattgcaattaatggtataatccaacactatttttgctcgcacacaaaacggatacacattatggaacaacaattagaacagcaatctcaattagaacttctgattgcccaagggcgtgaacaaggttatttaaccatttcagaagtgcacgaccacttaccggaagagttggttgatgcggagcagatcgaagatattattcaaatgatcaacgatatggggatcaaagttttagaaaccgccccggatactgacgagttaatgctcgcagagaatatcgctgatgaagatgtcgtggaagaagcgactaaagtactttcaacggtagaatcggaattaggtagaacaacggatccggttcgtatgtatatgcgtgaaatgggtacggtggaattacttacccgtgaaggcgagattgatatcgcaaaacgtatcgaagaaggtatcaatgaagtgcaatgtgcggttgcagaatatccggaagccttaactgaattaatcggcttttatgcgcaagttgaagaaggcacaatgcgtttgtctgacttagtgacggcgtttgttgatccgaatgcgcaggaagaagcaacggtggaagatctagaagccgtgcttgatgatgaagatgcggaagcggtggccgatgtggatgatgagagcgaagaggaagaaagcgatagcagtgcggatacgggcgatgacaactcaatcgatcctgagcttgctcgtgagaaattctatgcgttacgtgagcagcacgagaaagcattgcaagcgattcaaaaacacggtcgtggtcataaaaaatcaagagagcacatccaagcgctttcagatattttccgtgagttccgtttagtaccgaaacaatttgatttacttgtggaatcaatgcaaaaaatgatgaaacaagtgcgtgcggaagaacgtcagattcagcgttatgcggttgaatatgcacaaatgaaaaaagccgatttcttaaaattattccaaggtaacgaaacttcggaagaatggattgaaaaagcaatcaacgcgaaaaaaggcgcagcaccgaaattggctaactacgttgatcaaattcgtgtcaatatcgcaaacttacaacgtatggaacaaagtactggtttaacggtggcacagatccgtgaaatcggcggtcgtattgcaaatggtgagttaaaagctcgtcgtgcgaaaaaagagatggtcgaagcgaacttacgtttagtaatctcgattgcgaagaaatataccaaccgtggcttacaattcttagacttaattcaagaaggtaacatcggtttgatgaaagcggtagataagtttgaataccgtcgcggttacaaattctctacttatgcaacatggtggattcgtcaggcgattacccgttcaatcgcagaccaagctcgtaccatccgtattccagtgcatatgattgagaccatcaataaacttaaccgtatttctcgtcaatgcctacaagaaatgggacgtgaagcgactccagaggagttagcggagcgtatgggaatgccggaagataagattcgtaaagtgctgaagattgcaaaagagccaatctcaatggaaaccccaattggtgatgacgatgattcacatttaggtgattttattcaagatgaaagccttgaattaccgttagattcggcaacagcagaaagcttacgtattgcaactaatgaggtgttagaaggcttaacaccacgtgaagcgaaagtattacgtatgcgctttggtattgatatgaatactgaccacacacttgaggaagttggtaaacaatttgatgtaacgcgtgaacgtattcgtcagattgaagcgaaagcgttacgcaaacttcgtcatccaagccgttcagaaacgttacgtagtttcttagacgactaataaagtaaatgagaaaatgcccaaccttaagagtttgggcatttttatttatatccgcaaattggaacgctacctaaataagctaagatgcataggcttactttttatagcgtttcattataaaataaccactttttatcacattaaggatttacttttatgacatatccagcttgcccgcaatgtaagggcgaaaatacttaccatgactcaattcaattcgtttgccctgattgtgcacatgaatggacgggtgaggaagttgaagagcatgatgaagatcagttaatcgttaaagacagtaacggtaatttattagctgatggtgatgatgttcttttaatcaaagatttaaaattaaaaggttcttcagaagtactgaagaaaggaactaaattcaaaaatatccgtttagtacatggtgaccacaatgttgattgtggcaaaattatgcttaaatcggaattcttgaaaaaagcttaattggttattgaattttgtttattgtaaacgctcaccttggtgggcgttttttatttcatagtttatatgtattattgatatagattttataggttaagactattgataaatctcaaaaaatagatacctatttttatgagataatgtaacctcacacaaatggaggttaccgatgaaaaaatatttactttcagccttagctgttgctggcattggctatttttctctcgtgggatatgcgtattggttcgataaagaacaagcgcctaaattactggctgcagccggattaccggaatcacaccaagccgttgctagcgtgatgtttgaaaatggctgtcaatactgtcacacaccgaatgcagaattacctgcttattcaaaattacctatcgcaagtcaaatgatggcggcggatattgaaaagggaactcgctttttccgtttcgatcgtttaattgaagggatgaaagatccaagcaagctttcggaagctgatttggctaagttggagcaagttattcgcaatgatgaaatgccgattgcgaaatatatccatgttcactggggcgctcgtccggatgcggaacagaagaaagtgattctagattggattactgcacagcgccaggcacacttcttaccaaaagcagaaggcacagatgcaacgcgtttagttcaaccgattccagatcaattagcaaccaatccacataaagtggcactaggtgaggggctttattttgacggacgtttatcaggtgacggttcaatccagtgccgtacttgtcaccaattaacgcaaggcggggtggataatttaccggtgtcggaagggattcacggcttaaaaggcggtatcaatgcaccaaccgtatttaatgcggcatttaataaatggcaattctgggatggtcgtgcgaaaacattagctgatcaagcgggcggtccgccaactaatccggttgagatggggtcaaaaacttgggatgagattttggctaagttgagcaaagatgaagactttatgcaacgtttccttgcagtttatccacatcttgatcaagcaaatgtgacagatgcgattggtgaatttgagaaaacgcttattacaccaaatagtgccttcgaccgtttcttaaaaggtgatcaaaacgcattaactgacgtacaaaaacgtggttatgaacatttcaaaaatgcgaaatgtgacacctgtcatactggtacggcaatgggtggacaatcatttgaatatatgggcttatacggcgactacttcaaagatcgtggtacggaattaacggaagcggatcacggtcgttatgcggtaactaaggatccaagcgatatgcaccgtttcaaagtgccgactttacgtaacgtggcgttaaccgcaccatatatgcacgatgcaagcgcgaaagacttaaaagaagcggttcgtattatgggtatttaccaaagcaataaacagttctctgatacggagcttaatgagttagttgctttcttagaatcactaaccggtgaatataaaggcaaattactaactaatgaaaaagtgaaataatttcacataaacaagcggtgggatttctgcaaaactttgcaaacatcccaccgtttttttatttattcagcaatacttcgatttctttcggtatcacttttggctccggcacaaataattgcttatgtcgctgtagctcacctttctccagcacgatactacttttaggcactttaaataacttgcttaaatatttcagcaaatgcgcgttagccgcaccgtcgaccggtggtgcggtaatcgcaattttgagttcattatcgtgtaaaccgacaatttgatcgcggcttgccttgggttgtaaaaaaatccgcaggcggatgccacacggattttcaatacgttctactgcttccatttaagcaatcgcccaaagcacgccaaatatactatagaaaaggttatttagcagaattaagccgaacccgagtaccatcaccgaaaaatccaacataccggtacgcggtaataatttacggataaagcctaataccggctcggtgatttgtgccaccatataatctaacgggtgatcaccacgtgtgacccaactcattaaggcacgaattaaagtggtgaaaaacagaatttgaccgaaggtttttaccactcccaataagcccgctaacactgccatggctactggtacacctaaaataaatttctctaaagcaagtaatagtagtgcaatcagtaatgcagcgaaattgatgttttttacggttggaatcactttacttactggattcactaagggtgaagtaaggcgtaaaagtgattgggataacggcatatagggatcaacacggcaaaattgaagccaagtacgcaaaattaatacaaagctaaaaaagccgataatgattgaaagaacaggggctagaaattccatctatcttcctcttataaatatcttctataaactattcgggcgggaatacacccgccctcatgatagaaagcggtcggaatttgcaatttttttgcaaaatttaaccgcttgtcgctaaagcattagccttgaaccggataatcccaccagatgtcgaataaaccgcttacttcaacttgagttaagccattgttttctaaccaagtttttactaattgttggtgagattcatcacatttacctaatttttctaagcaaactaaaccttcccagtgtaagtaaccgctaccttcataagctaaaccgtttggtttgattacttctgcgataaaacggtctacggttaaatcaatttgatcaatacctgtgttttccgcaaattggaattttactaagaagcctaattcttggaattctgctaagtgcatttttttacgctgacgcgcgttgcgttgaatagccatttgtatctccccttatttaatgagaatggatagttaaaatcaatcgttaaaccgattgtgcttgtttaacgaaatataagtcccacacgccgtgtccaagacgatgaccgcgttcttcaaacttggttaaagggcggaaatctgggcgtggaataaagtcattggttgtcgaggtattgcgtaactctttgtcgaattgacgtagtacttccagcatatgttctgcatagttttcccagtcggttgcgaaatggataaaaccattatcccctaatttagttagcactcgagtgataaattccggctgcacaatacggcgtttatggtgtttcgctttttgccacggatccgggaaatagagttgtagaccgcctaatgcagcgtcagcaatcgcatcacgtaagatttccgttgcatcatggcaaatcacacgcaagtttttcacgcctttttctaaggcataagcgatacaagcgccgacacccggcgtatgtacttcaataccgatatagttacgatccggattttgttccgccatttcaaccaatgaacgtcccataccgaagccgatttctaacacaaccggattgttgttaccgaaaatctgctcaaaattaaaaggtgtgttttgataatccaaaccgagatttgcccagttgttattcatcatatcacgttggtaatcgctcaaacgcccggtacgtaatacgaaactacgtactttacgaagataacgaccgtcttcggtgaattcggcttgttctacggttttacgttttttatctgcaaaagtttgtttttctgacatttgtaaaaattctatcttttttgaccgcttgttagagacgacatgggttaaaaacgaacaagggcagaaccccaagtccaaccgccaccaaatgcttcaaggagtaataattgaccgcgttgaatacgtccgtcacgaaccgcttcatctaacgcaacaggaacagttgccgcactattgttaccatatttctcaaccgttaataccacttgcgacatatccatttcgagttttttcgctgttgcggcaataatacgaatattcgcttgatgcggtactaaccagtctaaatccgatttttgtaaattattcgcttcaagggtttcttccaccacacttgaaagctgacctaccgctaatttaaaggttgcattgccttgcatttgaataaagccggatttctcattaccacgctgttgtgccggtaatgccaacatatattcagtatcggaagacgaatgtaggtgagttgaaataataccttgttcttcacttgcttcaagaatgacagcacctgctccgtcaccaaataacactaccgtactacgatcggtttcatccaatgcacgagagtttaaatcagaaccgataaccaaggctttttttactttgccgctacgcacgaattgatctgcgatacttaacgcataaacaaaacccgtacaagcagcagcaacatcaaatgcaatggcatcctgaatgtctaacatgccttgaatttggcaagctgcactcgggtaagcgtgagagttagttgtagttcccacgacaatcagatcaatttcattgtgatcaatcttcgccatttctagtgcttttttagccgcttgtgcccccatagttgcaacagtttcatctgcagcagcaatacgacgttctttcataccggaacgagtaaaaatccactcatcggtcgtatctaccatcttttctaaatcagcattagttcgaatttgagcaggtaaataactacctgttgctaaaattttgctgtacatattttattctctataaattttgatgtaatttgtttaatccttgccaaattttatcaggaatttgcctttggatctgcccaattgcatgatcaattgcataaaaatatgcattagtacttgcaccaccatggctttttaccaccacagaagataatccaagtaaggttgctccattatggcgatccggattaatttgttgcaattttcgataagagcgataaaaaatagctcgtaataaataacgtttagtactttgacaaataaaagaaccttcagaggatctttttaatagtgaaagaatatttttggcggctccttccactgcttttagagcgatattaccggtaaatccatcacaaacaatgacatccgccatattattcatcagcttatcactttctagaaaaccgatataatttaaatcattgcgtagttgtaaacgtttatccgtattacgaatagtttgcgtacctttgctattttctacgccgatatttaatagtgctaaacgcggataaactaaatctagcatcacttcggcaaaaatatttcccatttcagcaaactggataagtaaatcactatctgcttctacgtttgcacctaaatcaagcatgacgcttgattttccgttcatgcttggaatgagtgtggtaagcgctgggcgttcaatattcggtaacggttcaattaatattttagctaatcccatcaatgcggcagtatttccaccgctaatgcatccttgtgcttcaccgtttgcgacagcttctaatgccaaacgcatagaacttcctttactttggcgtaatgcttgcattaaaggaatatttgcatcaatagcatggggcgtatgaacaaattgaatacgttttagctgatcgttagggagagcattcagaaaaggacttgcttggcgctgatcgccaaatagtataaaagatagcatcggattctgtgccaatgctagagataatgcagggatagtaacacggggaccaaagtccccgcccatcacatctaacgcaagggttagacgattcaactgatacctcgaaactaaccgagattatttgttgattactttacgaccacggtagtaaccgtcagcagttacgtggtgacgtaagtgagtttcaccagttgttttatctactgaaactgctgctgttgttaatgcatcgtgtgaacgacgcatatcacgacgtgaacgagatttcttattttgttgaacagccattggctatactcctagatctagtttttctttaaattagctaatacagcgaacgggttaggtttcttcgccaattcttcaggcaattcgccaaacacctgttcactcacggacacttcacagtgttcttcactatgcatcgggactagaggcaattcgatgataaactcatcttcaatcatatctagtaaatttacttcaccaaactcgtttacttcgataggttcataaatttcgggcaaattgtccgcctgatccatattagacactggactgaaacaaaatgaacagtcgagtgtttgtgtaaacgggttaccacatcgttggcaatcaaattccacctcaactttcgccgtacctttaatgacggttaagcgttgcggatcgatatataacgagagagtaacttgtgcatcgcttagcacattgctcacagattcacccaaacgactaaggagactactgaaaatgtagccttcgtaatccattcgacgctgagcgtctttatatgggtcaatggtgaggggtagttttaccttttgcatagggtgtgcatattacagatagaaagcaaaatagtcaaagagaaaatcggatttttctaaaatatgtcggtatagggaaaagatctctcacttgggtttgatataaggtaaattatgctaattttttctaggtaatttgaccactaaccatagaaaaaaagctataaaactggtacttttatcacctagctgaaaattattcttattttacgttaaaaacgggacaatgatgttatttgctattctggcgatccttgcttatttaggcgctttattatgggtggctccaaccgtagccaatttagaaaaccaagccaataaccaaaaaccgaatattaaagcggtctttggtattgggttgcttgcgatactttttcacggtattagcttgtctcaagaatttatttcgactgagaatggacaaaacttttcgctgtcgaatgtgaattcattgatgagtcttctactcagtgcttttgcaacattagctttgcctcgttggagaacgatttggtttccgctcatggtcgtttatacctttggtatttgtagcgtggcggtttcaagttttgcgacagggaattttattaaaaacttagcggataatccgggattagtattccacttaggtattgcattattttcgtatgcgttattctttttagcattgctttatgcattacagctaaaatggttagataaaaaactgaaaagcaaaaaaccggtattttgcagtatgttgccaccattaatgacggttgagcgtcatttctttaccttgacgttagcagcacaggcgatgctgacggtgacgttaatttctggcatgatttatctgcataatttctttgcaccagaacaaattcataaagcgattttttcgtttatcgcttggattgtttatactattttattactcggacaatggaaattccgttggcgtggaaatcgggtgctaatttattcaattttaggtacaatattattgactgtcggttatttcggtagtcatgtgatttcataatcacgagcggaagcggtcggattttctgtattttttgcaaattatttttcaaatttgaccgcttaattattcatttatataggacttttattttggacagtattcccctgagtactctttttatttcactcacaattcttttattcctttctgcgtttttctcaagttctgaaacaggacttatgtcgctcaaccgctataaaatgcgtcaccttgccgaaagcggtcacaaaggggcgaaacttgcggaaaaacttctcaacaagacggatgtattactcagtcttatccttatttgtaataatttagtcaatattgccgcttctgcgattgctacggtgattggtatgcgtttagccggtgatgccggtgtggcgattgcaaccggcgcgctgacctttgtaatgttagttttctcagaaattctgccgaaaaccattgcggcgatttatccggaaaaaatcggcttttttgccagttatgtcttaacgccgttaaaaaaaatattaatgccgttagtatttttaatgaatttaatcattagcgctttaatgaaattattacgcgttaaaaaagatgaaaataaaggactgagtgcggaagaattacgcggtgtggttttagaagccggaaaatttattccgaccgaacaccaagaaatgctaatttctattttagatatggaaaaagtgacggtcgaagatattatggtgcctcgcaacgacattggcggtattgatattgatgacgattggaaatcaattatgcgtcaattaaaccatgcggcacacgcccgggtggtgctatataaaggcaatatggataaaaatgtgcttggcatgttgcgtgtaagggaagcttttcgcttactgttagaaaaagacgaaccaagtaaagaaacactgattcgagcagtggatgaggtttactttattccggaagggacacctctcactacccagctaatgaattttaaaaccaataaagaacgtatcggcttagtagtggatgaatatggtgatattaaaggcttagtcactttagaagatattttggaagagattgtcggcgaattcaccacctcaacggctccaagtttggaagaagaagtgaagcaacaatcggatggctcggtcattattgaaggctcggcaaatttacgtgatctgaataagttgtttggctggaatttaccggtagacgaagtacggactttcaatggtttaattttggaacatcttgaaaaaattccggatgaagacactcaatttgaactgaacaatttaaaagtgacggtgttggaggtggcggacaatatggtgaaacaagcaaaagttgagccaatttcccctccagaaaaaggctaagtcggtaagcggtcgatttgtaaaattttttgcaaaatcgaccgcttgttttttgtggatttgactcgtactactgttctattttagtttgttttttgagctaatgaaattcaaatagttgtgctacaaatttaacaatgaatttatataaatatctgaatctatattgatattagatgaatatactaaaatattggtgtttttgtagtttaaatcactggtaaattctaaaaaatcacgtctaaaatttattttattctctttacttcttaacaattcttcggcatattgctcgcccttgcgagctgtattcgcaaccaattttcttttattcaaataaaaacttaatgtgtttaatatttaacatttgaggtatctctcgtgtcttctagcaacgcaactccagcaaaacgtgctactttttccggccgtaatgcttttattctcgctgccatcggttctgccgttggtttaggaaacatttggcgtttcccttataccacttatgaaaatggtggtggtgcatttattattccttatatcgtagcgcttttaaccgcaggtattccgttattgtttttagattttgcaattggtcaccgccaccgtggtgcggcgccattgtcattccgccgtttaaaccgtcattttgaagtatttggttggtggcaagtattggtaaatgtgattatcggtatctattatgcggtcgtacttggttgggcggcagtttatacctatttctctctgactaaagcgtggggggataaaccggttgatttctttgtcggcgaattcttaaaaatgggtgatatcgcaaatggtatcagctttgaatttgtcggtatggttgttggcccacttattgctgtgtggattattgctttaatcgtattggcattgggggtagagaaaggaattgcaaaatcatcaagtattttaatgccggtattggttactatgtttattgtattagtgatctcatcgctatttttaccgggtgcaactaaaggtttaaatgcattatttacgccggattggacgaaattagctgacccgagtgtatggattgcggcgtatggtcaaatctttttctcgctttcaatttgcttcggtatcatgattacctattcttcatatttgaagaaagatgcggatcttaccggcacggggatggtggttggttttgcgaactcgagctttgaagtattagccggtatcggggtgtttgcggcattaggctttatggcaaccgcagccggtcaggaagtgagtgaagtggcgaaaggcggtatcggtctagcattctttgctttcccgaccattatcaatgaagcgccaatgggaacattacttggcgtgttgttcttcggctcattaacctttgctgcactaacatctttcatttcagtgattgaagtaattattgctgcagttcaagataaattaaaatttagtcgcgtagcttcaacatttattgtcggtttaccgatgatggcagtgtcggttgtgttattcggtacgacaaccggtttaccaatgttggatgtgatggataaatttgtaaacaactttggtattgttgcggtagcctttgcttcattagtagcgattgtggcaaaaggtaaactgagtacgcttggccaccatattaataagacttcatcaattaaggttggcactttctggcgcttatcggttgtagttaccactggggtattagcctttatgttatttagtgaagcgatcaaagtgtctaacgaaggatacgaaaattatccaagttggtttgtgaatagctttggttggggcatggcggttgcgttagttatcgtagcatttattctgtctcgcttaaaatggcataacgaaacggaatttaatccggaaaacgaataggagaagagtatgagtactccagcaattattatgatgagtattgcgcttgtgattatttggggtggtttagcttttgcggttaaacgcttaccaaaagagtaaaaattcacaaaaataagtaaatagtggaccgcttgttattttaacaagcggtctttttttacagtgaaatttcaaaaaatactctatttgtgaaaattaatttcattaatgaataaattaagttaaatgataatgattaataattaatcagctgaatcagataaatgagatatagatcacaaatctaacaaatgttatttgtgttatgtaaagatctatctacaatttactccgattttcactctatttgaaaagaaatttcataagaatcccattaaggagtaaataatgagcattgctattatcatagcgacccacggtgttgcggcggagcagcttctcaaaacaacggagatgttgatcggcgagcagtcagacgttgcctatatcgacttcgtgcctggcgaaaatgcagaaaccattatgggtaaatatcaagcattggtggaaggcgaattatcacattgtgatcaagtgcttttccttgttgatatgtggggcggcagtccgtttaatgcggcaaaccgtttccaagaaggcaaaaccaatatggacgtagtaaccggcgtgaatattccgatgctggtaaatgcgtgtatggctcgtgatgatgttgaatcgctagaagaattggttgaggtggcattagaagctggctcgacaggcgtgcgttcattaaatcaccaaccggcggtagcagaaccggcagctcctgcgacacaaccgcaaccgacagagccagctccacaacaaattgtggatgacggtcgccgtatgacgattgcattagcacgtattgatgaccgtttaattcacggtcaggttgcgaccgtatggaccaaagaaagcaaagtaaaacgtatcatcgtagtcaatgatgatgttgcgaaagataaagtacgttctacgatgctgaaaagtgtagctccactaggtgtaacggctcacgtggttgatgttgcgaaaatgatccgtgtatataacaaccctgaatatgctgacgatcgtgtaatgctattatttactaatccaagtgatgtattaagcttaattgaaggcggcgttccgttaacttcaatcaacgtaggcggtatctctcataaagagggtaaacaaatggttagccatgcggtagcagtagatcagaaagatattgatgcatttaaagcgattgatgcaaaaggcgttgaattagaagtgcgtaaagtatcaagcgatagccgtcaagcgatgatggatctattgaagaaaaataacttaatttaagggaaattattatggaactctcagtattacaaatcattttagtgttccttgctgcttgtatttcaggcgcaggttcaatccttgatgaatggcaaacccagcgtcctatcgtggcgtgtacgttagttggtttagcgttatcaataggtgcaccggattctgcagaagtgattaaaaatgccatcattatcggcggtacgcttgaattaatggcgctaggttggatgaacatcggtgcggcagttgcaccggatgcggcattagcttctgttgtttcaactatccttgttattgttggcggtcaagaaatcgcaacaggtatcgcagtagcaattccacttgcagcggcaggtcaggtattaacttatgtggtacgtgcgattaccgttggtttccaacacgcggcagataaatcaatcgaagatggtagtttagctcgcttagactggttacaccgtggtgcgttaatgcttcaagtaatgcgtattgctatcccagcacttattgttgcgttaacagcaggtactgacgttgtacaaacaatgttaaatgcaattccgccggttgtaacaacaggtcttaaaattgcaggtggcttcattgcagtagtaggttacgcaatggttatcaatatgatgcgtgcaggtcacttaatgcctttcttcttcgcaggttttgttattgcaggctttactgatttcaaccttgttgcactaggtgcattaggtgcaatcatggcattgctttacatccaattacatcctaaatacaacaaaagccaacaagttgtggtagcacaagcagctgataacggcttagacaaccgcttagactaagaaggaatttactatgactactgaaatcaaaaaagtaacaaaaagtgatttgaatgcggttgttcgtcgttcaaacttattccaaggttcatggaactttgagcgtatgcaaggcttaggttttgcttactcaatggtaccggtgatcaaacgtttatatccggaccaaaactcacaagaacgtaaagatgcgattaaacgtcacttagaattcttcaatactcaaccattcgttgctgcaccggtattaggtgtgacgattgcgatggaagaagagcgtgcaaacggtaaagagatcgacaatgcggcaatcaacggtattaaagttggtttaatgggaccgcttgccggtgtaggtgacccaatcttctggggtacggtacgtccggtatttgcagcgcttggtgcgggtatcgcattaaacggttcaatcctcggcccgattttattcttcgtattatttaaccttgttcgtttagcgacccgttactacggcgtaacttacggttataaaaaaggtttagacgtagtacaagatatgagtggcggcttgttacaaaaattaacggaaggtgcatcaatccttggtttatttatcatgggggcgttagttcagaaatggacaagcatcaatgtaccacttgtcgtttctaagattcaaatgcaagacggtacggaacaaacaacaaccgtacaacaaattcttgatagcttaatgccgggtttattaccgttattattaacatttgcttgtatgtggttattgcgtaatcgtgtgaacgcactttggattatcgtaggcttctttgttatcggtatcttaggtgcagcaacaggtacattagcttaatattgcttttccacggaaaccgacttactctaataatatagatataatttgtgtttccgtggttttattttacaagcggtaaaatttgcggatttttttacaaaaattcaataaattttgaccgcttattttttgtgaactccttattattaagtggcaaatttccatgacaaacattattcttcttattggtatcgcggcagtgcttgcttttgcaatttacgatcaagtgattatgcctaaattgaaaggtgaaacgaaattgagcgtgcaattacaacgccaagtgaaaggagatgcatggatcttaatgggattaattgcactgactatcgtttatggagttcaacatggaattgaatcgctcaccatttatttattagcgttttcaattatactttgtgtttatgttacttttttacgttcgccacgtttattattaaaagaacaaggattcttttttgccaacgtcttttttgagtatgctaatattcatcaaattaacttagctcaatcacaaattattgtgattgatttaaaaagcggacgacgcttattagtacgtattcaaacgcctgaagatatagagaaagttgtaaacttctttggaggatacaaaaaatgatttttaaattaaaaggcaaatttcaacattatgattggggtggttcaacttttattccgcattttttgaaattggatgtgcccgaacaaaaaccttatgcggaatactggttaggaacccatccctcggcaccctcggatattttatttgaacaaaaatggctcccattggatcaagttattcaagttgcccccgaattattaggtgagaaaagccgaagccaatttggtgataatcttccttatttattgaaaattttagatataaaacaaccgctttctattcaaattcatcctactaaagccgaagctgaacatggttttgccttagaaaatcagcaaggtattcctctttccgcccctcagcgtgtttataaagatcgcaaccataagccggagatgatgatcgctctttctgacttctggggattacatggcttcaaaccgatcgctgatattaaagcgagtttagaacagcatgattcacttaaaccgattgccaaagctttagatgaaaagggtttaccttcggtttatgccgatattatgcaagcggacaagcaacaaatttctgagtggttgttaccgattattgaagaaaaatttgaagaataccaagccggaaaactgaaaccggataatccggattattggatatgctacatttctgatgcgatgaattcaccgctacatagtttagacggtggtattatttgtttttatttctttaatattgtttacctcaaaaaaggtgaaggcttatatcaaggcgcaggcttaccgcacgcttatttgcgcggacaaaatattgaattaatggcaaattcggataacgttattcggggtggattaacacctaaacatattgatattcccgctttactgcattcaattgattatcgtccggttacacctaaaatcattccggcttatcgagaaaccgatggctttattcatctttacccaacaccggaagcaaaagattttgccttacaacacctagagtttaaaccttttgatgaagaaaactttaccgccgattgtgcaagtattctgttagttatgaaaggtagcttatatattgatttaggcagagaggcaattcatctacaacaaggcgagtcaatttttatcgcagcagagagccaagtggatattattgcggaaacagacggctatgcagtgattgcaaccttgccgtaaatctgacaatatatattgtgattaatatatggcgtaatgtttttggctttaactattgaggtaaattatgaaatactcaaccttacttgccagtgcggcaatgtcgttgcttttagcaatgaatgcttatgcggaaggtaatcaaattcaaccaacagttgaacataaaaccgtgacaaaaaatgccccgctttcggcaaaagaagctaatcaaaagcgctttaatgatagtgttgcattacgttttttcggttatgagcttacgcaagatccacagggtcaaccaatgcttagtttcaaatatagtattgagaataaaacaaaacgtaacattcgtattgtgcaatgggcggtaaattatatccatgacggtaaaatcattttgacacaggatacgccggtcacgtttaaagataatttaaaacgtagaacaacggctgaattggtgttttctgtaccagtagctgaattaccagttcaagcacaagcagtatttcaaaatccgcaggcgaagctgaatgcacaatttgatgctcgccaaattgtcttctcaaacggcgcaaaaattattgtagctaaataatttttttagataaaaaagcggtcggatttcatctattttttgcaaaattctgatgaaatccgaccgcttgctcttacatacctaagtgacctagcgctctctcaagctttcagaaatagattcttccagcggacttaataagtaactaatcacactacgttctcctgtcttgatctcggcagtaacgctcatccctgagccaagtgcgatctctttgccatctttactagacagcgttttcttatcaattgagataatggtattaaataccaaaccaagttgcggatgctcaattgcttctaaagtgatatgttttactttacccgttaaataaccatagcgagtataaggaaatgtctcaactttgatcacggcatcttgtcccacttcaataaaaccaatgtccttattctgaattaaagcggtgacttcaagaacatcatcttccggcgcaatcaccattaatgtttctgcggtcgttacaacaccgccaaccgtatgggtttttaactgttgtaccgtaccggaaaccggtgctcgaatgactgatgcgacttggcgttgctcatttttttctagctcaagtttaagttgcttttccgtttcaacattttgcttaagcttttcaagtacatccgctttaaagagttgcgtaattaattgtgcatcttcttttgcttggcgtaagtcactttctacctcatttaagcgagattgatagaccgcaagttcattgacggcttcaatataatggttttcttgtgctaatacatcgtgctttgatgccgatcttgaattgaacagttttttaagatccttcaatttttcctgttctactcggcttatcccttcatatttacgaatattagctaaaaccgtttgtttctcagcttctcggcgttgtaataccaattccttttgatatttttgtttttgccacgcttcgaattgttcaacaattaaatgacgaatccgtgtcttatcctcttcagaggcgtgactaaagtcattatgtgttaattcgattaatggcaaatgattcgtttcaacggcagttaatagcgtttcgtaacgataacgttctaattttgccaatgacaacgagctttgggttttttgttgatccgcatctgcaccaagcgcagtaaggtgtagcaacaattcccctttttgtacaaattgtccatcttgtacaaaaatttccttcaccagtgcattttcaattggtttaatttctttactgcgtccgctaaaggtaagttttcctgaagcgctagcaacaatttccacgtgactaacaattgaaatgaccaatgctaaaaacaagaaaagcataattaagtaagcaaccaatcttggcttttttgaaaccggtgtttcaattagctctaagtgtgccggtaaaaactcactctcatcactttctcggtctggagtgtctagttgatgacgaattttccaaacttctgaccaaacggttttataacgttggagaaattcccataatcccataaaccatgttttcatttttttctcccttactccgactgtaattgatgtagatagtggtataaaccattcggatcagcgagaagctctttatgtttaccttgttctacaatttgtcctttttccatcacaataatacgatcggcatttttcaccgtggataagcggtgggcaatgataatcacagtacgtcccttacaaatttggtgcatatttcgcataatgatatgttctgattcataatctaatgcgctggttgcttcatcaaaaatcaaaatttttgggttattcactaaagcacgcgcaatcgcaatacgttggcgttgtccaccggataaaccggcaccttgttcacctacgatcgtattatagccttcacgcaattctgaaatgaaatcgtgagcgccggctaattttgccgcatggacaattttttccattggcatacccggatccgctaaggcaatattatctcgaatactacgatttaatagtacgttatcttgtaataccaccccgacttgacgacgtagccagttcggatccgccaatgctaaatcatgcccatctattaatacctgaccgttttccggaatatagaaacgttgaattaatttcgttaacgtacttttacctgagccggaacgacctacgataccgataacttcaccttgctgaattgataaattcacatcatttaaaatcactggtgcatccggtttgtagcggaaacgaatattgcggaagttaatctcgcctttaatttccggtaacgctaatttcccttgatagctttcggttggagagtttaaaacgtcacctaaacgagtaactgaaattcctacttgttggaaatcttgccaaagttgcgctaaacgaatcaccggtgcaatcacttgaccggataacatattaaatgcgattaattgtccgatacttaaatcgcctgaaatcactaaatgtgcgcctagccataaggtaataaccatcacgactttttgaataaattgtacaccttgctgtccgatagtagctaatgtggttacacggaatcccgccgatacatagctggctaattgcttatcccaggtattagtcatttgaggggtaaccgccaacgctttaatcgtattgattgcagtcaccgattccactaagaatgactgattgtccgcaccacgtgcgaatttttcatctaaacggcgacgtaaaatagggctgataaaaatcgaccaccccatataaaacggtaacgagcctaaaatcacaagagtaagtttagggctgtaataccacatcactgcaaagaagataaaggaaaacattaaatccaacacggaagtaagtgcctgcccggttaagaagttacgaatttgatcgagttctcgtacacgagccaccgtatcgccgactcgacgattttcaaaataagagattgggagtgctaataaatgtctgaataatcttgctcccaactccacatcaatacggctggtactatgcgcaaaaatataggtacgtaaaccgtttagcacaatttcaaacagcacgacgatcgctaatgccaccgtaatcacatttaaggttgaaaaacctcggtgtaccaagactttatccatcacgacttggaaaaaaagcggtgtaattagtgcgaaaatttgcaaaaaaattgaaacaattaacgtttcaataaaaatcttacgatacttaattaccgccggtataaaccaagtgaagtcaaactttgccagcttacctacgatggaagctcttgatgcaactaaaatcagttttccttggtataagctctcgaattccgcttgttccaaaatgcgaggattatgcgtttccaaatcaaaaattaaatatttttttgcttcattatcaattttagtcaaaataaaatgtttaccgtcttctcgccatacaagtgccggtagtgcgataaacgccaaacgatcaatcgctttttttacttgttttgctttaagttctaatgattttgcggctaatagccaagcggttagatctaagccttttccttcaaggtcgaatttatgttttagttcttccggatttacagcaatattatggtactgggctaaaatcgtcagtgcgtataatccgtagtcttcttcccgataaaaatccatttgctcctccataaataaaatagcaatcctacacacctaatatatataggattgctattaatcatttaaaaataattatcttaagcagattgtgttaaataattactgaaagcattcggtatgctattcggtgaattgctgtaagctaatggaccgcctgatcccactaaaacttgtccgtgttcaccggtaagtgcaccagtagatgaaatgatttgttcaatatcttttctgagttgaggaagtgcattatatccttctccataatacaatttttcttctaacccattaaagtaattgatacctcttccaggagctgtcagttcagtcagatattggcttaaaacataagctccatctttatcaacgattttttcaattttattattttgtccttctttaccttccttgaaccaatctttaatcgtgagcgcattcccattgtaatcttcatggtaatacagtgttcctccgattcttttattcacaagaagatcatcaccgattctgataaatcctacatctttaaaactaagatccgataacaataacgtatcatcatcaccgcctttctcaataatgatatgacgaccgtactccttactatagcgataaatatccttacctaaaccaccgtagattttgtcattgcctacaccaccgtcaaataagttagtaccatcgctgccatacagaatgtcattacccgcaccacctaataatacgttgtattgaccctcaaagacctgcaactcatcgtcaccatcaccgccattaaggaaattattaccttttccgccgattaatcggtcgtttccgttaccaccaacaagatggtcgttaccgtcaccgccatggattacatcattaccgtcgtctccgtataagatatcgtggccgtcattaccgtagatttcatcatcgcctttcgcaccatggaaaatatcggtaaagcgactaccaaagaatttgtctttacgattactaccgataatttcttcaacagaatgtaattcatctttagctctgataccgttcccaagttcgaatgggcttaactcataatcacgatattctaatttttcactgcgttttccaactgaaatatcctgagttttaaccacttcttttaaaacttttacatcagctttaagttctttagtgacaatatattcaccggctttctgtgcactttgtccgtcaaatgttaagtaacctgtatcggttttatcgtaatatgctacatcatgtccgttacccgcatatacgatagatgaaccggatgaaagatatatacgatcatttttctcacccaaatgagattcaatggtcacttgacgtttttcaccttttttatctatcgctaattggataagattcgtatagtcataaatcgcattatgtgactgcacaccggttaccacccatttttctttacctttaacgaataattcggtcatatattcgtatttaccggtttgcttacgctcacgaatctcttcacctgcggtaaagaccggcgtaacaaatttcaataaagtggttttgttaattgaagaaaggtcgattttaccttcaagcggatcaaacacttttttatcaaaacgatccggttctttctctaaaagttttccttcttcaaagaaatcaacgtaagctttaccgcttttcgtatcagaacctttgcgagtaatgccggcaagttcaccgatattgacatcccaacgctgttgcgtaatagcaacgacacgctctaccgaatactctttattgtattgtgataacaattcaaaggtatcttctaagaatgcggaatggcgggcgtcataaccgttttcaaaatagtttttactgtgttttttctcccattcgtcaatcttattcgctaatttcgttgcaactcgttcgaagattgcctgtttagaagcatctaaaatacctgaaataataccggtgattgcactaactaaagctgctaccggcgcaccgactaatgagccggttgcagcagccccaacacctgcggaagccgcacttaacacactgttaatcgtggttaatgccgcttcaatcgcaccggtttcacggtagaatgaagctaataaactatcaccttcataaccgaactttttaaagcgctccgaatattgttcaagctgtttcgcacgttcaaacttatccgcaacatttaagaacgaaagcgggctaatcgctaatgctacgaccgaaccgattaaaccaccggttgccgcagttgtggataagcctgccgccacacgttgcgcaataatatattgagaaaccgctttaccgatattgcctaagattttagttgagatttcaatacctgccgccgcttttgtacctgcatcggcatctttattacttaaaatgaatgaagccgaaacaacagataagatacctgatacggcatcaaacccaggtcctgcaaggcttaaatctggaaggttatttaacttacttgctaaaccgcttaagcgagtgttagataaggcattgcccaatttacctaattgttcggcaaacgcatccaccgtacccgttgcacttgcaatgttatccactaactgagcggctagatccacacctgctttagctaattccgaaccactgacgtcctcaccgtttctacggcgacgaagcaggctatcaagatccatacccgcaatagccgtacctaagaaactttgtaaggctgaaagtgccgtttgcgttttatttaaacgttgtcctaatgcttccgatgaaccgccgagcgatttacttaatttttggttcttattcagtaacttatcaaactgaggtgcaaataatgcgatgcctcgttccgagaaacctaatagtttttccgttgtaccgaataattctttcgctagtgcggtaccgtttttttccgagcgatgtacttcgatccctaaagcctccgccgctttcactaaatcattaagacttgagccggtactagcttgataatctttcggaatatataaaattaatttctgccctgcttgcttcacctgtcccaaaccattttttaatgcgccggcacctgatttagctgcactttttgtatgttgattaagtgaatcaatcaatcctttgactctatcgagctgagagttagccatgttgtctccttagctatttactaatgaaaatttaaaattttgtttattttttagctcactcattaattcaaagtgatattgttgaaaaattttacttgccagtttcttatcaatttttcctccatgaaattctgaaattttccctactcgagagtccggatcaactcgaatagccctaaacagctcattcgggaagttatctcgcatatgtttgtataatgcggcactgtctccgaacggtgctatccaatctataaaccatcgacgatcgccggaagtccaatcatccgcaactagcgaggcaacatcatcaaggtatttaatttcattttccaaattcaaatttgcccagctacaaaatgcaataggaaaaccgtcacgctttaacaaaacatattgattactctcaatcgcaggtagcacattaattgctaacaaagaaagcggccactttcgatgtaaaggagaacttgcccataaccatgccacctctcctaaaacctcaaatccattaatttttttactcattcatccccccagatttataacaatattgccgtttgtctgacttgattgtaaatacttaccgataaaaataaaaaaaagtaagttttttgattatttatataatttaccaattcattacaaatgaggtttacattatgattttataacaatatcgctcattaatctcgtattttgtgaactgcttcacggtattttttattcaattacggtaaattagttccaataagaaaaatgctttcgattatattcgcggcattttattgatttatgctcaatatgaggctttgattatgaaatttggaaaactttctttagcggtttcaaccgcattactcggtgcggggttaatgtttagttcggcggctcaagcaaaaggacgcttagtgatttactgtagtgcaaccaatgtcatgtgtgaaaatgcggcaaaaacatttgaagaaaaatatgatgtgaaaacctcttttatccgcaacggttcaggcagtacctttgcaaaaattgaagcggagaaaaataatccgcaagcggacgtttggtacggcgggactttagatccgcaatctcaagcgggtgaattaggcttattagaagcctatcgctcaccaaatatcgaccaaattatgccgaaattccaagatccggcaaaagtaaaaggtaacttaagctctgcggtatatattggtattttaggctttgcagtgaataccgaacgtttgaaaaaattaggcattgagaaaatgcctcaatgctggaacgatttgaccgatccgaaattaaaaggcgaaattcaaattgccgacccgcaaagttcaggcacagcctataccgctatcgcaacctttgctcaactgtggggcgaagataaagcgttcgattacttcaaacatctccatccgaacatttctcaatataccaaatcgggtatcacgccggcacgtaatgccgcacgcggtgaaactacggtcggtatcggtttcttacacgactatgcgttagaaaaagaacagggtgctccgcttgaaatggttgtgccgtgcgaaggtaccggctatgaattaggtggtgtgagtatcttaaaaggtgcgagaaacttagataacgctaaattattcgttgattttgccctttctaaagaaggtcaggaaaccgcatggaaaaaaggtcaagcgttacaaacgctaactaatactacagcggagcaatctccacttgcatttgatctgactaaactaaaattaattgattacaattttgaaaaatacggtgcaagtgacgaacgtaaacgcttaatcagcaaatgggttgatgaagtgaaattagcgaaataattattcgccttttgataagcggtcgtttttcgcaaaaaatttgcaaaaaatcagcgaaaaacgaccgcttgtttttctctattttatacgttgttgtgaggctatatggattctattacaaataaaagatcgctgtttgaatctagccacttttggattctgctctcacttattgcatttattgttctgccttccaaagcactggattacggtttattggaaagtacttcagatgaatttttagatgcaatgggttggtcttccgttaatttgacgatactttggtttttacctttaatcggtttctggttactcccttccttaaaactttcgaccgaagcccaggcaaaagcggaattaggtttaatttctttcatactattattcgcctttatttcggcaacgatttataaggtcagtatgggctattcggttatcgtattaattgcaaccttaaccgcacttgccacctttgcttttgctaaactcaaaatgatgcaaggcgataaatttattattgccgcattgctcagtatcatcttgctgattttcttttttatcgtttatccgaccgttgcgatttttatttcgatgttttatgacggagaaacgttcgcaccggaacaagtggtcagaattttagggcagggttatattgttcgagtaatcagtaactctttattcctttccggctttgtcggcattgtttcaaccgttttcggtttagcgtttgcgctttatactactcgtatcgctcaccgtaccgcctttatcgggaaaattttctcaatcctaccgattgtgacaccgccgtttgtggtgggtcttggcgtaactttaatgcttggtcgttcgggctatgtgaccgaatttttagatacctatttcggctttaaagatcataactggctgtatggttttaacgggattgcgattgctcagattcttgctttcgccccgatttcatttatgattttagacggtgcgttaaaatcaattcacccttcgattgaagaagcgtcttatacgttacgagcgaaccgctatcaaacgttctataacattattttcccgttattacgtccggcattggcaaattcatttttaatcgtgtttatccaatcgctcgccgacttcagtaacccgttggttttaggcggtagctttgacgtaatcgctactcaaatttatttctatatcgccggttcgcaattagattacgcttcggcaagtaccttaggttcaatgttgctgattttctcattattgatctttatcgttcagtatatgtggattggtaatcgctcttatgtgaccgtttcgggtaaatcttatcgcggcgatgtacaagacctaccaagcggtttgaaatataccattattgcaatgttaggtttctgggtggtgttcaaccttgcgttatacggcagtattttctacggcagcttcacggtcaactggggggtagattacactttaaccttgaataactatgcaatgttattcggacaaggtctaagtgatggggcgtggccgtctttaatcaataccatgatctatgccggtattgccgcaccgttaacagcgttattcggcttactcatcgcttatattgtggtgcgtaaagatttccaaggtaagaaaacgcttgagttcttaactatgctgtgctttgccgtaccgggtacggttgccggtgtgtcttatattctcgcctttaatgatgcgccaatgtatattaccggcaccggtatcatcattattatttcaatggtaatgcgagatttaccgatcggtatgcgtgcggcaattgcgggacttgggcagttggataaatcattggatgaagcctcattatcattaaaaggcagttcgttaaaaaccatttggtttatcgtcttcccattattgaaaccggcattgttatccgcattagtgaccagtttcgtacgtgcgatgacaaccgtgagtgcgattgtgttccttgtgaccgcagatactcgtgttgcaaccgcttatattttaaaccgtgtggaagacggtgagtacggggtggctatcgcatacggttcaatcttaattgttgtgatgatggcgatcattttattcttcgactggattgtcggggacactcgtatcgcaaaatcaaaagcgaaaaaagcagattaattcgtcccgggcggtattgtcgctcgtgtataaaaggcaaaatattatgaacaacgatttcttagtactgaaaaatattaccaaatctttcggtaaagcaacagtaattgataatttagatttagtgattaaacgtggcacgatggtcactttattagggccatccggctgcggtaaaaccaccgtattacgcttagtggcagggcttgagaatccgacaagcggtcaaatttttattgatggcgaagatgtaaccaaatcttcgattcaaaatcgagatatttgtattgtgttccaatcttatgcactattcccgcatatgtcgattggcgataacgtcggttatggtttacgtatgcagggcgtaagtaacgaagagcgtaaacagcgtgtgaaagaggcattggaactggtggatttagccggctttgaagatcgttttgttgatcaaatttctggtggtcagcaacaacgtgttgcattagcccgtgccttagtgctaaaaccgaaagtgttattatttgacgaaccgttaagtaacttagatgccaacttacgccgttccatgcgtgaaaaaattcgtgaattgcaacaacgcttaggtattacctcgctttatgttacgcacgatcagactgaagcatttgcggtttcggatgaagttattgtgatgaataaaggcaagattatgcaaaaagcaccggcaaaagatctttatttacgtccgaattctttattccttgccaactttatgggcgaatcgactatttttgacggtagcttaagccaaggcacggtcgcaatcggagattacagtttctctcttcataatgctgcagattttggtattacagacggcgaatgtttggtcggtgtgcgtccggaggcaattcgacttactgccaccggtgaagctggtcaatgttgccaaattaagagtgcagtttatatgggcaaccattgggagattgttgcagagtggaacggtaaagaagttttagtgaatgcaaatccggatcaatttgatccagaattaaaagaggcgtttatccattttactgaacaaggtattttcttacttaaaaaagaataatttatagacaatggtaagcggttatttttgttaaattttttgcaaagatggccgcttatttctctatatgttatacctatttataggtatgcaaatgttacataatgcagcattctttgtgtaaatttttgaaaatatgacatataaaattatctttgctttacataaaaccgtttcgatagtgtaagttatggtaaaatgtaattttcatccacaagagggcgctatgttcaaacaaattgcattgtcagcactcaggctgataaataattatttgcatcggtttaacgaatggttattccataccaaacagaagtatgaagatcgcttcattttagctgatattctcaatagtgagatttacttgcaaaagtatggattagataattttcatcggctgttagagtaccaacctcaattagtacgttatatcaaaataaaggaggaatataatttaaaaagtaagtttattgtttatgagagggatatgttgcttcctgacgagttcgaatattatatgcttaaactaactaaaaatttaaaagaaagcctattttttagtgagtttagtcatattcaattggatagagttgctcaagatactgcttttacttacgatttagaaacaacatttaaatttattagggagaaaggcgataggcttaatattatttttatcgatgataatatggcttacgtttgtattacttaatacacgataaaatttttaaaaattaattattctaacttaatcgatataacgaatttttacgataattagatgcttatcattgtcaatagaataagaaataaggacatttatttaaagcatggaaacacaatcgttttatcttcaattgatagctgttaaagtgagaatcgcatagtaatttataccagagttaatggtgtttttagtatattagacttattttctaatatggtttaattaggaatacataataaaaaaggaagcttttaagcttccttttttatttatagcgaacttatttcactgttacacgtgcaaatttacgtttaccaacttggtaaacaaaagtaccttgttgtgcattttgacgaacgtcttcgactttttcgccatcaatttttacgccaccttgctgtgctgaacgaatcgcctctgaagttgatgcgactaaaccggcttcttttaacaaggttgctaaaccgatttcaccttcaaacgtaaattccggcatttcatctggaattgcacctttttggaaacgattgatgaattcttgttctgcagcatctgccgccgcttgatcgtggaaacgtgcaattaactctttcgctaataaaattttcacatcacgtgggtttttaccggctgcaacgtctgcttttaattgggcgatctcatctaatggacggaatgaaagtaaattataccaatcccacattaattcgtctgaaatcgacatcactttaccgaacatatcgcttggtgcatctgttacaccgatatagttaccaagtgattttgacatttttttctcgccgtctaagccgacaagtagaggtaatgtcattgctacttgcggtttttgacccgctgatttttgtaactcacggccaactaataagttaaaggtttggtctgtaccacctaactcaacatccgcttctaaagccacagagtcatggccttggagtaacggataaataaattcgtggattgcaatagattggttattggcaaaacgttttttgaaatcgtcacgctcaagcatacgtgcaacagtgtaattagatgcaaggcgaatcataccttcggtacctaatttacctaaccattcggagttgaataccacacgagttttatttggatctaagatcttgaataattgttgtttgtaagtttccgcattacgtaatacgtcttcgcgcgttaacggtggacgagttgagtttttacctgaagggtcgcctaccataccggtaaaatcaccgattaagaaaatcacttcatgaccaagctgttggaattggcggagtttatttaaaacaacggtatggcctaagtgaatatcgggggctgtcggatctgcgcctaatttaacgcgtaacggacgattttcttttaacttttcaattaaatcttcttcagaataaatattttcaacaccgcgtttcagttcggctaatgttgcttcaatagattgagccatttgcttgattccttatatcttgttttaaatatgaaaatagaatctattataacgagatacgttgtgattgataaggcttaatcggcaatagacgaaaaaaaacgcctcattttgtgggggaatgaggcgtaagagttggagtgattacctattatttttgaagtgagttaatgataataattctcaagtaattaagcaagaggctttacaaattcttacaaatgagaatctttatcatttaactttggtgataatagaattttttaaatgttgattcaagctaaaaacaaactaacatagatccaaaagttacaagtatttgcgtaatgaaacttttactgaggtttagctttctcgacaatttagccaaggtactcgaacaccattgatattgcgataataagcagaactttgctcacgtgcaatgaggtcaacatagctgccttgaattggattgtatgagcgataagttacttcaaaacgagaacctcgtgcattgagcgttttattttcaatatgatcaaacggttcaattttcccgccgtctaattggaagtagaagccgaagttatctttcatacgactttctcttgaaagcggaaagtagctggataagtaagaacttgtaccggtttcaaaattgctacaaagataatgatagcgcttatagttagctcggtttgctaattcggtttgactaatattatcctttaaataatctgttttcgcttttttagtcggcgaaggggaacaagcaaataaagttgtcagtgttgaaattaaaaaaataagtttaagtttattcatataaatagttccgataaaaatagcctagttttggctaggctatgatagttcaaattttagcgctgacaagcggtagaatttgtaaaaaattttgcaaatttgaccgcttattcgctatttcttacgtttagttgctgctggtttcttagcttttttggcggttttacgagcagctttttcttttttcggcttcgacttcgttgctttgatggttttcggctctttaaagattggtttatcgccaacttttttcgctttctgcttcgccgttttgcccactgcaatccctttacgcaaattaccgattagcgcaaaatcgattttcttatcatctaagctcacattaattactttcacttttaccggatcacctaagcgataaataatgccactaccgccgaccaaacgttgtctgtctgcatcataatgatagtaatcgttatctaatgttgaaatatgtactaaaccgtcaattagtagctcattgattttaacgaataaaccgaaaccggtgacgcttgaaatcaccccttcgaacgtttcaccgagatgatcttgcataaattcacatttcagccaatctgctacttcacgggttgcttcgtccgcacggcgctcggttgcagaacatttatcaccaaattgatcgatgtcgtccaatttatagtggtagccaccaccgtccgtataattgcgagtgttacctttttctttttcaatcaaatacttaattgcacggtgtaacagtaaatccggataacgacgaatcggcgaagtaaagtgagcatactcggttaacgctaaaccgaaatgccctacattatctgccgcatatacagcctgtttaagtgagcgaagcaacatggtttgaattaactcacgatccggacgatcggcaagctgttcaatcagctcggcatagtcttttggttccggatcaagccctacattccaagtcaatccacattctttgataaaggatttaaaactggtcagtttttcttcgcttggtttatcgtgaatacggaatagtgccggttcattcgctttttcgacaaaacgggctgaagcgatatttgctaaaatcatacactcttcgataattttatgtgcatcgttacgaatcagcggttcaatccgttcgattctgccttgcggattgaaaataaattggttttccaccgtttcaaattcaattgcaccacgagcttgacgagctttgactaacacttggaacatttcgttcaaggtttccaaatgtggtacgagcggtgcgtaacgctcacgtaatgcttcatcgccttctaacattttccaaactttggtataggttaaacgggcgtgtgagttcattaccgcttcataaaatttatagccggtcagttcgccttttttggatacagtcatttccgccaccagacataagcggtcaacttgtggattcagtgaacacaaaccgtttgataaaatctccggtaacatcggaatgactcgatttgggaagtaaaccgagttaccacgatttgccgcttctaaatcaagtgcggttttcgggcgaacgtaatagcttacatcggcaatcgctacccataaacgccaaccgtcaccttctttcttagcaaaaacggcatcgtcaaaatctcgcgcactttcaccgtcaatcgtgaccaaaggtaaatcacgtaaatctactcgaccaagcttagcttcttccggtacttcttcattaaattggcgaatttgtttttctacaccttccggccaaacgtgcggaatatcgtggttacgcaatgcgatttcgatttccatgcctggtgcgaggttatcgcctaagatttcggtaataaaaccgactgggcggttgaaactggctttgcgttcttgcagttccactacaaccacttgccccattcttgcgcccatacgttgatcgtcaggaattaaaatatcttgagtgagacggctgtcgtccggcacaacaaaaccaatgccgctttcaaggaataaacggccgacaatttgttttttacgtgcttctaaaacacgaacaatgcgtacctcacggcgacctcggcgatcggttccgtttggctgagcaagcacaaaatcaccgtgcatcactcgtgtcatttggttattcggaataaaccagtcatcgcttttttcaccaccttctacttgcagaaagccgtagccgtcacggtgaccgacaaccgtaccttttatcaagtccattttttccggcagggcataacgtttacgtttggtaaaaattaattgtccgtcattttccatcgcacgtaagcggcgacgaacaccttcgatacgctcttcatcataaatatgaaacgcttcgagcagttcttcacggctcatcggtgcatcaaattctcgaatggtatttaaaataaattcccgactcggcacgggattctcgtatttttcgagttcttgttggtaattaggatctactatcataatattctctatatgctaaagcggtctgatttgcagaaaaattgacaaatcagaccgcttgaattttaagttaggctactcagccataaacggactttaagcccccaatagcttgtaagccctgttgtatgctgtacaaccttgccgtcttttatgattaaaatcgttggggtggcttggatgttccagcttttggatatttcgccatcaggatcattgatgacggggaagtgataatcttcttggctgagataatccgcaacctgttgcggactaccggatttgagcgcaacacttagcaccgctacgttatcatccatcaattgttgaactgcaggtgaggtgaatttgcagtagttacaccaactgccccaaaagtagagcaacagcggtttttgatggcttaattgtgccatcactttcggctgttgctgcaaatcgtagaaaacctgttgagcgaacgcattcggctcactgggtttgcgataccaatcaactgcaatacttagcacgataaacattagcccgtaaacaagcaaatttttaccgaaacggaaaagcatagcgtttttgttttgcattattggtgatcctttgtatggctataagtgtaagaagccgcaccacgagtaagcattctgagttgcataatcactcgctttttcagtttttcacgttcttgcgtattcatatcaagcgcataagcgccggcagtaaacacaatcgtcatgagtccctccgcttggatatgggcgatttcacggctactgttgacatctttactcataatatagtcggtcaattccgcaataaaatgctgaatttctcgtgatgccgccgtacgaaaggcttgtgatgtaccagaactttctcggagtaacaaacggaatacattcggtcgatccgtaataaattcaaagaacgtttcggttgaaactgcaaccacgcttccgccgttttcaatacgtttacgagcttggcgcatgagttgacgaagcaataaacccgattcgtccaccatggctaagcctaattcgtccatatctttaaagtggcgatagaacgaggtcggtgcaataccggcttctcttgcgacttctcgtaaactgagattagaaaaacttttctctgcacttaattggttaaatgccgcatcgactaatgctcggcgtgttttttctttttgctgtgcgcgaataccgatgttactcattgatgttctcttgcttcataatattggcaacttcttttgcaagacgttcatagcgaaggcgtaatggtgagccagggcgataaattagtcccacagaacgatatggttttggatcgttaaaggcgaggtattttaagccttcacacgatttagctgctaattctggaatcagtgaaatgccggcatttgctgctaccatattacgtaatgtttctaagttagtcgctttaaaatgtgtgctttctttggcgccgacagataagcagtaatccaaggtttgggtgcgtaaacagtggccgtcatctaaaaagagtagctctttatcttttaaggcgctaatgtctaaacctttttgatttgcccactcgtgttgctgtgaaactgccaataacatttgctcattgaagataggtacttcgataaatggctcgctttctttaacaaaagccaagattccgcagtctaattgacccgattcaagctgatctaccaattgtgaagtttgtagctcgtaaatataaagttctagttcgggaaacgccgattttaacgcaggcaatacaagtggtaaaagatacggaccaagtgttggaataatgccaacatgaagtggaccggacatttcttttccttggttacttgccatctcttttagcacttttacttcgcgtaatacggctttagcttgttcaaccagagttaaaccggcttgcgtgaataagactttacggctggtacgctcaagtaaaaccgtacctaattcgtcttctaatttgcgaatttgaccgctgagtgtcggctggctcacattacaggcatcagccgcacggcggaagtgtttataatctgctaaggcaattaaatattctaaatctctaatattcacaggaactcccagttagatcgaagaatgaccatttttcctattaatcaaataggctgaattatggcatatttaggtgtagaatgcgtacggtttttgaaaacattatgtaaaacaggagaattttttatgtcatttaaagatatgactgggcaaaaagtgcctaacgtaactttcccgactcgtaaaggtggcgaatgggttaatgtaactactgcagatttattcgataacaaaactgttgtcgttttctctttaccaggcgcattcacaccaacttgttcatcaactcacttaccacgctacaatgaattagcgggcgagttcaaaaaattaggtgtagattcaatcatctgtatctctgtaaatgatactttcgtaatgaacgcatgggcgaaagaccaagatgcggaaaacgtaatcttattagcagacggtaacggtgaattcactgaaggtatgggtcgtttagttgataaagcgaacttaggctttggtaaacgttcttggcgttattctatgcttgtgaaaaacggcgaagtagtgaaaatgtttgatgaaccagaaaaagatggcgacccgtttgaagtatctgacgcagaaaccatgatcaagttcttaaacccagagtggaaagaccaagatccaatcgtggtattcagcaaaactgactgcccattctgtgctaaagcaaaagcattattagctgaaaaaggcttacgctttgaagaaatcgtgttagataacgattcacaacgtggtaaagtggtacgtgcggttgcaggtagccaaactgttccacaaatctttatcggcggtaaattaatcggcggtagcgatgctttagaagcgtattttgcaaaataataagcaaatttaaccgcttatataaaaaaaccgaacgtttaaaagcgttcggttttttgtttttattaggactattctgcaaattcttgcataaatttgaccgcttgttgcaccattgaggttgagccaacaaagaacgggacacgttgatgtagttcggtcggtttaatatctaaaatcggattaaaaccgtctgttgccataccgccggcttgctcagctaagaacgccattggattgccttcatataataaacgtagcttaccttttggatagacagttgaggttgggtagatatagatcccaccttttaatagattgcggtgaaaatctgacactaatgaaccgatataacgtgatgaatacggacgtttagtcgcttcgtcactttcttggcaatatttgatgaattttttcacgcccatcgggaaagtgacatattgtccttcgttaattgagtaatattttccttcaaacggcattttcatatccggatgagacagaataaataaaccgagggacgggtcataagtaaagccgttgacgccgttaccggtggtataaaccaacattgtagatgaaccgtaagtgacatagcccgacgccacttgtttgcgcccttcttgtaagaaatcttcaatcgtaaccggcgtaccaatcggtgaaacacgtttataaattgagaaaatcgtgccgaccgaaacgtttacatcaatatttgaagaaccgtctaaaggatcggtcattaaaatatattttgcatttctacctctttcgttgtcaaaagcaacgaagttatcgtcttcttcagaggcaaaacctgccacatcttcacgtgcaattaatgcttttttcatcgtttcattggcaaacacatctaatttcatttgtgcttcgccttgaatgttttcagatccggcaacgcctaaaatatcttggcttaaaccggcacggttaatttcacgatgaataattttagccgcaaggcgaatagacgataagataccgcttaattcaccttttgcttctgggtactctgcttgtttttcaataataaattcgccgagtgttttcataatttctccttggggtatgctaaaatagctagcggtattatagaaagaaattaaagctccctctaacggggtataacaagtttgtgacattgatcacaaaatttttacattaaaggctaatttatgacgcaaaaacacattcacattcttggtatttgtggcacttttatgggcggtgtagcgatgatcgctcgagaactgggctataaagtgacaggttcggataccaatgtttatccgccgatgagtacatttttagaaaatcacggcatcgaaattattcctaattatgatgtggcgcagcttcagccggcaccggatttagtggttatcggtaacgcaatgagccgtggtaatccttgcgtagaatatgtattggataatcagctaaattacacttcaggcccacaatggttacatgatcatctgttaaaagatcgctgggttctagcggtgtctggtacgcacggtaaaaccactaccactggcatgttagcgtggattttagatcaaaatcagattgataccggctttttaatcggtggcgttgccggtaatttcggtatttcggcacgtgccggttcaagcaaattctttgtgattgaagcagatgagtatgattctgcattctttgataaacgttctaagttcgtacattacacgccaaaaacgttaattatcaacaatattgaatttgatcatgcagatatttttgacgatttaaaagcgattcaacgtcagttccatcatttagtccgtaccatgccgagtagcggttgtattctttcggcagcagcagatgagaatgtacaaaatacgctaaaaatgggcagttacagcgagctgcaatttattggcgaagataaacagtggtttgcaaaaccgatttcagcagattgttcgaatttcgaagtattccacaaaggtgaaaaagccggtgaagtaaaatggaatattatcggtgcgcataatatgcataatgcattaatggcgattgccgcggcgcatcacgctggtgtatcggtagcaggcgcttgcgaagcactcggttcatttattaatgcaaaccgccgtttagaagtgaaaggcgaagtgaatggtattaccgtttatgatgactttgcccatcacccaaccgcaattgcggcaaccattgacgctttacgtggcaaagtcggcaaagaacagcgcattttagcggtgcttgagcctcgttccaatacgatgaaaatgggcgtacataaagaagaaattgcgccaagtttagccgatgcgaatgcggtatttgtttaccaaccggacacaattccgtggtcagtttcggtaattaccgattcactctcacaaccggcagcatggtcggcagatcttgatgaattggtggcgttagtggtaaaagaagcgaagccgaacgatcatattttagtgatgagtaacggtgcatttggcggtattcacaataaactcttaaatgcactaaaaagctagttttcccgtctatgtaaaaataccgcctagagagctaggcggtatattcttttatatatttctccaatacttctttaagttccctcatattaatatatctcgccgaacgccaaatttctttgccgtccgcaaagaaaagtaccgccggtgcggtgagtacgtgaaaacggctggcaatcatcggcaccgttgtgatattggtttcaacacctgtcatttcaggtaattccgccacgacttcggcaacctgttttctaaataccgtacacacaccgcaatttggtgcttgtacataaagtagtgttaagcgattttcagcaagatactgttcgatagtcgcaagatcgtgagcgttatgcatattttcctcctatttaaaaatgacaagcggtcagatttttgcaacattttacaaaatccgaccgcttgaacatagttattcggcaaataatccgtcaatcacttccgctacggttttgatttcgtggatattggcaatgcctaagccgacacagccccaaccgttatcgaaatctcctttcatcataccgttgccgaaaccggataaaccagccattgctttaccgatttcgctgtcgtctgcaccgctttgggtgagttcaaccaatttttccgtgagtttacccgtgaaagaacgggcgaacgttggcggtgctttaaagagcaataaatcatcaggcgttgagcgaacaatgctttctttcactcgttgatgggttgggttttctttggttgccaataatgctgttcccacaaaaatcccttccgcgcctaaggcaaatgtggctttagtggtacggtggtcggaaatgccaccagctgccataacgggcacattcttcgccgcatcgacaatcatcggtacaatcgcaaaagtaccaatcgctttttccggcattaaaccgccttcatcaaaaccggttgcgacaataatatccgcccctgcttgttccgcttgttgtgtattagcaatcgtaggggtaattgctcggaaaataattttcacacccgcttgttttaattcggcaaaaatctccggtagcactgtgccatcgcctatacccatccatactacaccgtgtacgccttcttctttgatgacatcaataatcggacgagtccaaggatcttttgattgatcaggatttggggcaaggttcacgccaaacggcttatccgttagggctttagttttgcgaatttctgctcgcatacgctcagccgtttcaatcggagaactggtcatctctgtttgccctgcattcggcccaagcacaccatagccacctgcattacttaccgccgccacaaattcagcattggttacccacgacattgggccttgcacgataggtttttcaatccctaaaatttctgtaattcgatttttcattttatatcctttgttttagcgatcatttgcaaacttttgagggaaaatgaccgcttgtaatgttaattaaaattagccttaaacaatacgatgaaccacaggaactgggttggtaaacatatcgtataacggagagtgattcggaatttctgcaattaaagcctcgacttcggcacggctagcatttgagctttcaacgtgaatatccacacgaatttcacttgcaccgtttcgtacgtttggatcgaattttaaaaagccgtttaagtcaaaatccgcttcaagatttagctcgattttttccaattcaatgcctttgcctgctgccaataatgtgagagtggcggtgtaacaacccgctaaggcttgcaaagcatattccattgggctaagcgctttgtcttcgcctaaaactgcttctggttcatcaccgatggtttcaaatttacccacacggctttcatcaacaataccagcgtgaacggttttgcctgtgcgagttttcacacctacaccaccgttagattggctggtcattgtgacggtaaatcgccctaatttcggctcatttttcaccgcacttgctacttctgcaactttgtttggatcaacataaggtttcgtcattttattttcctcgaataatgttaaaaattgcctaaaatgctttttcaataaaagcagctaattgagatttcggcattgcgcctgcggtgcgatcaacaatctcaccattgcggaaagttatcaatgtcggaatgttgcgaacaccaaatttcattgaaagctcaggattttgatcgacattgattttcacgattttcgctttgccttgatattcctctgcaagcgcttctaagcttggtacaatcatttgacatggtggacaccagtctgcgtaaaaatccactaacacgggttgttttgcattcaaaacatcttgctcaaaatcgttatcgtttgaataaaaaatagtattgctcattgggaattctccagcttgttaaattgtttcagtcttgtgctgatgtgagtcattatagaaaaaacaagcggtcatttcttgccgaaaacaagcaaattattgcctaatttgataatgtgggtagaatatgtgaaaagagaggaatcggatgaaaaacgaaaaattgcaacaaattgcggaattgataaaagaatttaccgcagaagaagggtgtttctacatgactgaaattcaaactttaagcctttgtcgccgtaatcacacgactaatccgatgccgtgcatttatccgttgagcttatttttggtagtgcaaggctcgcaacatgtgaattttggcgagagtgtaatggaaattcatcggggccaaacggcgctgacaacgctggatttaccggtagtttccaatgtgctcaatgcttctaaacatgaaccgtatttgagtttgcggattgagcttgatgcgatgttactgcgagaacttgacgaacaaacgcagtggcagccgacaacttccagtttatcagatagcttatcggtctttccggcagatgaagatttactagatagcattttgcgtttgatgaaactgcttaaaactccaaaattacaatcgtatttgcgaccgttagtagagcgagaaattgctttgcgattattggcaagcgaccatcatgcaatgttaagaagattgcttacgcaaggtacgattgaacaaaaaattgcaaaagtaattgcctattttaatgaccattatgctgagaagattgaaatggatcgcctggcggaaatggtttttattagtccgtcttcgctccgtcagcatttccgtaaaattacgggtacaagcccgttgcaatatcaaaagcagttgcgattacagcacgcaagacgattaatgtttaagcagaattttgatgcgaccagcgccgcaatggaggtcggctatgaaagcccaaatcaatttaatcgagaatacgcccgctttttcggtgaaccgccattacgggatattcatcgcttaaaagaagacgaaatgcacttcgggcgaattgtataaaaaatcaagcggtcaaaatttgcaaattttttgcaaaattagaccgcttgtaagttgttttaaagctagggtgaaaggcttatcttctaagttctagggcttgccaccattgattgttttggaaatgttccggttggtatttttcacccattttcggcacgtctaatataacgcccttttccgctgccgttttaacgctggtgtcaatagattgataccaagggttacgtcctaagctaaatacgccccaatgaatcggtaacattcttttcgccttaagatcttgggcggcttgtactgcttgttctgggaacatatgcgttttcggccagccggcattagcagcgtcaatttcaacgaaagcgagatcaaatccgccatatttctgcccgatttccgctaaatgtttgccgtaactggtgtctccgctccaaaagatacgtcgtccgtttgcttccaagacaaaagaagcccatagggttttattgcggtcggttgtccagcgagaggtataatgttgagcggtttcagcggtcagttttatctcaccaaacatactgctatcaccccaacctaattcagtaattttttccaccggtacgccccacgattgtaatctcgcccctacacctaacggtgcaataaagcgatcaactttatccgctaaatggcgaatcgtatccgcttccaaatgatcgtagtgatcgtgcgtcagtaacactgcatcgagcttcggtaagtttttcaactgaatcggcgcttcttgaaagcgaggggcaatcaacggaaaattgagcggattcgcattaccgaataccggatcaattaagatacgttgactgctcaattccaaaattgccgacgaatgtcctaaccaatagtaagcgaattgttccgcttgtccaaagctgttttgatctaacatcgtcattggtaaacgtgctttcggtgtataaccgtcataacgaataaagccgcctttgccggtcgcctgttccggatagtaaggcaattccggttcatatagattagtaaactgtccgtttttgtaatatggcagattacgaaaacgactttcatccggtaaatcgccgagattgcgataaagcataattccgagcactgcgactatcagtagtatcccactaaacagataaagtaagcccttaagccatttcttcacattatgctcccatagcagctaacgcttttgcatgaaatgcgatatgtttttcgataaaactcgcgataaagaaatagctgtgatcataaccttcgtgcaaattaagcgtcacatcaaaacctagcttttgcgctttttcggcaaatatttccggctgtaattgggttggatagaagctatcggcaagcccttgctcaatcaaaatagggcgagctggcgatacgttatctaataacgcaaagctgtcatattccgcccaagcggtctgattttcacccaaataagcagtgaaggctttttgtccccatggtacttggcttggggtaacgatcggcgagaaagccgagatcgcacagtaacgttccggattctttaagccgatttggatcgcaccgtgtccacccatactgtgacccgaaattgaacgtttatcgctaactgggaagtttgcctcaataagcgccggcagctcttgcacaatgtaatcgtacattttgaaatgcgcagcccacggttgttgggtggcattgaggtaaaaaccggcaccttgacctaagtcgtaaccttcatcatttgcaacggcttcaccacgtggcgaagtatccggcatcacaatcgcaataccgtgttgtgcggcaaattgttgtgcgccggctttggtcgcaaagttttcatcggtacaagtcagccctgaaagccaataaagcaccggcactttttgcccttgttccgcttgcggcggcaagtagatagcaaaagtcatttcacagtgggtgctgtttgaataatgcgtataacgttcgtgatagccgccaaacattttatagcgggcaatttgtgtaagtgcggtcatttttctccctttttttacgatttaatcggacgatattcttttgctaaggcacgaatcacagccgggcggttagcaatctgttccgcccaacgcatcaggtgcggatattcgtgtaccgctaaaaattcagcagcgtcatacacacgatttaacacaatttgtccataccagccccaaattgcaatatcggcaatgctgtaatgttcaccgcaaatataggttttgtcggcaagctgtttatttaacaaatccaattggcgtttcgtttcaagagtaaaacggttaatcggatactcttgcttggttggtgcatatttgtagaaatgcccgaaaccgccgcccacgtaaggcgcacttgccatttgccaaaataaccaagacaaacattcggtacgttcgctgaaatcggtcggtaagaacgcattaaatttttcagctaaataaagcaaaatcgcaccgctttcaaataccggctgcggtttttcacggctgtaatcgagtaacgccggaatttttgaattcggattaatgtttacaaaatccgaaccgaattgatcgccctgtctaatatcgatcagaaacagatcataagcggcttttgagataccaagttctaataattcctcaagcataacggtaacttttacgccgtttggcgtaccgagagaataaagctgtaaatcatgttcgcctttcggtaaatgctgttcaaataaagcgcctgaagttgggcgattgatattagcaaattgtccgccgtttggtgcttcccattgccatacttttggcggttgatattcgattgtcattacttttctccattgaatttgcaaaaaattgtgtaaattctaccgcttgttaagttataaaggctaatcactttttctgatgtttaatataaaacggattgatgtctggttatatagatcgaagataaaaataggcagagtttctgcctattttgctgatgagaatgtgattactcttggaacggattaaacattcgcacaccggtttttgcaaaatccgccacattgcgagtgactaaaatcaaattgtgctgaattgcagtcgctgcaatccacgcatcattttcagaagcatgatcggggatatgtaatttggcacaaatgcgagcggtttcttcatcaatattaaggattttgcctgcaaacgtcggtttaaccatctcatcaaaccaacgacgtaatactttaccttgagcaatatctttacgctccattgataaaatccctcgttcaatttccatcattacaatcgcattggtttttatcaattctgatgatgtactctcaacccattccgctacgcccgcattgcatttaccttgcttcatcttgcgaatttcactgattaaattagtatcaagcaaatacatttttccccctaaaattctaccggacagcgttgtccacggctacgaggttgcaattcaagctcaacatcggcagcttcgggattaggatcagctaatgcttccccaatactgcgaaaggttttgggttggtattgctgttcatagtttttgtatgtcatcaacacaaacgccggttcgcctcggttggtgataattacaggggcggtaagagccgccttttgagctttgccaaggttttgattaaattcacgactggttataattttcatattatttctccttttgtagctaagttgctacaaaaataatagtctattttatgaacattcgcaagcctgttgaaaaatggtaggaagattttgagagaagaaatttgataggaaaaacaaaaggggcttacgccccttatttaatgaaattaaaaatgaatcaccgtacggattgatttaccttcgtgcattaaatcgaaggctttgttgatgtcttccaatggcatagtgtgagtgatgaaatcacgcaatttaaattcgcctttcataaattggtcgataatgcccggtaattcggtacgtcctttcacgccgccgaatgccgaaccacgccatacacgacctgtcactaattggagcggacgagtacggatttccgcacctgccggtgcgacaccgatgatgatactttcaccccaacctttgtggcaacattctaatgctgaacgcattaaatccacattgcctacacattcaaatgagaaatccacaccgccatcggtcatctcaataatcacattttggattggtttatcgtaatctttcgggttgatacaatccgttgcaccaagttctttagctttttcaaatttagccggattaatgtcgatcgcaataatacgacctgcacctgccattcttgccccgataattgccgcaagaccgataccgcctaagccgaaaatcgcaaccgtatcgccttgtttcacttttgccgtacgggttaccgcaccgataccggtggtgacaccacaaccaagtaaacacacttcatcaagcggtgcattttcttgaatttttgccaatgagtattcggaaaccaccgtatattcagagaaagttgaagtccccatatagtggaaaatcggctgaccgtctttaaagaaacgcaccgtaccgtccggcattaagcctttaccttgggtttcacgtactgccgaacaaaggttggtttttcccgataaacagaatttacatttacgacattctgcggtgtaaagtgggataacgtgatcccccactttaaaatcggtgacaccttcgccgactgcttctacaatccctgcaccttcgtgaccaagtacgcacgggaacacaccttcgctatcttgaccagaaagagtataagcatcggtatgacacacaccggttgccactaaacggactaacacttcgcctttttgtggcggcattaaatccaattcttcaatttttaacggttcattcggcgcccaagcgaccgccgcacgagttttgataaattccattgctttccttctttttatagattgcagtaaaaagttttataaattttaccgcttgttttaatataaatgccaatcacttttcgtaataagagatataaatagaattgatgtcttaacctgtgtatctggtactgaaaaaccctcttttcgcctgagaaaaaatggcatacaatccggacagtttttacccattcacagaaggaaaacattatgacaacagaatttaaacaagtaggttggattggcttaggtcaaatgggtgtaccaatggtaaatcgtttattagcacacgatattgaagttggtgtgtttaatcgaaatgtcgctaaatgtggtgaatttgctgaaaaaggtgcgaaagtgtatggttctgccgttgaacttgtgcgtgcttacaaagcggtgattttaatggtgtctgattttgctgcggcaaaagatattctcaatgcagaagtttgcgccaatttaaacggtaaaattattgtgaatatgagtaccgtttcacccactgaaaataatcagttaaaagcaattgttgaacaacacggcggacgttttgccgaagcaccggtttcaggttctgttgtaccggcgaccaacggtacattattaattttatttggtggtgatgaggcggtacttaatccgttacgtaatgttttcagcatcttagggcaacgcactttccattttggtgatgtgggtaaaggctccggcgcaaaattagtgttaaattcattgctcggtattttcggcgaagcctatgcggaagcaatgttaatgggcgaacaattcggcatcgacttaaatgaattagcggaagcgattggcggctcggcaatgaactcaccgatgttccaaaccaaaaaaccgttattacttgcgaaagaattccctgcagcatttatgctcaaacacgcaagtaaagatctcaacctcgcttgtggcgagctggaaaaagcaaatctagatctacctgcagtaaaaaccgttgccgaacaataccgcaacgccgttgccgccgatctcggcgagcaggatgtttcaggcatttatttgcagttggcgaaatagccctccttatttgaaaagaaacgctgtcagacaaagcctgacggcgttttttatattctgaagaaagctgaaattagtgtaatatatacttatctcaataaatacaggaaaacagcaatgacggctcgctataatgaaaaaaccagagttcaaattcccgcagtagcgcatttagggcgtttgggatatcaatatctttcgctaaaaacagcgcaatgggatgttagcaataacatttttggtgagatttttaagtcggcgattgcaaaaattaacccaaatttgactacttttgatctcgaacgagagctgaaagatgtggcgatgttgctcaaaaatgaagatttagggcaagcgttttataagcgtttactgcaagttggcaccgctcgcctgattgattttgactgtattgagaacaaccaatttcacgttgttgccgaactaacttgtggtgacaaagacggtgacaatttccgcccggatattaccctattgattaacggtttgccgttagtgtttttagaagtgaaaaagccgaatgcccaaaatggattacagtcggaatttgagcgtatgcaatatcgctgtaaaaagcctgctttccgtccttacatcaacgccactcagttgatgattttttccaataatcaggaatatcaagctgctgatcgccataaaactcagggagcattttatgcgacgacaggttttcacggcgtgcagttcaattatttccgtgatgaaggcgaaattgccgaagaacaagcggtcaaattaaacgaaaatcttgcaattttaccagagacggaattaaaccgtattttgttagactttaatgagccgatgttgaaaaacgatgcggaatttcgtaccaatcttgatccaaattcaccgactaatcgtctttgtactgcattattgcataaagaacgtttgttatttctgttgaaatacggcattgcctatgtagaagaacaaggtggcatggaaaaacacgtaatgcgttatccacaactgtttgcgactaaggcaatcagccgccatttagcagcaggtaaaaagaaaggcattatttggcatacgcaaggcagtggtaaaacggcgttggcatattacaacgtacgagtgctaaccgatttttatcaacgccaaaatgtgattcctaaattctatttcattgtggacagactcgatttacgcaatcaggcaatgtcggaatttagtcatcgtggattacaagtaaacagtattaaccgccgtgaagagtttgctcaagaaatgcggaaagctgctgcattgagtaattgtagcggtgatcctgaaattacggtgatcaatatccaaaaattccaaaatagtaatgtagcggaatttattcctgattacgacatcagtgtgcagcgtatcttttttattgatgaagcacaccgcagttttggtaatcaagcacaaaccgtgagccaatttttagccagcctaatccaagcagacccaagtgcggtacatattggtttgacaggcacaccattgctcggaggaggtaaaaaccgagttggctcaacggcgatttttggcgattacattcacaaatattactacaatcaatccattgcggacggttacacgctccgcctgattcgtgaagaaatcgaaagcaattacaaagcggaacttagccaaattttggcggatttgcaaattcaacaaggtagtattaaaagccgagccattaccagtcgccgccgttttgttgagccaatgctagattacatcgtgcaggattttgaaaaattcagacgacaaaaagccgacaattcgctcggggcgatggtgatttgcgacagtagcgatcaagcccgaatgatgcattttctattcaaccaaaaatatgcagaaaatccgcaagatttgaccgcttaccgtgaaaaactggctgaaaatgatccgcacttttttgatgaattaccgaaagttgccgagccaactgcaacctataacctagctaaacgtacggtaacatcagcaagtttgattttatcggacgaaggcgataaaacttaccgtaaagaccttgtggacgattacaaagccggcaaaaccgatttgttgtttgtttacaatatgttgctcacaggttttgacgcaaaacgtctgaaaaaactctatttagggcgagtaatcaaagaacataacttattgcaagctctcacaagggtaaatcgtacctacaaagattacgagtttggctatgtggtagattttgccgatattcaggcagaatttgataaaaccaatgccgcctaccaagcggaattacaacttgaattaggcgatgaagcggaacattattcccaacttttcaaatcgcaagcggaaatcgatcaagacatcgctcaaatcaaagaggtactttttgattttgaaactgaaaatgccgaaattttccgccaacagcttgatgaaattgacgacaaacaaaaattactcgaattaaaacgcacgttggaattggcaagaagcctgtataaccagctcaaagtggacgaaaaatcaggcttagaacgccttgattttgagcaatacaacgtgctttaccgccaagtgctagaccgtctgttccaagtaaatactatggaacgagtggattcaggcgatttgcaaggcgtgttaaacgaggcattggaaaatatctacttcacattccacaaaaaaagtgaggcagaattaaaattagccgacagtttgcaagaccaaatgcggaaaactcgtgaagccttcgctcgcaacatagaccaaaaagatcctgaatttgtccgtttactagatgaattgaaacatctgtttgaaaaacgtaacgtgcaatctgtaagccaagcggaaatgcaaatgcacattgatgaattcgccaaactagaacgccaaattggtaaattaaatgccgaaaatgaccgcttgtcgctcaaattttcaggcgatgctaaatttgtccgcattttcaaacgtggcgtacaagattttggcttgcaacaaaaccgtagccattttatggaaggcttacagcagattaaatttagcaacgaccaatttgtgctaaatcagggtgacttactccaaagctcttcgagctattttgaaaaagagagtttacgtacggtgacgaaactcaaaagcgagttccaattgccgctcgataacaaagccttaatgaacttaaataaattgattgtgagtgagtatataggggcatagcccattacaaatataaatatagggacacaacgtgtcactgctgaacaaaaaataaactagagcaataaaaatgaccgaacaactttttcaacaaaaaactaaagaattgatcgacagcttaaaagccatttgtgcgaactatgggctagggaatgatggcaatgaatttaaaatcattacccaagtatttttgtataaatttcttaatgacaaatttgcctttgaaatcaagcagattaaaccgtctttggcggagcatgatagctgggagcaggcgttgggtgaaatatccgctgaagattttgactttttaacaatgaatatgaacggcgacaccgccattttgcgaccaaatcaatttatcagccatttgttcaaccaatcgaatatcgccaattttgctaatctgttcgatgaaaccctaatggacatcgccgctcaaaatgcggatattttctcggtaaaaaccgaaggtggggcgaaaatcaacttgtttgaccgtgtcagccaatatattgctgacccaagcaagcgagacgcattctgccgtgcggttatcaacaaattggtagaatttagtttcgagcatattttcaaccaaaaatttgatttttacgccacgatttttgagtatcttatcaaagattacaacaccaactcgggcgggaaatatgccgaatactacacgccacacgcggtggctcgcattatggcagcaattctcgtgcctgaaaacgagcgcggacagttgcaaaatgtgagctgttacgatccgtccgcaggctctggcacattgttgatgaacatcgcccacgccatcggcgaaaaaaaatgtaccatttacacacaggatatttcgcaaaaatcgtcaaacttattgcgattgaacctgatcttaaacaatcttgttgccagtattcctaacgtggtgcaaggcaacacgatgacgcacccttaccacaaatcgggcgatcaactccgccagtttgattacatcgtgtctaacccaccgttcaaaatggatttcagcgaagtgcgagaggaattagccacgcccgcccacaaggatcgctttttcgccggcgtgccaaacgtaccgaaagccaaaaaagagggaatggcgatttatcaactttttgttcagcacatcattcactcgcttaaagcagacggcaaagcagctgtggtgttgccaacgggctttattaccgctcaatctggcattgataagaaaatccgagaatttctggtaaacgaaaaaatgttagcgggcgtggtgtcgatgccgtctaacattttcgccaccacaggcacgaacgtctctattctctttctcgaccgagccaacaaagagaacgtggtgctgattgatgccagcaacttgggcgaaaaaatcaaagagggcaaaaaccaaaaaaccgtgctttccgccgaagaagagcaacgcattattgacgtattcaaccagaaaaaagcggaagacgatttctcggtggtggtctcttatgtcgacatcgcagccaaaaatcatagcctatccgcaggacagtattttgacgtgaaaatcgaccacatcgacatcaccgctgccgagtttgagcagaaaatggcagattttcagcaaaatctgaccgcactttttgccgaaagcaaggcgttagaaagccaaattcagcaacaaatggcaacgttaaaatttaacgcacaagcggtggaaaattaggggaagtttgcgagatggataagttagtatcttgtcaattaggagatttaattgagtttcaacgggggtatgatttaccacgttcggaatttgtagaaggagaatatcctgttcagtcatcaaatgggatcttaggttaccacaatgagtataaagtggaagcccctggaattactattggacgaagtggaacagttggaattcctcatttgttgagaaagaatttttttccacataatacggcgttattcgttaaagattttaaagggaatgatgttgaatatatctattatcttttacattatttagatttaggaaaccaaaagtctggttcaggtgttcctacaatgaaccgaaaccatttacacccattaaaaataaaggcatatactgatttagaaacccaacaaaaaatctcccaagtgcttaccacattggatcgcaaaattgccctaaatcagcaaattaacgccgaactagaaaaaatggcgaaaacgctctacgactactggtttgtgcaattcgactttcccgatgaaaacggcaacccctacaaatcatcaggcggcgaaatggtttaccaccccgaactaaaacgagaagtgccgaaggggtggggaaggaaaactatcggtgattattgtaaatcaacaggtggatatgcgtttaaatcatcagaatgggtggaaagtggaaatcctgttattaaaattaaaaatatccaagaagatggttcattaaatattagtgatattgattttgtagatttaagtaataaaactattgatgaaaaatttaaagtaaatgttggcgatattgttattgcaatgacaggggcaaccattggtaaatttgcacttattcccaaaacagatagtgatttatacgttaatcaacgagttggagtttttaaattaagtgcagttgaaaaattaccatttttaatcaatactctaagccaagattattttagaaaaagtattattgaattatctggcggtgcagcacaaccgaatatcagtaatgaacaaatcaataatattgagttaatttatccagttgaaaatatcattgcaaactttaatgaaaaattgaccgctagttataagcaaattatccaaaagcgttacgaaacccaaaaacttacccaacttcgagattttcttttgccaatgttaatgaatgggcaggttgaggtggtgtagggtggaaaataggacgcacgcagtgcgtccctaccatgactaccgaatttggtattaaaggagaagcgaattgcacaacaccatgcctaaaatctatatcggtaccggcggttatagcgacacggatttggttgggacgctatatccgcatggtacggcaaaaagtgattttttaacgatttatagttgtcattacgatacagttgaaatcaatagcacttttcatgcgcctattggtgagaaggcattacaaggcatggtggaaaaggcggagaagcggttaaaattttcagtaaaattgcatcaagattttagccataaccgcactgctactgctgagcaggctcgctattttttggctgctttacagccgcttattgagcaaaattgtctcgcaaatttgtttgtgcaatttccgcatacttttgaccgcactccagcaaaccgcctttatcttgctcaactttgtcactggtttgccgatttcccgctagcagtggaatttcgccacgccagttggcatattccacctgtgtttcaaacctttgccaaacagcctaatctgatttggtgtaatgttgattatccacagaatatcggtttgccggcgtttcattttcagagttttcagcggacggcttatttacgtttacacggacataatcccaactggtgggaagcggattccgccgcagaacgacatgattatcgctatcgtgatgatgagttaaaacaactagcagatgtgctttttcaacaacgccatacatttgatacgctttatctttacttccaaaatacgacgaaaagccattctttctataatatcgctacactgaaaggttatttagctgaattaggatttgaggtaaaaaccgaggtgaatgaacgtagtggagagcaagggagtttgttttagtcggtttagaaaagtaagggcgtagtcgctaaaaataagaaacccgcacttcaagatagaaatttgaagtgcgggtaatatggaaggttttacatcattgccgcaatgtattttaacattacgccggccgcgatggctgaaccgattacaccggctacgtttggtcccattgcgtgcattaataagaagttttgtttgtcatattccaaaccgactttatttgatacacgagctgccattggtacggcagagacaccggcagaaccgataagcgggttaattttgtttttgctgaatttattcatcaatttcgccattaatacaccgcttgctgtgccgatacagaacgccacgatacctaataataaaataccgagtgtttgtggttgtaagaatttatccgccactaattttgcaccgaccgataagccaaggaaaatcgttacgatattaatcagcgcattttgtgctgtatcattcaaacgttccaccacgccactgacacgcattaagttaccgaaacagaacataccgagtaatggtgccgcatccggcagtaataacgccacaagtaagagtaagataatcgggaacagaattttttctcgattgcttaccgtgcgtaactgcaccatacggattttgcgttcggcatctgtggttaacgctttcataatcggcggctgaatcaacggcactaacgccatataagagtaagccgctactgcaatcgcaccgagtaattcaggcgcaagtttacttgccagatagattgcagtcgggccgtccgcaccaccgataatcccaattgctgccgcttgcggtagggtaaagtcaataatacctaaccagttcaaacctaaagcgccgagtacggttgcgaaaataccgaattgtgccgctgcacctaataagagtgtacgagggtttgcgagtaacgggccaaaatccgtcattgctcccacgcccataaagatgatgagtggtgcaacaccatacccaatcgccactttataaaataacgctaacacaccggcggtatagcccatatctccggcaatcacttccaactcgttttgtaccgaaggagcaactaatgcaatcgcttctttaatgctgtgtacatccaaactggcactatttactttcgccgcaataatcgctagctgttcggttgtgccgtggtgcaatagattatctaaagcagtcattgccaaaccggcttccggaatgttggataacaaaccgccaaaaccgattggcagtaaaaggagcggttcaaagccacgggcaatcgcaagccagagcaatagcagacttaccgcgatcataatcgcttgccctagctccatatgcataatgcccatgccctgaaacagagcgataatactttccatatcaactccctatcgtttaagcgagattcattaatacttgatcaactgcaacgacatcaccttgttttgccgcaatgccttggactttaccggcttttggtgcgcaaatttgagtttccattttcattgcttcaagaattaataacacatcaccttccgcaacttgttgaccttcggttacttcaactttaagaatgttacctgccatcggtgctttgactggttcagcatttgcactggttgctgcaggagctgcaacttgtggtgcagcggttggggctgttggtgcaatattggtaatatctccgccttcactgactttcaccacaaaggctttgccttcaagttcaaccgtataaactgcggggcctgattgtggctgtgcttttggtgctgctgcctgagcaggtttagctgattctgctgtcggtgccggctcaaaggcagccggattattacggttttctaggaatttccaaccaacttgttggaataacgccacgattagcacgtcatcaattgcattttctgagagggtaatgcctttttctttagcctgtgccgttacttccgctaccaatttatcgatttcaggggcaatatgatttgccggacgatcagtaatcggtgcagcaccttcaagtacacgttcttgtaacgctttattaaccggtgcaggtgtacgaccgtattcaccttttaaaataccggcggtttctttagcgatagttttatagcgttcgcccattaacacgttcattaccgcttgagtaccgacaatttgtgaggttggcgtaacaagcggaatattaccaagatcttcgcgtacacgtgggatctcttgtagtacaagatcaagtttgtcacttgcattttgttgttttaactggctttcaaggttggttagcataccgcccggcacttgtgccactaaaatacggctatctacaccacgtaactgaccttcaaacttcgcatattttttacgaacgtcacggaagtaagctgagattttttcaagttgaggaatgttcaaaccggtgtcgtaaggcgtaccttgaagcgttgccacgatggattcggttgccggatgaccataagtaccggacattgaagaaatagaggtatctacaccatcaacaccagcttcaatcgcttttaataacgccatttccgccataccggtggttgagtgacagtgtaagtgaagttctacgtcataacgttttttgatttcgctgactaattcataagccgccattggggttaaaataccggacatatctttgataacgagagaatctactccgatttctaataattgttcagttacgtctaaccacgtttgtaaggtgtgtaccggactggtggtataacttaacgtaccttgtgcatgcccaccgtgttttttgaccgcttgtaatgccgcttgcatattgcgagggtcatttaacgcatcaaacacacggaacacatccatcccgttggtaacacaacgttccacaaagcgatctaccacatcatccgcataatgacggtagcctaataaattttgtccgcgtaataacatttgcagtggtgtatttggaatcgcttttttcaactcacgcaaacgtacccaaggatcttcacctaaaaaacggatacagctatcaaaagtcgcaccgccccatgcttctaaagaccaatagccgattttatctaattcagccgcaatcggtagcatatcgtctaaacgtagtcgtgtcgcaaacaaagattggtgtgcatcacgtaaaacaacatcagtaattgcaatttttttattttgaatagtcatgataaaaatcctctattattttaatccttgttgacgacgatgatgggcaatagcagccgcaatcacggggcgtaaatggtctaaattatcagttggaacagcgcttggcgttggtttggttagcggagctggaagtggttcaggaaagaatttattgattatcttagagataaaactaattgcataaatgagtacgatcagaaaagtaagcacaaagcccattcctgaaatcattaaatttatgccttcactaaaaagttctgcgtctgtcataaatatatccttatttgtatgatgtcatttaaagataggtaagatcacacttttctgcaaatggtttagcccagaaatgcggagcagttcacaaattttttcttcatttgattaagatgcggttgaaattggagagtgttttgtaagttttactccaaatttaaccgcttattttattttccttatggaaaaaatgggaagaaaataggcagtaaaattaaacttacaatcgtagatacgataatgagtggtaaacctgctttaacatagtccataaatttataaccgccaattgataataccattgtgtttgctggcatgccgattggtgttgcataggcacaggaactaccgataaccgttgccattaatactgctcgtggatcagctcctaaagaactcgcaattgataaacaaatcggtgcgagtagtgctacggtcgcagtatttgacataaaattagtcagtacacagctaatgataaagacggtagtcaataatgcaaatggacttggatttgaacctaataaaccaatgacaaaattagcaatatctttacctgcccctgtactgtttaatgcagtagcaagagctaaagtaccaccaaataagaaaatgacttgactgtcgatagatgcataggcttgtttttcgttcattactcctgtgacaaccagtaataatgcacctacgcaagctgatatataaagctttattcctattacatcttcaagtaccattgctaataaggtaccaactaagatgacaagtgaaagccattgtttccaaatgggtacatccacagcttcttttttattgccgtgtatagaattttcgatacttaaattttctgcattaggtaaaaaacgataacctattagtacgaagtacagaatcccaatgataagaataggtaaaccaaccttggcatactcaaaaaaaccaaatttgagatttgcttgttctaaaacaccttgtgcaattaagttaccgggtgcaccgataagtgataagttaccgcccattgccgcagcaaaaaccaatggcattaacaggcgtgaacgggcaaaacctgatttggtagcaatacctacgacaacaggaattagaatagctgccgtaccagtattggataatataccggacattagccctgtaacgagcattaaaacaatagtgagttggcgttctgttttggcaaattttgaaactaaacctccgattttatttgccatacctgtttcaaacaatgctccaccaatgacaaacattccaacaaataaaatcacattactatctataaaacctagaaaggcttccttcgggctcagcacgccagttaaaattaaaccaatacaaacaatcattgcggtaacagcgagaggtaatttttcccatacaaacatcacgacggcgaaaagtaaaaagagtagcgttatcgtacttgcagccataattgcctccaagagtgaatttctgaattttgggtataagaaaccccatacacacaagtgtatgtatggggggatttttttgataagacgttatttactatttgatgaaatcaacgtgtttgcagatttcttcaatcgctttgtctttgcgttcgttgaagataactttattttcttcaaaaatattgcgaccgtgggtatcaatagacacaattaacggaccgaactctttcactttgcatacccaaagcgtttcaggcataccgaggtctttccattgtgcatcaacaatttcttctacacattcagccgccaatactgcacagccagcagggaatacacaatgtaatgctttataatcgcgacagccttccattgtgccttgtcccataccgcctttaccaacgattaccttcacgccggtttgcttgataaattctttctcgaatttttccattcgcattgaagtagttggaccgaccgaaaccatttcatatttatcatcaccaagcggtcgaataattggacctgcatggaatattgcaccaccgttgatatccactggtaattcacgtccgttattgattaaacgacggtgtgccacatcacgacaagtgacgatataaccgttcaaataaatgatgtcgccaatgttgatgtcttccaagtcttctgctttgattggtgtggtcaagatttttttgtcgctcatagtgtcacccccgaatgtgaagtaatggtgtagttgaggtctttatcgaaaataatatgtcctttgcggtgtgcccaacagcccacatttacacttacaccgataactgacggatggcgagcggtattttcaatgtttacccctaatactgacattctacccattaagccttgtggacctaaaccgatgctattgattccatcctctaatagttgctccatataagctgctttttcatttgagttacgttcacctagagggcggaataatgcttttttagattgtactgctgcagtttcaacggaagttgcaattcctacaccaactaataatggcggacaggcatttaaaccgtaactagtcatcacatccaacacaaatttggttacaccttcgtatccttcacctggcataagtactttggcttgtcccggtaatgagcaaccaccgcctgccatataagtatctaattccagtttgtcactgtccggtataatttcccaaaatacacttggtgtgcctttacctacgttcaaaccggtattatattcatcaaaggtttccacgctgttatggcgtaacggagctgttttagtcgcttgaataaccgattcttttaatagtgcttcaagctcaccaatgtaagggaaattagctccgcatttcacaaaaaattggattacaccagtgtcttggcaacttggacgatttaattttttggctaaacgttggttatcgaacattgcaccgtaaataatttttggtaattgttcttcctctttcttacgtaattcttctaattttgccattacgtcgtcaggtaatactttaccggtaaaaccgacaaatttagcaatggtatcagttagataacgtatgccttcttcttttgtcatcatagatcaccccatttggatttgatttgtttagcctttctgcttcccactaaattaaacaaagctttgatatggcgaataatactgaagaggtataaaataagtccaatacgattttttacatactaggtataggtaaatacctatggaatgataagtggttgaattttatgaattttttgcgaatctttgatagagtttaaccatttgtaagctaaaaagaggaaaaaaatggagtttcggcaatttaaatatgtattaaaagtggcagaagagcgtaatttttccaatgcagcgaaaaaattattcatttctcaaccatcattgagccaatttattcaaaaagtggaagaagaggttggttcacctttgtttgatcgtagtgtttcgccgttaaaattaacttatgtcggggagctttatgtagaaaaagctaaagcaataatagatattcaacaccaatttgagcaaaaagtagatgatattttgaatgtcaaacgtggaagagtgacgatcggtagtacaccattccgtagtgcttacttactttcgagagtattgccgctttttagccaacaatatccaaaaattgatatatttttaaaagaagatagtacccgtaatttagaagaaatggttacacatggatatgttgattgtgctatttcattattacccgtcaacgaaaaatattttgattatgaaatattatttgaagaacgaatgttgttagcaatccctccggaacatagaattgctaaagaactagggttaaaagccggtgatcattcttttagtcaaagagtatgtttagaacaatttaaacagagccgttttattaaaatgaataaaaatcacaaattacatgagatgcttattaagcagtgtgaattagccggttatgtacctgaaattgcattggaaacagaaagtatgactacggctcaagcgttagcaggagcagggttaggtgtagcattattacctgaaacattagtgtcaaaaaatcattttgataaagaaccatgctatggagagctagatatacgtcgaacagttgtaatcatttatcgtaaaaatagttatttatcacgtgcgacacgtgcatttattcagtcactacgtgaattgacccaatgtccgttctcatccgaaaaaatgtagcaaaacgtggtttcccctgtttggtaagcccccgatatttataggtaatcaaactaccaataggcggtggatttgcacgatctttatctttaaaaccggatccgatacggaaacgtccacgctggttttcacaagtgattgcgcccagtttatcgcgatatttccctttaccgttatggtgagcaatgacggtacattcttcatctaatacaggttttaatttgagaatttgtgcagaacgtccttttatataagcagtattcggattacgtaccacaacgccttcgccatgttgggcaagtacttgctgatagaattgcattaaatgggctttattttgaatcggaatctgttcaatgatttgaatataaggggtagggtgttgtaaaagataatttttcaacttggctaatcgctcaaatagattaccttgagcatttggtacatcaaaaatatagaatttcaacttataccagcctttaggctcactggctctggtgatacttgagatttcttcaaattttcctctttcgctaaaaagttctccgtcaatcgcaaaaggtgggaaatctttaataaaatagtccggaggtgcaagcggattaccttggcggctgataagttgcttgccgtcccaatagccccgtacaccatccagtttttcgctcattacccagccatttatatcttgatctcgatattgacctagtaacatcaaatcgggtgtcttggcaaataatgacgtactgaaacataaaagtataaaaaggagagttttcatattcgttacctattaagagaagaggtaaaccaatatatagaggatctaacaagcggtctgattttaagaaaatttttccgatcaggatcgcaaaatttttatcaaaatagaccgcttgtatagtgagaaattgattagcgtaccgtttgaactaatgctgagatgtctgcagagaattgttccgagctagccatttctgcaatttgctcatgtgagtattgcttagcattgtaaaccaccacaatacttgtatcgccaacttgaaggaagttgctttcaccaaattcagtatagcgggtagcaccgatactgatcactgcttttgtcggataattcgcttgtttaagcaattcggcaatatgattcattggcccttgatccggttggttattcatcttatctacaatccagttcagcagtttttgatgaaaataactatagcttacagcagggctatcttcgccatatacattaagtttaccgtcgcgtttatggaaacaagcaatattgtaattatctaaaataccgccttgtgcaaaatgatctaacggaatcaatatttcagagatcccttttgacgcattgccccagtttttcttttcacaaattttacgtgcattcggacggcgaatagaacagtcgttataagcggcaaaatgagtaggcttgagagcgatgacttgattgttttgatattcaatttcgcaaatcaatgcaacttccggttcaatttgcagattgtcagcatcatttggaaaagtaatcgtatcgtgagataggggataagttgcgaggaattgttccgttgggtttaaggtttggcttgggacatagaaaggaaagatagctttcggttgaattgcttcttcagtctttacttgcaagaaatcagccgcttcgcccgcttgttctaaatgaccggcaaaatttcccgctacgcctaaaccaataaaatgttctttttgcatgatatctacctctatataaataagttatacggaatgtagcgattaattttagaaaaagaaagtgaatttttaggaaaaataagaatgcactatttgccgtttaaagatgggttttgttacttttttagcagaaaaataataaaaaatattcgaattgtattaattgtgttctttcaatcacttttttaagatttttttgcaaaaagtacttgcaaggatttcatatttctctataatgcacctcacacaacgacgcactgttgtgaacgatttaaaattgattgccagtgcgtcgtttctttttgttctttaacaatttatcagacaatctgtgtgggcacttgttgattgacttaattgaaaaaatatttttgattttgaagtcttaataggtgcttaaactagaaattcatttttacttttgaagtaatatgtaaactttagctaagcagtttattgagcgattaaactttttgaattgaagagtttgatcatggctcagattgaacgctggcggcaggcttaacacatgcaagtcgaacggtagcacgaaggagcttgctccttgggtgacgagtggcggacgggtgagtaatgcttgggaatctggctcatggagggggataactacgggaaactgtagctaataccgcgtaatatcttcggattaaagtgtgggaccgcaaggccacatgccatgagatgagcccaagtgggattaggtagttggtggggtaaaggcctaccaagccgacgatctctagctggtctgagaggatgaccagccacactggaactgagacacggtccagactcctacgggaggcagcagtggggaatattgcacaatggggggaaccctgatgcagccatgccgcgtgaatgaagaaggccttcgggttgtaaagttctttcggtagcgaggaaggtatcaaatttaatagatttggtaattgacgttaactacagaagaagcaccggctaactccgtgccagcagccgcggtaatacggagggtgcgagcgttaatcggaataactgggcgtaaagggcacgcaggcggttgattaagtgagatgtgaaagccccgggcttaacctgggaattgcatttcatactggtcaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacaggattagataccctggtagtccacgctgtaaacgctgtcgatttggggattggactttaagtctggtgcccgaagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccatggaatcttgtagagatacgagagtgccttcgggaaccatgagacaggtgctgcatggctgtcgtcagctcgtgttgtgaaatgttgggttaagtcccgcaacgagcgcaacccttatcctttgttgccagcggtttggccgggaactcaaaggagactgccagtgataaactggaggaaggtggggatgacgtcaagtcatcatggcccttacgagtagggctacacacgtgctacaatggcgtatacagagggaagcaatatggcgacatggagcaaatctcacaaagtacgtctaagtccggattggagtctgcaactcgactccatgaagtcggaatcgctagtaatcgcaaatcagaatgttgcggtgaatacgttcccgggccttgtacacaccgcccgtcacaccatgggagtgggttgtaccagaagtagatagcttaaccttcgggggggcgtttaccacggtatgattcatgactggggtgaagtcgtaacaaggtaaccgtaggggaacctgcggttggatcacctccttaccaagaattaagcgactgcaagtgttcacacagattgtttgatagaagagaagacgaaaacggacataatccggcatccttttgggtctgtagctcaggtggttagagcgcacccctgataagggtgaggtcggtggttcaagtccactcagacccaccactctaaacgagtgaaaactgaaaggtgagattatgttcagtcatgatgtatggggatatagctcagctgggagagcgcctgccttgcacgcaggaggtcagcggttcgatcccgcttatctccaccaatcatcatgactaagtgaataagtaaaagatttgtttatttagtcatgatgataagtcaaattattgtcttaaattgttctttaaaaaattggaaacaagctgaaaaactgagagattttcgaaagaaagtctgagtagttaaaaaaatcttgactgaacaaaagcagtcaagtgtttagttgaataaaatacagcattgaatggatttgaataagatttgaaaacatttgaggttgtatagttaagtgactaagcgtacacggtggatgccttggcaatcagaggcgaagaaggacgtgctaatctgcgataagcttggatgagttgataagaagcgtttaatccaagatttccgaatggggaaacccactagatgaagaatctagtatttactactgaatacataggtagtaaaggcaaaccgggagaactgaaacatctaagtaccccgaggaaaagaaatcaaccgagattctgtaagtagcggcgagcgaaagcggaagagcctgttagtgatagcagtagacacagaagaacgagctgggaagctcgactataaagggtgatagtcccgtattcgaagtgtctattgtggtactaagctaacgacaagtagggcgggacacgagaaatcctgtttgaagatggggggaccatcctccaaggctaaatactcctgattgaccgatagtgaaccagtactgtgaaggaaaggcgaaaagaaccccagtgaggggagtgaaatagaacctgaaaccgtgtacgtacaagcagtgggagcctctttgtggggtgactgcgtaccttttgtataatgggtcagcgacttatattttgtagcgaggttaactgaataagggagccgaagggaaaccgagtcttaactgggcgttttagttgcaaggtatagacccgaaacccggtgatctagccatgggcaggttgaagattgggtaacactaattggaggaccgaaccgactaatgttgaaaaattagcggatgacttgtggctgggggtgaaaggccaatcaaaccgggagatagctggttctccccgaaatctatttaggtagagccttgagcggacaccttcgggggtagagcactgtttcggctaggggtccatcccggattaccaacccgatgcaaactgcgaataccgaagagtgatactcaggagacacacggtgggtgctaacgtccatcgtggagagggaaacaacccagaccgccagctaaggtcccaaagtactagttaagtgggaaacgaagtgggaaggcttagacagctaggatgttggcttagaagcagccaccatttaaagaaagcgtaatagctcactagtcgagtcggcctgcgcggaagatgtaacggggctaaaactagtcaccgaagctgcggcatcagtcgaaagactgttgggtaggggagcgttctgtaagcggatgaagctgaattgagaagtttggtggacgtatcagaagtgcgaatgctgacataagtaacgacaaaacgagtgaaaaactcgttcgccggaagaccaagggttcctgtccaacgttaatcggggcagggtgagtcggcccctaaggcgaggctgaaaagcgtagtcgatgggaaacgggttaatattcccgtacttggtataactgcgatgtggggacggagaaggttaggttatcagactgttggatgtctgtttaagccggtaggtgggaattttaggcaaatccggaattccgttaacaccgagaagtgatgacgagtctctacggagatgaagtaaccgataccacgcttccaggaaaagccactaagcttcaggttatactaaaccgtactataaaccgacacaggtggtcaggtagagaatactcaggcgcttgagagaactcgggtgaaggaactaggcaaaatagcaccgtaacttcgggagaaggtgcgccggcgtagattgtagagatttactctcgaaggttgaaccggtcgaagataccagctggctgcaactgtttattaaaaacacagcactctgcaaacacgaaagtggacgtatagggtgtgatgcctgcccggtgctggaaggttaattgatggtgttatcgaaagagaagctcctgatcgaagccccagtaaacggcggccgtaactataacggtcctaaggtagcgaaattccttgtcgggtaagttccgacctgcacgaatggcataatgatggccaggctgtctccacccgagactcagtgaaattgaaatcgccgtgaagatgcggtgtacccgcggctagacggaaagaccccgtgaacctttactatagcttgacactgaacattgaattttgatgtgtaggataggtgggagcctttgaagatgacacgccagtgttgttggaggcgtccttgaaataccaccctttaacgtttgatgttctaacgaagattgcggaacgcggtctcggacagtgtctggtgggtagtttgactggggcggtctcctcccaaagagtaacggaggagcacgaaggtttgctaatcacggtcggacatcgtgaggttagtgcaatggtataagcaagcttaactgcgagacagacaagtcaagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgttggagaattgagaggggctgctcctagtacgagaggaccggagtggacgcatcactggtgttccagttgtctcgccagaggcattgctgggtagctacatgcggaagagataagtgctgaaagcatctaagcacgaaacttgcctcaagatgagttctccccgactataagtcggtaagggttgttggagactacgacgtagataggtctggtgtgtaagtggtgtgagccattgagctaacagatactaattgcccgagaggcttaactatacaacgctcaagtgtttttgagcactacactcagtagcagcttgtttcgaatttaagaagaaagaacaaagacaaagaaagaagacaaaagacatcaacagaatattctggcgaccagagtgctgtggctctacctgactccattccgaactcagaagtaaaacgcggtaacgccgatggtagtgtggggcttccccatgtgagagtagggcatcgccagattgaatttaggaccctgtggttagcgataaccacggggtttttgcttttttacaacggacaacgatgttgttttatccagagccttattctcagcctcagcctcaacctcatccttatctttactttcattttctcctttcctttttttcctttttgctgatttaagctgccttactaatgatttgcaaaacggcagggaaatttgaccgcttgtttaaaataagaaaacggctactaaaaatcaagtcaagctagaacgggtaaaatgaaagtgaattgtttgtcttcttttaatgcgaaggaaggtattttctggtttgactacttctcaaaatcactcttttccgttattcttctactattgattatatctataggatttaaacatctctttgcaattaccattacccattcatcaagtagatgatgagactttcgataatttttacgcagaaaacagccttgtgctgttggattctttgcgccaaaattttgtcgatgtgcagcagccgttcttttatatttggggcgggaaaagtagtggtaagagtcatctcctaaaagcggtaagtaatcattatttactgaatcagcaaacgtctagctatattcctttagaaaaatcacaatacttttctccgatggttttggataatgccgaacaattagatgttatctgtttggatgatattcaggtggttgccggtgatgaagcttgggaactcgctattttcaatctttttaatcagattcgggagcaacaaggtttgttcggcagtggtcataagactttgctgctgataagtgctgattgtcctccgcatcaattaaagattaatttaccggatctccgttcccgtcttacgtggggagaagtgtatcagttaaatgatttaagtgatgagcaaaagcgaattattttgcaacgcaatgcatatcaaaaaggaatggagctttccgatgaggttgctaatttcttactaaaacgtttggatagagatttacaaacgctttctaccgaattagatcgccttgatagggcctctttacaggcacagcggaaattaacagtgccttttgtgaaagaaattttagggctttgatgcgatttgattcctatcaatatttgcaagaaaattaccaaatttgaccgcttgttacctctaaagaggtaacggctttgctacgctaaaatgtaggcttatgttaaactttgttaactttactaccaataaatattatgtcttatatgcatcaactttcagtgattaatttagcttgtgaacggggcgagaaccgtctttttgaaggctgtcagttttctgtgaaaagcggagattggctacaaattgaaggacataacggtattggtaaaacaagtttattaagaattcttgctggattatcgacacccgccgaaggcgatgtcctttggaatcatgagcctattcagaaatgccgtgaagaatattacacagaattattttatttggggcatcatgccggagtgaaaccggaactgagtccatgggaaaatctacgttttttccaaaaaatgcaaaagttgccgttaagtgatgatgcactttggaatgctttggataaagtgggattagttgggcgagaagatttaccttgttcacacctctctgcaggccagcaacgtcgtgttgctttagcaaaattgtggctgactaagcagaagctttggatcttagatgaaccttttaccgcaattgataaaaaaggtgtggctgatttgatctctcatatcgaacgccattgtgagaatggcgggatagtaatattcactagccatcagacagcagaaagcagccaagtacagattctttcattagataaatttaagatataactaattaatatgattttatttaatattattcagcgagaactgactattgcttttcgcaagccggcggagattttaaatcccttatggttctttctgattgtgattaccctttttccattattaatgggaccaaatcctgaattattaggcaaaattgcaccgggagtggcatgggttgccgcattattatcggcattattatcgtttgaacgtttatttcgggatgactatgtggacggctctttggaacagctgatgcttttgccggttgggttgccacaagttgcgttagcaaaagtgattgcacactggttattaaccggattgcccctgattttattgtcaccggttgcagcgattctgctatcgttagaaacacaagtttggtgggcactcgttcttactttactactgggaacgccgattcttagctgtttaggggcgataggtgttgcgcttacggtcggtctacgtaaaggtgggacattgctcagtttacttattttgccattatttttaccggtattgatttttgccgccgcagtattagaagctgcaaccttgaatatgggatatagcggtcagcttgcgatcattggtgcgattcttgcgttaacgctaactttctcgccttttgcgattgccggagcgttgagaattagtgttcaatagagcacattcttgaagcctatacaggcaagtaagcggttaaatttttattattttttgcaattttggagatgttatgtggaaatggcttcacccctacgctaaatcggaaacgcaatatcgattgctcgggaaagttcaaccggtattgggttggttaagttttatgatgttggtggctgcgtttgtatgggggcttggcttcgcacctaaggattatcagcaaggtgatagttatcgcattatctttatccatgtgccggcggcaatttggtcaatgggagtatatggttcaatggcggttgccgcattagtggcattagtgtggcagattcgccaagcaagccttgcgatgatttctatggcgccaatcggattagtgtttgcctttatttcgcttgcaactggtgcaatttggggtaaaccgatgtggggaacttggtgggtttgggacgctcgcttgacgtctgctttagttttattcttcttatatattggcgtgatggcgctgtattcggctttccaagataagcaaaccggtgcgaaagcggctggagtgttagcggtcgttggtgtaatcaatcttccgattattcacttttcagtggaatggtggaacaccttacatcaaggcgcaaccattacgaaattagataagccgtctatggctgtagaaatgttgattccgttattattggcaattttcggcagcttaatttttaccgcttggtttagtatttggcgttatcgtatcgcgctcttaaatgatgagcgtaagcgtccttgggtaaaagcacttgtaacagaataagcggttaaattaggagaaaaagatgcaatttcaatttgaatcattaagtgatttcctttcaatgggaaattacggtttctatgtttggctttcttatgcagtttctattattgcgatggggggcttgatttggttctctcgtcgagaagaaaagcaaattatgcaacaagtcaaaaaagagttagcgcgagaggcacaactcaataagaagtagttatagctatggaattaagcggtcatttttatataactttttgcaagttagttagaaaaatgaccgcttacttattttgaggtatagggtttgagaaaaagcaaagattctttctagagattaaagtaatagcggaatcttaaatgattttttgttattctacgcagagttttttatttaaatttttttgtgcaatcggcacattttgaaaggtgattactatgaatccaagacgtaaatcgcgattgaaagtggtggtttcaattttattcggtgtggcggttgccgccggtctgacgctttatgcgctaagtaagaatatcgatttattttatacgccatcggaaattgtaaatggtaagaatgatgatccgaaccaaaaaccggaagtgggtcaacgtattcgtgttggcggaatggttgtggaagatacggtaaaacgtgatgagaaaaccttaaaagttgaatttgatgtgaacgatgttggaccttcgattacgattgaatacgaaggtattttgccggatttattccgtgaagggcaaggcattgtggcgcaaggcgtattaattgagccgactcgtttaagagcaacggaagtattggcgaagcatgatgagaactatatgccaccggagttaggtgacaaattaaaacaaaaacacaataagatgggtgtttcagaatctgatttaaaaggtgaatcagagcgtgatagagcggaaatagaagagaccctgaagactttgcaaggggagtctaaataatgattgcggaattaggcaattatggcttagcacttgcgttaggattgtcaattttattggcaatcttaccgcttatcggtgcacagaaaggtaatatcaccttaatgtcgttagctcgcccgatgacatggggaatgtttcttgcgttaacgatttcattcggctcacttttctatttatttgccgtaaatgattttagtgtgcagtatgtggtgaataactcgaattcaaccttaccgctacaataccgtttatcggcggtctggggctctcatgagggctctctattgctttggatttggctattatcactttgggcggttgctgtagctgcctttagtcgtcagatgccggaagaagccgtggcgcgcgtattgagtatcatgggcttaattagtattggattcttattatttattatttttagttcgaatccgtttgatcgtaccttccctaatttcccggcagacggtcgagaattaaacccgatgttgcaagatgtcggcttaattttccatccgccgttattatatatgggatatgtcgggttctcggtggcattcgcctttgcgattgcttccctaatgaccggcagattggataccgcttgggcacgctggtctcgtccttggaccatggcagcttgggtatttttaacgctaggtatcgtgttaggttcttggtgggcttattatgaattaggctggggcggctggtggttctgggatcctgtcgagaatgcttctttaatgccttggattgccggcacagcgctgattcattccttagcggtcacggaaaaacgcagtacctttaaagcttggacagtgttacttgctatcttagcattttcgctttgcttgctaggtacgttcttggtgcgttcaggcatattggtttcggtgcatgcgtttgcgtcggatccaacacgtggtttatatatcttggcttatttagtgctggttattggcggctcattattactttatgccttccaaggttcgaaaattaaaagtttagataattatgaacgttattcacgtgaatcaatgttgttaattaataatattttattaatggcatttttatccgtggtatttttaggtacgattttaccgctaattcataagcagatcggtttaggctcaatctctattggtgcgccgttctttgatcaaatgtttgttatcttaatggtaccgtttgcctttattttgggtatcggcccattagtgaaatggcgtagagatcaaatttcagcgattcgtacgccggtacttatctcattagtattaatgacggtgcttggttttgcattaccatatttgtttgctgatcgtattaccgcaacctctgtgttaggggtaatgatggcggcaattatcgttattttgagcttatatgaattacatcaacgtgcgacacatcgccataccttctttagcggcatttttaaattatctcgttcgcattgggggatggtgttagcgcatgttggggtagcgatgaccgtatttggtatcgcatttagtcagaattttagtattgagaaagacgttcgtatgaacgtgggcgatcaagtacaaattctggattacaattttgaatttaaaggaatcaagattactgacggagtgaactaccaaggtggcacagcagaaattgcaattactaaaaacggtgaatatgaagcaaccttaaatgcagaaaagcgtttttataacgtgagtaaaatgggtatgaccgaagcggcgattgattggggttttagccgagatctttatgctgctttaggtgaaaagcttgaagacggctcatggggcgttcgtttatattacaaaccgtttattcgttggatttggcttggcgggttatttatggcgttaggcggtttattatgtatgatggataaacgctatcgcgttcgtattcatgcctaaattgggttgagttcttagttacacttagcgaagcggtcgaattttcggatttttttgcaaatctttgaaaatttcgaccgcttattttataactctatgaaaaggttgagaattattcacaaaattgctgaaaatcactctttttgtttgtaatctaggcaaacgtctaattttttctaatttttaagaaaaagggtttgacatatttctaaattctagtaatatgtgcgccacagacacagtgagtggtgagatggccgagcaggctgaaggcgctcccctgctaagggagtatagggttcaaaagctctatcgagggttcgaatccctctctcaccgccatttactttatcacgcacccgtagctcagctggatagagtactcggctacgaaccgagcggtcagaggttcgaatcctctcgggtgcgccattttaatttttactctattcaaattaaaatggtcgctgataaaactaaataactcaccattcaaaatacaacgcacccgtagctcagctggatagagtactcggctacgaaccgagcggtcagaggttcgaatcctctcgggtgcgccatttcaaacattcaaatctttttcgtaattcagcaaattttccaataattttaaaatttatcctttacggattagatgcattttattgatgattttatgcttaaatttgcttatcaagaacattttaaatcttactattacgattctcgtaacttatcgcttcaatttccttctattagtgcagatcaagatgctgatgtttgtatcattggtgccgggtttcttggcttatccacagcacttgagttagcagaaaaaggtaaaaaagttattatcttagagggtgcacgagttggcttcggtgcatccggtcgttccggtggtcaagcgattaacggttttgaagatggcattgatgaatatattgaacaggtcggtttagagaaagcgcacagattatggcaaatgtcattagaagcgatcgatatcattgatgagcgtgtaaaaaaacatcatatccaatgtgattggaaaaagggatatgcgacgttggcgctcaatcatcgccgcatggatgacttgattgctatggaacaagcaagccgagagacctttggctatcagcaaatgcagctttgggataaaacacaacttaagcaacatttaggcagcgatatttatgtcggtgctttatttgatagtaactcaggtcacttgcatccgttaaattattgcttaggtctagcgcaagcctgtgttaacgccggcgtggtcatttatgaacattcgccagcgactgaaattcgaagtgtaagtgagagtaaagcggtcgttttttccgaaaaatttaccatttcgtgtgaatcagtggttttagcaactaatgcctatattgatgcgctttctaaaaagctcacgtttggtattgagaaaaaaattctaccggtcgaaagctttattattgctacagaaccactgtctcaggcaatggcggatagtcttatcaataatggtatgtctgtttgcgataacaatttattgttggattattaccgcttatctgcagataaccgtttgttgtttggatcggattctagtactaatgtggatatggtggcaaaaatgcgctcagaaatgttggcggtatttccacaattagaagatgccaaaattgattatggttggggcgggccgattgatatgacgctgaactcaacccctcattttgggcggattaaaccgaatatctactttgctcaaggtttttcagggcatggtgttgctttaaccggattagccggacgaattattcaagaagcaattttaggcaatgacgaacgattagcgctttttgagagtttgaaagtaccgagtctttatggcggtaaatgggtaaaaagaatggcattgaaggttggtattccttattatcgttttttagataaatataaataatactaataaaatcaaggacgtaagtattcgcttacgtcttttttaatttttacaccgcataaatctggaagcgggttatttcgcaatgtacaaaattcagctagacttgcgaactaaagggaaataatgaggatttcatattgaaaggattactagcacgattatttgttggtatggcattgttgttatgggcatgggatatggtttacccttggcagcagctcatgcaggcagaggagaatcgttatggacagattcaacagcgacaagtattaaaagtaggaatgatcaaccatccactttcttattttgtcggagcggatggtacagccggtattgagtatgaattggcaaaatcgttttctgagtacttaggtgtcggtttagaagttaaatcatttgaacacagtgaacagctttttaaggcattaaaagagaataaaattgatattgctgctgccggtttattgtatcagcctgagttaggcgaacaatttcaaattggtgcaacctattattcggcttcatggcaagtagcatataaaaaaggtaaaacaagaccgtataaattagcagatctgcaagatgagttggtagtgccgtctggttctgcagtgttgcctattttacagaagctaaaggaagagcatcctaagctacgttggcatacgacagatcaattcactcaagaagaattgttattgcaagtggcagaaggaaagatcccttatacggtggctgtttccgtcgatatttctgcggctcaacatattagcccgaatattgcggttgggtttgatttaaccgatgaaatgccggtactttggtatttgccaagcagttcatacagtgaattacaagcggcagtgctggatttcatggataatgcaaatgagacgggcttgatttcacgtattgaggaaaaatattttaatcatttgtctcgctttgattatgtcgatactcaaagttatttaaatgcaattaaatcggtattacctaaatatcaaccgttattcgaaaagtatcgaggtgatttagaatggcaaatgttagcggcaattgcttatcaagaatcgcattgggatccgagtgcaacttcaccgaccggtgtgcgtggcatgatgatgttgacacgggatacagcggatagaatgaaaattaccgatcgaacaaatgcggaacaaagcattcgtgccggttcggaatatttgcatctgttaatgggacaaattccagaaactgtaccgaaggaagatcgtatttggtatgggttagcggcttataatatgggattagggcatttattagatgttagacgtttaaccaaacagctcggtggcgatccggataattggttggacgtgaagaaaaatttaccgcttttagcggagaaacgccactatagccgcttaaaatacgggtatgcaagaggttttgaggcttttcaatacgtagagaatattcgtcgttattatagtagtataataaatcatcaacgtgttgaagagcagaaagtacaggcgttacagctttcgaagcaacaagctcaagaaagtcagttattggaagcttctccaatagccccttttacggataaaatgctaactcaaccggaacaatccaacgaagtcattaaggaatagttttatgagaaaacgtaaactgaaaagtagaaaaaccttagcgcgtaacaataaatctcgtcgaattttgcaaattctaaagagaaaacgtcggattgcagctcgccatagtttagcttttatgatgttgcagaatgaagaatagccagttaggtgaaaacttaagttataaaaaaaccgtcctttaaggacggtttttttacgttctattgtgcatagctaatcactttaataactttgctgacaccacttactgtacgagctgcttctgctgctgcatctgcttgggttggtgaaagttttccgactaagaacacttctccattttcagtaatgactttcacttctgttgattttacttccgaattaatcagtaattttgatttcactgcggtagtaatccagctatcaatagagatctgaccaacaccaatttttgagccggtacgaatttcattatatatttcagtaacaccttctgcgccggcagcaagattcttcgcattttcaaccgcatcaaaccccggagcttgaccgattagcaatactttaccattgtaagcgactacattaatgcgagcttcttgtttcagttgttcatctttattgatattgtaagcaacacgttcttctaagatctcatcatccacttgtgtgccggtagaacgaggatcggttgctactttagttgcaatagctgcggaagtaactacagttgttgcaatacaaccttgtaatgataagaggcttacagcgaataaactcgctacactgattcgtttggctaaagtaagcataacaatatccttctaaatgttaagaaaagagtaactggtcaactaattcacagagtaagtttacacagaattgatggccttcgataattcgtaattcattactggaaggcattgaaatttcaaggtcgtgatcgtcaagcaaaccttgtgtatggtcattacggctactggtaaatgctaaaacttctaaaccttcattttttgcagaatgtagcgcatttaagaccgcttcttcatcgcctagaggcgaaaaactaataaataagtctccctcttttgcaattgcttgtagctgtttacgatagatttgcgtaaggtcgttatcttgtgcaattacccctgccaacacaccgtcaaattgcaataattgagctgcaaagcttgggcgcgcaagatcgtatttatgtaataaatggctgactaaaagctgtgcgttcgcatatgaacgcccgtgtccgcatacaataatcttattacctctcaataaacaggcaacaatgcgatttgcggcttcgctaagcgttttaggcagtaattccgccgctgcaatctggatctggatgctttcggtaaagcgatcttgtattttttctagcatgaaaagaactatcctaaaaaattggggatccaaagaggcggatcatttccttcaaaggcaacaacatcaaagcgacagtttgccgtgtctaagctctgtttacgttgcgtaaacagccacatatttgcggcatctaaccatttttgttgttttcggtaatcaatactttcgactgcagagccgaagcgcttacttttacgttggcgaacttctacaaaaaccaaggtttcaccttgttgcataataagatcaagttcgccgcatttaaaagtctgattagccgcaatgaatttcagcccttgcccttctaaaaaggcacgggctttatcttcaaaacaagcaccttgagaacgcttagttagcgctttgaacagcaccattacgatattgcaaccaagtcatttcacgttcgatattacaattcggacctgcagttaagttgcctgttaaaccggagacactgtaacccggaatttggcggaactcattaaatttattcgcaagtgcccaagcatcggaacccattgcatataagcgcatcattgagaaatcgcttgccgctaggctatctgcttttttgtattcatccgaatctgtgtcagacaataatggaatttcgctgaattttacgccttccatcgaagtacggaactcaatcccgttattcggtgagttactacgtgaagaggtataaatagcaagctgtccggctagcaccgagttatcaacgccttgttttaattcaagtaattgttcagctgtacctagtgcgtataatgccgcgccttgaatactgcctgagttttgaatagccacaacagaatcttgtgggatgttgtaataacgaacatctgcatccgtattggttaattgtctccagcgttgagcaaacgcatcagcagaacgttgtccgaaatcatcttgcggtgctgcaacaatcgcacgagagtaaccgtcacgatataaacgatctgcacctgctcttgcttcagcttccggtgataaaccgtagtaacatacgcccggaatcgctttaacatttggggttgagtttagcgctaacacgttaacacctttaatttcagggctgatgagcatttcatcaacacgagatttaagtaacggcccgataattgtttgtgcgccttgttgttttgcttgcgctaaaatactttcaacagaaccgctatcagtatcataggtttgtactgcaattgagtcgctacctttggcgtcattaaagccttttttgatgatatcgcctaaaattttcgcatcaccacttaatggtaaaagtaacgcaacgccatttaattgagtttgttggaagtttgatacattttgtagttcagccggcataaaagaaaccgcactgtgattaggatacagttgcttccagttattgataccttgtggcatttgtgccggtgttgaaacgttttggttatataccgcaataagcgctagccaacctgcaaattccgtttcgcctgggcctgcgcttgcgactgaaagcacacctttattggcattacgtaataatgcccaaatttggtcattattttcttggcgtaaacgattttcagagaattgtgcgctcatcaaagaacgggcacgtaccgcttcgataacatctttgttattttccgcaatacgcgcttgagtttggtgataacgtaacaattgtgacttgcttaacaatgcgattggcacaagtttaagttgtgctactgcctgagcgttgttggcttgtaaagcggaaagctgcgccgcaactaagttatattcgactttttgaatttcatttttttgaatttcagcaagcgaagcatttaattcatcaaacatattttgtgcttcgaacgctttattttcatcaatcaatttacgaattgcgagtaagcgataagtgattttatcttctttatccgtcgcttgctccgctttattgatataaaactcagaagttgcgtacgcttcattttttaccgtttttgttaacgggttttcaaaaaaacttgtaccggtacaagcagaaagaaaaagtgccattgccgttgggacaaagacagtttttagtttctgttttaaaatagtcgccattgtattgctcctaatagactataataggcagaataatgttgaaatcttacttaccaaacgagtgaaaagcaaatgaaaaacgaacaaaacggcactttgtatattgtcgcaacgccaatcggtaaccttggagatataactcaacgagcattagacacttttgcccaagtcgatttaattgctgcggaagatacccgtcatagcggtttattacttagtcattatggcatcaaaaaaccgttttttgccttacatgatcataatgaacaacaaaaagctgccgtattagtcgaaaaattacaacaagggctgaatattgccctgatttccgatgccggaacgccattaattagtgatccgggtttccacttggtgcgccattgccgccaagccggagtcaaagtcgtgccattacccggagcttgtgcggcgattactgcactttgtgcttccggtattgcctctgaccgcttttgttttgaagggttcttaccggctaagacaaaatcacgctgcgataaattagcggaagtggctgatgaagcacgcacactgattttttatgaatcaactcatcgcattttagatacgcttgaagatatgcagaaaatgttgggcgctgatcgttatgtggtgatggctcgtgaaattaccaaaacgtgggaaaccattcacggcgatacgttggcaaatttaattgcatggttaaatgaagacagcaatcgcattaaaggtgagattgtgttagtggtggaaggaaaaacgcaacaagacgatgaagaattttccacccaagcggttaaattactcggtttactttgccaagaattaccgctgaaaaaagcggcggcaatcgtagcggagactttcggctataaaaagaatgcactttatcaatacggtttggaacatctctccgataactaaaatacaagcggttaaatttcctaaaaatttaaccgcttgtttgttagattctcgccaaatcaaaatttgctaaatcaattttatcctctgtgccgtagaattcggctaacgctttacgtagcgtttcggcacgtttgggtaaataaccacgctccgcataaatttttacttgatcaaaaactgcttgtttaaacgcggaattatcgcccggattaccggaaagattatccgcactggcaaaatagcggaagccggcagcggttgccaacacccattcaatcgcttgcggtttaacttccactgattcaaattcacgctgacgttctgccgagcgtccgtccggttcgtaccaatagccgaaatcttctaatttacggcgttcagttcctgccacaagccaatgggcaatctcatgtaatgcactgctgtaatagccgtgtgcaaataaaatcacgttgtacgggcgatcggatttcacgccgtcttcatctaaaaatgcgggtaagtaaatcgggtagtcttcgcccttttctaagcgagtattgtattcttcggcgaaacattcatcgaaaatacgaataatgtcttcaattttatgattgtcttggttcatagcaaacttattgtgattaataaaaaaatggcacaggcgattgacttgtgccataagattataactgatttagccaatttaaaaattgatttgcttctaagaagccggtaactcttgattgcgtcagttcattaccgttctcatcaaagaataaaatggtcggtaaacctagtacgttgaagtgtttcatcagctcatcgttttgtggcgaattattggtcatatccacttgcagcaccaccatttcagccaatttttgctgtacagcttggtcggtaaaagtgtatttctcaaattccttacacgctacacaccagtcagcgtacagatctaacatcacttttttgccttgtgaagcggtcaattttgcttgtaattctgcaagtgattgcacgcgttcaaaggctaagtggttgcttacttgtgccgaatggctactgttaccttgattccacactaaattcgcccaagggtaagaagcaagcgcaaatgtaaaaaatagtagaattctgaccgcttgtttgatgacaccttgtgccggaatcacgctaatcaaccagccaacaaacaccattgccagcgccgaccacatcaacggctcataatggcttggtaaaatacggctaagtaaaaagaccggtaaagctaacatcacaaacccgaaggcggttttgactttcaataaccaatcgcccgatttcggcaaaatacggttaccgaataaggtaatcagaattaacggaattcccattcctaaagctaataaatagagtgctaatccgcctgtgagtaagtccccactttgggcaacatacagtaatgcaccggataatggcgcggaagtacaaggtgaagcgactaaaccggcaatcatccccatcacaaatacactaccaaatgcaccgccttgctgtttctgactcatcgcattcagtttttgttgccatgaattcggcaaacggatttcaaataagccgaacatcgaagcggctaaaatggtgaatagaatcgcaagcgaaatcagtaccggcggactttgcaacgccacttggaacggtaagccgatcgccgccaccactaaacctaatagcgtataagtaagcgccataccttgtacataagcaaagctgagtaataatgctttaaacgtgttagggcgttgcttattgccaatcacaattgcagataataacggcaacattggcaagacgcacggggtaaaggctaaaccgatacccagtacaaagaaccagaaaatcgataaacgattgttcgctaagttctcggcaagctgatcctgttccgctttcggcgcattagcctgtggctgagaagcggttgaattttcactattttttgcaaaattttgtgcggaatcgaccgcttgttgcccgtctaatgcaatgctgaccgtttcaggcgggtagcaaaaacctttggtacagccttggtaacgaaccgaaagactactgtttgcttgtgccgcagagaatgttaccggcagcgtaagctgatcacggaaaatttcgacatcaccaaaaaattcatcatgataattttccgcagcagggaaagctaacggctggatttcagcattttgtggcgtgacttgtatttcttttttatacagataatagccgtctgcaatttgccaattcagctcaatttgattatcggatttcggtgtcgccgaaaaagcgaaagcctctgcgccgcttaaatattttggctgattattgccaaacaagccggcatgtgcgggaagtgttagcgctaagctaacaaataagagaatgaaacgtttcaacatacgaattaatacaaataataaaggtgcgatattttacctaaaaggtgcgatattgtaatgcaaataggtaaagtcgagaaaagttatgatttcttaccaaaatatagtctttaattaataatggtaaagattgacaaaaaattaccttaaatattgagaaagttgttcgataaagccataataaatttacgcgttttaattcagaggagaaaaaacgatgtatgaaatagtcttttatcgagaccgacgtgggcgagaacccgtcaaggaattcctgcaggaatttattaatgaacaacaagacgaaaatcgagagcgtttgcacaaaattagtcatcatttgacgattttacatttgcacggcactcgagcaggcgaaagttatattaagcatttagaagatcgtatttggcagttacgtccaattagcgattgtttgctcttcgccggtattgtacgaggtcagtttgtattgttgcatcatttcgccaaaagcagtagtcggcttcctaagcgtgagcttgagcgagcaaaaagtcgtttggcagatctacaggagaggataaaagatgagccccattggttctagttggacatcatttgaacgagaagtgtttaatgagttggaaatggaagaaaaccattttcgtgttaaattgattcttgaaattattgagacccgacaggcgttaggtatttcacaacgtaaattagaaaaactaagtggcgtaaaacaatcgatgatagcccgggttgaaaagggaagctccaatccttctcttggtacgttactaaaattactggtgccgctggggaaaacattacaaatcgtgcctttagacgatactcattctaaataaagacaaacaagcggtcgaatttgcataaaattttgcaaattcgaccgcttgttctatttagatatgattatagtgcggttttaagtaagtagagggtatagccgatataacataataggaaaataccgccttctagacgtgtaatcttagcttgttttttcttaaagctgtaagcaaagaagaaaagtaataacgttaaggcaaacatcactaacatatcacgagagaataccgctgattctacctgcatcggttcaattgcgccggcaataccgacaaccgcaagggagttgaacaggtttgaaccaacgatattgcctaccgctaaatccgattcacctttgcgagcggcaatgattgatgatgctaattccggtaatgatgtaccgattgccacaatcgttaagccaatcaccaaatcacttacgccaaagtatttcgctacttcaaccgccccccagacaagtaattgtgaacttgccattaaaaacgctaaaccgatcgcaacccaaaagagtgcttttttaagtggtaattgttccgtttgaagcgattctgtttgtgctaacgcatcatctttattgcgtaagccaacccaaatcgtccagcccatatatagcgtaaaaatcaccaataaaatgaccgcttctagctgagtgacttgcgcatcaaacaacatataagcggagattaccgttactaaaatcaggatcggtaattcacgtttaatcacttccgaagctaccataatgggcttaattaacgcagtaacccctaagataagggcaatattagtaatattagagccgtaagcattaccaagtgcaatgcctgatgcgccttttagcgctgaagatgccgaaacaatcatttccggagcggatgtaccgaaaccgacaatcacaataccgattaacaacggagacatgccaaaatggcgagcagatgaagctgcgccttctacaaatttatctgcactccaaacgagtaaaattaagccaattacaatggcaagagaagcgtataacattaggtttcctacgagtaaaaatgggcgtatagtataggttaatttttaactattgactataaggaaccagcgatgaaagtgattagttcagcaatcaaaaatggggcgtttgaagaccaatacggtaaacgtggtagccaatttagtccaaatggaatgccgagttattccattccgtttgaaattagcgatgcaccgcaaggtacgaaatcttttgctgttgttttggaagataaagatgcgattactgcaagcggttttgtctggattcattggttaattgccgatttagaacgcaccaaaattgccgaaaacgaaagtctaacggcaactgattttgtacaaggtgctaactcgtgggcaagtaaattaggtaatttctcgatcgaagaagcttcaaattatggcggcatggcaccaccgaattgcaaacaccgctatgaacttattgtttatgcgttggataccaagctgaatttaacttccggtttccgttttaacgatctgcattttgcaatgcaagaccatatcttagctacagcaagtgtaatgggaacttatgacgtttaagcgttaagctaattgctggtggtgcattgaacagacagcacgagtgaggacactccgccggcatggtaaaacttttgagaaaaatgaccgcttgttatatttaattttattgcaagcggttattttttataaaatttttacaaaatcataagaaaaacatcttgcataattatgcaataaaaattagtattcattcagttatttgaaatatacaggattttaaacgaatggcaattcgcattcacaacgtcaactttttttacggttcaagccaagcattattcgatattaatttagatatcgaaaaaggcgatacggtagtgctgttaggtccgagcggtgcgggtaaaagtaccctgattcgcacgctaaacttaatggaaattccacaatcaggtacgcttgaaatcgcacaacataaattcaatctttcagcaaaaaccgatgccaaagaaattgcattattacgccgtgaagttggtatggtgtttcagcagtaccatttatggccgcatttaagtgtgatgcaaaacttgattgaagcgccgatgaaggtgttaggcttaactaaagatgaagcggtacagcgtgctaaatcgcatttggagcgtttacgtttaggcgaatttgccgatcgttttccattacagttatccggtggtcagcaacaacgtgtggcaattgcccgtgcattaatgatgcagccacaggtgttattatttgacgagccgactgccgcacttgacccggaaattaccgcacaagtggttgatattattaaagaactgcaaggaaccggtattacccaagttatcgttacccacgaggtcggtgtagctcgtaaagtggctaccaaagtggtgtatatggaaaaaggcaaaattatcgaacaaggcggagcggactgctttgaacatccgaaaactgctcaatttgaaaattatctttctcactcagaataattatatgcaaggacacattatgaaaaaattattattagcatcagccatcgcacttagtgcatttccagtacaagcaaaagatttaacctttgctatggaacctagctatccgccgtttgaattaaccaatgaaaaaggtgaaatcatcggttttgatgtagatattgccaatgcaatctgtaaagaaatccaagcaaattgttcattcaaaagtcaatcatttgacggtttaattcaagcggtaaaacaaaaacgtattgatgcggcgatctctgcgattgatattaccgaagcacgtgcaaaacaagtggctttcactgaagcttattacgatagttcggcaagctttatcgcagtaaaaggtaaagcagatttaaatacggctaaaaacgtgggtgtacaaaacggtacgactttccaacaatatgtcgtagcggaagcaaaacaatatgcaccgaaatcatacgcttcattacaagatgcagtgttagatttaaaaaatggtcgtattgatattatcttcggtgatacagcggtattagctgatatgctatcaaaagaagcggaactttcatttgtaggtgaaaaagtaaccaatcaaaaatatttcggtaacggcttaggtattgcggtcaataaatcaaatagcgagttagttgcggaattaaataaaggtttagcggcaattaaagcaaatggtgaataccaaaaaatctacgataaatggatgactaaataatttttatgttttcagaatatcttccgcttatttatagtgcaaccctaatgaccttagggttagcactcgcctctctggtagtcggcttattactttcaatgctgtttgtggtacttgagaccaataaacagccttgtattagtaaaccgacttctgtttttctagcattattgcgtggtttacctgagattttagtagttttactgattttcttcggttctaccgaattgcttgagaaaattaccggtgaatatattgaatttagcgcatttaattgcggggtattagcgctttcgttaattttttccgcttatgcttcgcaatcgttgcgtggtgcgattcaagccgtaccaaacggacaatgggaaagtggtgcagctcttgggttaagccgtgcgcatacgtttttaaaaattattatgccgcaggtttggcgtcatgctttaccgggtttaagtaaccaatggttagtattgttaaaagatacggctttgatctctttgattggcgtggatgatttaatgcgtcaaaccgatttaattaataccaatgaacatcagcctttcacatggtacggtttagcggcattaatttatttagcgattactttaattagccaagtaattattgccagacttgaaaaacgtttcacacgctttgaaagagggggtaaataatgtttcaagattatttagccgtcatagcgcaaggaattccgaccagtttaagtttaaccgccgtatcgttgctgattgcctttgtgttagcagtggtttttactttcttgctatcaatggaaaacaagctgattaaagcggcggtaaacggttatttgatgctatttaccggtacaccgttgttggtacagttctttttgatttatcacggaccggggcagttccaatggattgtcgatagctttgcatggcaatttttatcggatgcgtggttttgtgcggcgttagcgttggcattaaatagcgcggcatactcaacccaattattccacggggcggtaaaggcaattccgaaagggcaatgggaaacttgtgcagcacttggtttaagccgtttagatactttgaaaatcttaattccatacgcattacgccgtgcgttaccgtcgtatagcaatgagattatcttagtgtttaaaggtacatcgttagcttcgactatcacgctattggatattatgggctatgcccgccagttatacggtacggaatacgatgcgattactatttacggtattgccggagcgatttacttagtaattaccggtattatgacgattctgttacgtagagtagaggcgaaagtgctggcatttgaacgtccggcaacggataaagcgtaaatttttgcgatggtgctcgtctttgacgagtacctttatttttatatacgaacaagcggtctgattttgagagaaatttgcaaatttcccgttaaatcagaccgcttgtttttaggataaaatggataaattacgcaactttcttagctaacatggtcgcgaaacgcattttaatgcggttaccgttcgcatcggttttatgcaattcacccaaatcttcgttgtacttcactaattcccaatcttgataatagttcgctaactctcgctcgccgaaggtaaatgagaacggcatcggacacggatattcttcagtactcatcgcacacacaattaagttataaccgccgactttggtgtttttttgcatattttcaataattgccggaatgcgttcacggtttaagaacatcattacaactgtcgaaacaatcagatcatattcaccgttttgattaccaattgtcgcttggttaatatcataaatacccgtttcgatattgctcagattctctttctcaatcatataatttaagaattcgatactctcagcattatgatctaccgctgtcacatcaaaccctagtaaattcagatagagtgaattgcgtcctcgtccacaacctaaatccaacgctttaccggctttcacataattaaccgcatttaacacttcggagtgtgtagtggtcaggttatattttttcgcatagtaatcttttgcttcacaatagaatgcgagctgacattccaaatcatcagaaagcgcttcaactttatgccaaagttggggttcaacaaacggaggcagattttcaggggtaaaagtcaggctattaacttcttcaccttgttcagtcaattcataaaattttaattcgcctttaagaatggttaattttgcccaagtcccttgtttagtgttatgtttttcttgaaacatttgtggcaggctgtctttggtccaaaccggcatttgtttgtagcaaattaagttttgcatgattgatcctctctaacaaaataagataatgttgaattttactcctctgatttctctaggcaataaaaaaaaccgactaaaatagtcggtcatatcaaaaatacctaagatttattagatcacttttttaaatttcgacgcctttaaattggcgaccgaaatagactaaaccggtatttggggtgacatcaatatgtttcagctccaccataaaaatcgtatgtgtgccaaccgaatgggtgttaacaatatcaccttgtaaagacgagattgaaccgcgtaacaccggttgtctgtcaatcccttcgtcccaaatatcccaagcaaagcgttcttccatactgctatttagcatacacgcaaaatgcttcgccatttcttcttgttcatgacttaatacgttgatgcacactttaccgttttgcttgatgatatcgtgtacggagctgttttgattaatacagaaaagtaatgtcggtggcgtatcggtaaccgagcaaaccgatgatacagtaatgcctattttacctgccgcgccgttggtcgttacaatactgaccgcagcggataaatgcgccatggcattacgaaattgttgtgaaaattcaggtaccttttgaggttttggaatacaagacataaatctccttttaaattactccttccagataacgtgatattctcggttatccgcatcatgagaaatcaagaagcgtgcgaatacatcgtccatttcatctttatcatttactaagccaacccagacttcggcaaatgcgtcagggtcaatcagagtgccgatttcttgatcccaattttccgaggtttcgaccatttcaacggcgccacgctcttcaaattgtaaattgaataataaaatatccgcaggatctaaattctcacccgccatttcaaggaaaatatcataagcgaggtcaatcgcttcatctggagttaatttgttcataatttgtttcttttatgtaaaaaatagcgacctaatttgccaataaaggttaaaaaagtcaaatttatagacattggatcaagcgacttattacttgtccggcggttttttctttaataatttgccaattgtttggtaattcaagcggcggatggttcttttccgtttccacataaatcagcgcattgtcggcaagccattggttttcagccaataatgttagcaccttcggcacaaagccgtgattaaaaggcggatcgacaaataccacttgaaacccctgatcaggatttttttgggctaaatattgcagcgtatcggtattaatcactgtaccattgatggttttaagtgaggttaaattgtttttcagtagatttgccgcatttgcaaatttttcaagaaaaacaaccgcttgtgcttggcgagagagtgcttcgataccaagtgaaccactgcccgcaaaacaatctaaacagcggctgcccgccacatcattcatcaaccaattaaacagagtttctttcacccggtcggtagtcgggcgtaaaccttccgcatttaataccggcagctttcgccctcgccatagcccagcaatgacacgcacttcgccggtcggtttattttgtaaagtggaattacgattttttttcatactaactaaaggaaaagtaaggattatttgataaactacacaagtttagtccattttaaaggaaaagtgagaaaaatatggcagaaaagaaaaaaggtttttggtcttggctaggttttggcaaaaaagatgagccgaaacaagacgatgttccggcggaacaaaatgttgaatctacagcagaaacgctagaacaaaaagtcgagcaagcagaacaaaaagccgagcagctacaagagacagtagaacaaaaattagaagatcttgaagataaaattgaagataagtttgagcaaattacctcgcagccggaaatcaaacaatttgttgattcagttgagcaaaaagcggaacaggttgaggattttgttgagcgcattgaagatgcgattgagcaaaagtttgaacaaatcgaagaattcgttgaacaaaaatcagagcaaattgagcaatttgttgaggataaagtcgaagaagccaaaagctttttgcatgagacagcggaaaagatagagcaatcttttgagcaagaaaaagaacaatccgtttcaattattgatacggctaaggccgaaattccgccaacagatgttacccaaaacattgagcaagaggttgaagaaacctcggtacaagcggtcgaatttggtgaaaatcttgcaaatgaaacgacaactgagccagagccggtaaatcatcatcagcaaatcgaagaacgtgttgaaaaagttgtagaagcggagcttgctggcgaagttaaaacaaaatcggatgcggaagaaaactttgaagagctggaagaattagttgagcttgaggcagaaaaagcagaacacgagcaagcggcacaaaaggcggatgattaccaagaaaaaccaagtgaaggtggctttttcagccgcttgttaaaagggctcgttaaaacgaaacaaagcatcggttccggtttccgtaatttctttagcggcaaaaaaatcgatgacgatttatttgaagaactggaagagcagttattggtcgccgatttgggcatgccgaccacaactaagattattaacagccttacgcaacacgcaactaaacagcagttaaaagatgcggatttactttatcagcaacttaaagttgagttgggcgaagtattaaaaccagttagccaaccgcttgaaatcgatacaagtaagaagccttatgtaattttaatggttggcgtgaacggggtgggtaaaactaccactatcggtaaattagctcgcaaattccaagcggaaggtaaatctgtaatgcttgccgccggtgatactttccgtgccgctgccgtagaacagttacaagtttggggtgaacgtaacaatattccggtggtcgcacaatctaccggttcggactctgcttcggtgatttttgatgcgatgcaatcagcggcgtcaaaagggattgatatcttaatcgcagatactgctggtcgtttgcagaataaaaacaacttaatggatgagctgaaaaaaatcgtacgtgtgatgaaaaaatatgatgaaagcgcaccgcacgaaattatgcttaccttagatgccggtacaggacaaaatgcaattagccaagcgaagttatttaacgaagcggtcggtttaaccggtattaccttaactaaattagacggtacggcaaaaggtggtgtgatctttgcgattgccgaccaatttaacattccgattcgctttatcggggtcggtgaaaaaattgaagatctccgcccatttaatgcggaagaatttatcgaagcattatttgaacacgaagaataacaacaattattacgcgcaggcggagaaagagatttttgcaaaaaataagcaaaattagaccgctctttctggaatgtcgtgatagaaaaaggtaaacacaatgattaaattcacaaatgtaagtaaagcctataaaggtggcaagccggcattacaaggtattaatttccatttgccggttggcggtatggcgtatttaaccggccattccggtgccggtaaaagtaccttgcttaagctgattatgggcattgagcgtgcaaatggtgggcaagtgatgtttaacggacacgatattacacgtcttgaagcacacgaattgccgtttttacgccgccaaatcggtatggttcaccaagattaccgtttacttaccgatcgtaccattctggataatgtcgctttgccgttgattattcaaggtatgaatcagcaaattgttgagcgtgaagcgcgtatcgctttagaacgtgtcggcttggcaaataaagccaattatttaccgctacacctttcaggcggtgaacaacaacgtgtggatattgcccgtgcgattgtacatcgtccgattttattattagctgatgagccgaccggtaacttagacgaaaaattatcgtttgagattttccgcttatttgaagaatttaatcaatccggcacaacagtattggtcgcaactcacgataccaatattatttcaaaacgcccgaaaccatgcttagtattagagcaaggtcatcttagaaattaaggaaacaatatggctcgttcatttaataccagctttggtgcgcaaacacgttataccttacgttctgtatggcaagatctcctaaaacgtaagtttggaacttttttaaccgtattagtgattgcggtatcactcactattccgaccgtaagttatttactttggaaaaatactcatcaggcagcgacagagttttatccggaaccggagctcacgatttatttgcataaaaatcttgctgaacatgatgtgaatgccgtggtagaacgtattcgccactttgatgcggataaaattgaatcgttgaactatatttctcgtcagcaaagtttagatgaatttcgttcatggtctggctttggtgaagctttagatattattgatgataatccgctaccggcggtagttaccctcaaaccgaaaaagcagtttaccgctaatgatgcgatgcttgaattacgtaatggtttacaggcgattaaaggtgtgcaagaggttcgtctagataacggttggttagaaaaattaaccgctttaacttggctgattgctcgaattgcaatggtttgtacggtgttgatgctaattgcggtatttttagtggtgggaaatgcggtgcgtactgatgtcgcaaatagcaaagcttcaattgaagtgcagcaattattaggtgcaacggatcactttattgctcgcccgttcctttataccggtatgatttatggctttttcggcagtttgcttgctattgtgtttagtgcggttttaatcagttactttaccggtgtagtgaaatatgtcactgatatgttcacggttaaatttgagttaaacggcctggattttagtgaaatgttcttcctgattgtggcgtgtatctttatcggttggttatcagcaaaaattgcgactaatcgtcatatacaccgaatcggttctcgctattaagctaatttaaggcaataaaaaacggatattcagtgatgaatatccgtttttttatatggttagaattggtagttcagatttaattttgcgacattttgcttcgccacttttgaaccgtcagtaacaccggctgaaaggctgagtttgagattttgatatcccatttccacacctgccgctaaatgttgacgattgcctgtttctaagctgaattcgtgatccgccactttaatttttgcatcgccgttatgtacccaatactctgcggagattaacggtttaatattaaagtgagtgccaagagcaaacttataacctagctcaagtcctgcaaaatagctgacaaaatcgaccgcttgttcttgcacatttagtccgtccaattggtaattggcgtgtcctaaatgattatagcgaatacctgttttcgcggtggtttcaagctgattccaagttagttcctgtcctaaagttaagccggtttgtataagtttacggctaaagctatcggtttggtttgccgattttagcttatttttaattcgtcccgcacctagatccaatgcagcaaatgtaccgttatttgtttgatatttcacaaatgcggaagcaacttgcaaatgatgtttaccgctgttataagcaaaatcattgctattacgcacatcggttaagatagcgccaacttgcgtattggcatttactaaaccacttacacctaactgagaacggaagctatccgtttcataatgttgcggtgcattacgataagcagagctattcgtaaccgtgttattagaccatacacggaactgattaccatcggttgggaatttttcaatcacttgctgagcaatatccatattcacatccgcaatactatttaattgcgctgctgcgtttgattcgactaaattcgaaattagctgaactttttgctgttgttgtaacaacatttctgctcgacgcagtgcggcaattaatgcttcagtatcgacctcaggtttttcggcagtaaggcttgcgagtgtttgctgtacaaccggttctactacaggttttgcttctgcagtaacgcttgtccctttttgagtagtttccggaacatccgcagtcggcttttctgcttcggtaacacttgctcctttttcagtaattaaaggtacatcagctactggtttttccgcttcagcaacacttgaccctttttcagtaattaaaggtacatcagccgttggtttttccgcttcggtaacacttgaccctttttcagtaattaaaggtacatcagctaccggtttttccgcttcagcaacacttgaccctttttcagtaatcaaagacatatcagccgttggtttttccgcttcggtaacacttgctcctttttcagtaatcaaaggtacatcagccgttggtttttccgcttcggtaacacttgctcctttttcagtaatcaaaggtacatcagccgttggtttttccgcttcaacaacacttgaccctttttcagtaatcaaaggcacatcagccgttggtttttccgcttcggtaacagctgaacctttgggtaattaaaggcacatcagccattggtttttccgcttcggtaacacttgaccctttttcagtaatcaaaggcacatcagccgttggtttttccgcttcggtaacacttgaccctttttcagtaatcaaaggtacatcagctaccggtttttctgcttcagtaacagctgaacctttttgggtaattaaaggtgtatcagctataggtttttcttcgacctgaacactatctcctttttctgttactacagttggcggtgtaactggtagaataggttgagccggcggagtaacggtaactggcggtggagtcaccgtatccaacggggcagttttaaacgagttaccgtcttttacaatatttagatcacttgcttgtgaagccgtcacggttaaaccgtctgcattaccttgtacattaacataggtttcatctggatctaaccagcccctaatatctaggttaatatttccagcggtactggcaagatcaatgctgcccgagtctacattagcaattaaggtaccgccactaccgctaagatgttgtattgaaattgggaagtttgtattttcggtatttagctttgtgccattttcaagtgataaattttcaacttccaaatcacttaccgcaagatctgtaccttgagtaagctttaaattcttcacaccactgattgcggttgaacggtgtgtattaaccccttttaattcgagtgtactattcgtattgttgccaatatatccgcctactttatctgtttcactgattactgtgacctcaccggtcacattatttggtgagtctaagccgaaatatactccttgcaagacttcggaatggctatcaagcgtaattttggtattactttgttttgaactcgaatttagattacctgcaagaatatttttaacaatcgtatttttaagtacgagttctgcttttccagcgtcttttgtcgcacccataccgctacccataacaatatttgggcggcttaatttattcgcattagtacccatttgagtatctacattatcgagttctaatcggttaccgtttacaaatatatattgggtgatttcttgttggtttgccgcatttagatcaagcgttaacccctgagaaggtaagaaactcagtttggtatttcgaataaccgtatctccggtaatatctaatggagaacctcgaacagtgaggatatgattagctccatcgatcgtaacgttaccaatttcccatggtatttcctgtctattttgatttactttgggtaataaagtgaagtcattcgtaaggcgaatggtgaggttagtggctgattttgcttgagctaatgcacgttcaaaatcactttgtgaagagacttccactacactggtttgagcgtaagcaatagggctaatcgttgttgttattatggttgggatgctacataaaatagcaatcgcaacacgatttttagtaaatttcatataaactatatccttaggtgaaaaccaatatagtttatagtatattttgacttttcttggtattttgttgcaagattttacatatctttatcatttgtgaaatgttagttaagtgtaagttctttttgcagattttttgtaaaaaaagaccgcttacctttatttggtaagcggtttagtttgattgatgatgtataagttatctagaaacgtttgctaaactccacaaaagcacggtgtttatcgtagctatagaatacgtgattactttttactttattaaagctatacgtcaggcgaggcgtaatcccccaataatgtacggcacgatgccatagacttaatgatgcaccgtattctttattacgttgtgtaataccaaagattggcattggcgctttgtaatttttttgtgcatagttaacacttaatcgtgttgatagtccgagtggccattcttgtccccaaccaagcacaattccgcgacggacataactatcgtctttatctcgagttgctgttctattatagttgatattgctaaaccaatattgttttgcattcgcaaggtaggttaagccgctagagacgaaatggtaattgccgtttaaatgtttgcgatccatataacgttgttcggcatattcatagctggattcccattgccatttaggtgagatccaataacttgtttctaacgttgcaccacttgctttagaaaagcgttttaaactttcactgctgtttgagccaccggcataaagtgtttgctccataaaaggaaggagtgccatggtaaagcgagcggtttgatagcctaaaccaaggcttcctcttgcacttacttcattatattttttattattccaataatattttccgttactgcttagacgaaattcattatagaaattatttccccaagaccattttttaccggcatagaaattaaagccgatcccttgtgcagattctgatttaggtgcgctccattgtccgtaagttgtgccggatttcggtgcattattaatgttaggatcgtttaaataggtgaagccaccggagaatgtccaacgatctttatttgcaattgcggtaatgtactgatcaatcaaacctttgatttgggaaggtggattttcggatcgtattttttgaaattgatcttcggccgcttccaattcattattctcaaagagtgccattgcaagttgtaaacggactaagcctaaaccagaatgttcggctaatatttcacgatattttgtaattgcactattatagttacctctgtagcgagctaaaatagcttcagaccacttaagcataattggatcttggtattgtgttggcagcttactataaaatggataaagaaagctgactgaatcagagttagattgctgtaatgccaaaataagcgcgtttgaaattaaatctgggcgcttagaaaattcctctttgctcatacttagacgctttttttgctgaatcgcaagttgaggcattgggtgactggcaggtttttggatacgagattcaatcgctacttccgtttggctgcgtaaatcgtttaaatgttcagaaatttgttgctctgtcgtattagcaaatgctgaatatgccgtagatacggcaagtgtaggaatgagtagatttaatttcattttatggtttttagtaaagaatgtaaattttaattatatatgagaattattcttattaaaacgacttttacataaaaaagctatcctatcggatagcttttttaattaaaggatcttaaattcttttaatgcatggagtatgccatcttcctcgatatgtttcgtgatatagtcagcatgctgttttaattcttgttctgcatttcccattgctacgctaaaaccgacagtatcaaacatttcaatatcattaaacccatctccaaatgccatcgtattttcgatatttaaaccaaaatggcggataacatcttcgataccacgggctttagaattttcgatacgtagaatatcaaccgcatttgaattccagcgtacggctttaagttcatctagcagcaggcctgacgcacgaatttcttcatcacgactttccggataaaacgcaagcatctgtaccgcagtgctttttaaatagaatttcgggtcaaccacataatctgctttgattggtgcggtcgccgctcgcacgataggattttcttccgacaccgcaatctcttccggtgtgacaaatgcataagcaatacctaatgcattaagtttttcaatacaacgctcaatttgctcaatagttaaaccatattgactaatcatttgatctttatagaaattatactgaccgttaatcgtaacaaatagctcaaagccatgtttgcccattaatggttttaaggcttgaggaaaaccaccaaaattacgtccagtcgcaatagctgggataatacctttttcttttagtttaggtaggacttgttgagtgattgaatctggaatataagcttttgattttacatagagtgtttcatcaatatcaaaaaagatgactttaattggctgacttggtttggtcattcgttagtttgtccttaataaaaagcgagttattaagtaaagattttactcttttttcgatctatatcgcaaaaaatctccgatttttctgatgaaagtttgatacaaccaaactaaaaaggagtaagtatgaattattggggatttagatgtattcattgccgtaaaccattagcaatagcgcagcatactatttgtagtagctgttatcgaaaaatagaaaaaagctgctattgtggatgctgtggtgcgttattgccagaaaatcagttatattgcggtaattgtttacgtaatgagccaaaatggcatcgtatcgtacagattgcatattataagccaccgctttccgattggattcatcggtttaagtttcaggatcaattttggttggatcaaggtcttgctagattgttgctattagcgataaagcaagcgcaaagaacacatcaattagaattgccggaggtaattttcccggtaccacttttttggcacagagaatggcagaggggttttaatcaagcgcagctgctggcggaacatttatcaaattggctaaatattcctttagataatgttagtttaaaacgagtacgagcgacatattctcaacgacaacttacagcctatgaacggaagcgcaatttaaaaggcgcatttcgttatacgccaaatcgagcatatcaccgtgttgcgattattgatgatgtggtgacaaccggctcaacgttaaatgcaatttgtgccgagttacttaagcagggtgtacagcacattcaagtttggacattggctcgagcttaatttagctttaacaagcggtcatttttacagattttttgcaaaaataaccgcttgtatggatttgtatatgaaggaattaggttaaatttttaaaataatcgatgattaattggcttgccactcgtactttttcagactgaatacgctgcggcgtaactaaatatagtggtgtttttggtaatttccaatctgaacaaagtgagattaattcgccggattcaagctgatctcgaatatatttaatcgggagtttagtaatacctaatccatttaacagtaaaccttttgccgcattaagtgaattgcaagtaatacgataatagggcataaatgttgcggtatctcgtcctcggcttagcagtattggggattttttcttttctttatccggataactaatccagtccaacttctctagttcggataaatttttgggcaatccatggcgcttaatatagtcgtgatgcgccacaattgcccattcaaaattatgtagatgacgagcgacagtgcggtcatctgtgatattgcccgaacgtagcaaaatatcaaatttctgctccgaaatatcaacaggagtatcttcaaaggtaagattcaaacgaatttctggatgattatcgagaatattcttaaacgttctgattaaaaaactatcaattagaccacttacagaagcgatttttaattcaccgacaggttctgagcgaagcgcttcaatgctgcgaaccgcattttctgcgctgtgttgaatatgtgcaatatgctgataaaaaatgttccccgcatcagttaaagatagctttcgtgttgttctatttaacagtttgatttttaactgattttctaactttttaatcgtttgcgttaccgcggagggtgtcatggacaacttctcagcggccgcttgcatcgcaccttgctcaacgactgttacaaagaccagcattgctttgtaatcatacatacaaaatccttttattaagttgtgcttaatagtgtattaagtaaaatggggttgttaaggcattttaaatcattacaattaatttgaaatttttactatttcattatttttagcaatgacatatatgaactagttatgccttagagttatgatgagattctacggctttttagtgtctttgcttagcgaacttttgtataaaaatagaaaattttctatttcaaatgtaaagcgtttgttgaattaatgaaatagggaaaatttctgttatctccattatgaatgagtattatttgtaataaatgaataatacattggagtaataagcatagtgatcaaccgcactaaacaattttgatagtgatttacgaattattattagaagtattttgtgactggttttttttcaaagacggctgaaaaggattttctggccgtcttttttcgctttaagctttagcggaatacactttaaatttattggatttggcaatcactttatgtgaaccgaaagctttatccaataaatccggataaggtaagaaagcattcgctacaatacgcagttctccaccacgatttaaacgatttttcgcttgtgcaattaaatcttctactgctcgataagcggtatcaatcccatcgtgaaacggcgggtttgatacgatcaaatcaaaacgttcctcaatatgcgaaaacacatcgcttgccactacagttccttccaaagcattttctgccaatgtacgacgagatgattcaagtgccattgcatgaatatcggacatagttaatttaatcttttcaaattgctgttttaggcttgccccaatcacaccggctccgcagccaagatccagtatttttccttttaagcggtctgccttattaaaactcgaaagtaataattgcgtgccaccatctaattctgccgaactgaatacagccggtaaagcaaaaatggttagatttggtaactggtaagatttccagaattttttactgttaaattcaggcatactttgcaactcaaaatgatataaaccgcagcgacgagcggaatcaattttggcgatattgccgtaaggctcaagtaatttttctaccgaacgcacaccggcacggttttcaccgataatcaacatttcttgtcctacatcggcttgcgaaagccattgtagtaattgatattgacattcttgcttatttttagtccagtaaaagacggctaattcggctttaatttcgcaatctaaaccgaagctcacatcggcatattggcgtgcataatcgaaataactgctaaaaacggcaacgctttttgcattcgcttttatttgatcggcaaagcgatctcgaacatcaccaaaaagtaaaatggatttattggcaaataacggtaaatgacgagttaatacttcactttcaagagagagcataaatatccttttatttctgaatattacggagcgtaatcataaaaacatttccgcattttaccgacttttggtactattccctacttgtttttgcgaggtatgagatgaatcggcgagatttgctattaaatgagatgaatattcctcaatggatgctaacaaaaccgcaagtattaaagggcgatgcgcaaattcgcttggataaagcggtgaaactggttgtggtatgtgaagagaatcatcaagctagcggtctgttttcggatattttacgcaccttgcagctgcagccaaaccaatatcaatggttggatgcggaacaagcccagcgtttagcttttgaacatcagcctattttttggttaatccaagcagaatcacaagcggttgaaattgcaaaaaaatttgcaaatcagaccgcttggcaacatagctcgtggcaagatttaactaatgtcacaactaaacgccaactttggcgacaaatggcggcattttgtcagcattttggggataatcatgattgaagtagtgaatgaatcggattttgaccgcttgtttgaaattgaacaagccgcacacctcgtaccttggagcaaaggcacgttactcaataatcaaggtgataaatatttaaatctcaagctgaccgaacaaaatcaaatcgtggcttttgctatttgccaaaccgtattggatgaagcaaccttatttaatattgcggttgaccctcgtttccaagcaaaaggttacggcaaacgtttattatccgccttaattgaaagactgcgtgaacaaggtatcttaacgctttggttggaagtacgagaatccaatctcgccgcacaaaaattatatgacgtactcggttttaatgaagtcactattcgtaaaaattattatccgacaccgagtggcgcaagagaaaatgccgttgtgatggcattgtatttataaaataattaggaacattaaacataatgaccacagaaaccccattaatgacctttgaggaattagatttagcccctcaactgttaaaagcattgaataaaaaaggttataaacgcccgaccgccgtacaagcggaaaccattccgcacgcgcttgacggacgtgatttacttggctcagcaccaaccggcaccggtaaaaccgctgcatttctattgccagcgattcaacatttattagattacccacgccgtaaaccgggtgcaccacgtattttaattttaacgccgactcgtgaacttgcgatgcaagtggcggaagaagcacaagcttttgctgaatttaccaaacttagtattgcaacgattaccggcggtgtggcgtatcaaaaccacggcgaagtgtttaacagcaaccaagatatcgtggtcgcgacaccgggacgtttaatgcaatatatcaaagaagaaaattttgactgccgtgcggtagagattttgatctttgatgaagcagaccgtatgttacaaatggggtttgggcaagatgcggaaaaaattgcagcggaaacccgttggcgtaaacatacgtggttattctcagcaacgttggaaggtgagctattagtggattttaccgatcgaattttggataacccgttaaaaattgatgcggaaccaagccgccgtgagcgtaaaaaaatccaacaatggtattaccatgcggataacttagaacacaaaaccaaattgcttgctcgtttaatttctacgatggaaatggagaaagcgattgtttttgtgcgccgtcgtgaagatgtgcgtgagttaagcgatacgttacgtaaacgtggtttacgttcgacttatttagaaggcgatatggcacaaacccaacgtaaccaagcgatcgcccgtttaaaagacggtgtagttaatgtgttggttgcgacggatgttgctgcacgtggtattgatattgatgatgttgattatgtgattaacttcgacttaccgtacagtgcagatacctatttgcaccgtatcggtcgtaccgctcgtgccggtaaaaaaggctcggcaatctcattggtggaagcgcacgattacaaactattaggtaaaatcaagcgttataccgaggaattgttaaaaccgagagtgattgaaggtttagaacctcgtaccaaagcgccgaaagacggtgagttgaacactacgaccaaaaaagaaaaagcacgtattaaaaaacgcaaagaagcgaaaaaagaagcggcaaaagccaaagtaaaagtgcgtcataaagacaccaaaaatattggtaaacgtcgtaaaccggcttcagaagcgacaaaatctgagtaatacaagcggttaaatttttgcaaaattttgcggaaatttgaccgcttttgctttctagtttgtagagaggaagaaatggatctacacaacatccgagaagattatagtaaacaagaattgtcccaagcgcattgccatgcggatccgattcaacaattcgaacaatggctacaagaagcgattagcgccaaagtgaacgagccgacagcaatgaatgtggcgactgtgttagacggaaaaccgaccagtcgtattgtgctattaaaagaagtgaatccaaatggctttgtattttttaccaactatcaaagtcgtaaagggcaagagattgagcaaaatccttatgttgcgttaacttttttctgggcggagttagaacgttcggtacgcattgaaggacggattgagaaaatttcagctgaggaatcggatcgctattttgccagccgtccttataccagccgagttggtgcttgggcgagtaatcagagtcaagtgttagccagtaaaagcgagttggtggcaaaagcggcattgattgcggcaaaacacccgttacacgtacctcgtccaccgcattggggcggttatatcgttttaccggaacgtattgaattttggcagggcagaccaagtcgtttgcacgaccggatttgttatcgcattgttgaaggaaagtggctgaaagaacggttatcgccataagctagatacaaaaaaatggtgggatttcccaccattttttattgatttgcaccattaactgaaaagatttttagtcagcaagttttgtaccgtacaaataagtgtaaccgaacgggctttgtttatagtcctgtacacgtttgctagtcggtgcaaagttaatcgagtgtgcaacgttaatccacggggcttgttctcttaacaatacttgtgcctgttcgtagagtttagtacgttccgctttatccgataaaccgagcgctttgtctaataacgcatctaactcagggctgttaaaacgagcatagttactgttgccaacatttgctgaaccgaataatggcgataagaagttatccggatcaccgttatcgccggaccagccgtaagtaccggcagttaattcacccgcttttgagcgtttaatataatcgccccattcataggtcactaatttggcttttacaccaatttttgcccagtccgcctgaatgatttcagacatacggcgtggattcggatttgaggcacgaaccaccggctgtacccaaagttcggtttcgaaaccgttcggatagcctgcttctgcgagtaattgtttcgctttttcgatattgaattccgattctgctaagctgtcgttgtagccccaaatggttggcggtaatggatttttcgccgcaataccggcaccttgataaaccacatcaataattgcttttttatcgaccgcaagatttaacgcttggcgtactttcacattatcaaacggtgctttttcggtgttaaatgccacataagcgatatttaagcccggttgtgaaagtaattgcactttcggatcggttttcattttttcaatatcggtcgcattcgggaagtcgattaaatcgcactgacctgcttgtaattttgcataacgagcggttgcatccggtacaatttcaaaaattaagcggtcaaaatctgctttgccattccaataatctttgtgtgccacatagcggcttgcctgatctaacacgtagccggtaaaggcgaacgggccggtaccaatcggggtagtgtcgatggtttctggtttacctgcttttaacatcgcatccgcatattctgcagaatagatcgaagtgaaatccatacctaaacttgatacgaaggttgcatcacgtttggttaaggtaaatttaaccgtatgatcatccactttctctaccgattttaataaagtcgggaatttcatcgctttaaagtacggataagtcgcttttgataccgtatggtaaggatgatttgggtctaattgacggttaaatgaaaataccacatcatctgcattaaaatcacggcttggggtaaattctttgtttgagtggaattttacccctttgcgtaagtggaaagtgtaagttaagccgtcttctgatacatcccaagattcggctaatgccggctcaatctcagttgaaccgcgtttaaattcaactaaacggttataaacttgttgagaactcgcattgtacgaaataccgtccattgctagtgccggactgaaatattgcggcgaacggctaacgcagttcacgaaagtcttttcggcagccggttttgctgcggtcttagcatcagtgtttttatcgtcacaagcggttaaggcaagtgctactaatacacctgcacttactttagttaaagtcgctaatttcataagtgcttctccaagtaggattttaaataaatcgcaaaataaaaagttgcgagagattaccctgtctgagcaatggagtaaagaacaaaaggcatttcgttataacaaaaaggtataaaaagcggtctgatttgcccaagattttgcaaaaaaagtgagaaatcagaccgcttattcacggagattcaattccgaccattagtacatgccttcacgctcttcacgggtgctgatgtagatatttttcacttgggtataagcgtctaacatcatttggtgggtttcacgcccgataccggaagatttatagccaccgaacggtgcgcctgccggcagaatattataacaatttacccacacacgaccggtttcgatcgcttgtgcaacacgtaatgcacggttaatgtctttagtccaaacaccgccgcctaagccgtattccgaatcgttcgccatacgaataacatcttcttcggttttaaatttaatcacggttgccaccggtccgaagatttcttcttgagcaattcggctgttattatctttcgattcaattaaagtcggttcaacaaattcaccgctggcaagattatccgctaacacttttctaccgccggtaataatacggcagccttcttcttcaccgattttcacatattttaaaatggtgttaagttgtcccgcattgacctgtgcacccatttgagtgtcatcttcccacggtaaaccgactttgactttcttaaattcttcggctaatgctgccacaaatttgtcataaattccttcttgtacaaagatgcgtgaaccggcacaacagacttgtccttgattgaataaaatccctttttgtgcgccctctaatgctttgtcgaacggcatatcgtcaaagaaaatattagccgatttaccgcctaattctaaggttgccggaatgagtaattctgcggcagaaatcgcaatatgacgtcccacttcagtcgaaccggtaaatgccagtttgttaaagcctttgtgtttaagcatatattcaccggatttcgaacctttaccggtaatcacgtttaatacgcctttcggcagtaaatgattaattttttgtgcaaaggataataggcttaacgaagtagtactggaagggtgaatgaccacggtacagccggcggcaagagccggtgcgattttccatgccgccattaagaatgggaaattccacggaataatttgcccaactacgccgattggctcacgcagtacgagcgaaagttcttcttgattgatttgatttaagctgccttcgccggcacgaatggcactggcaaaatagcggaagtgatcggcagccaacgggatatccgctgctctggtttctcgaattggtttgccgttatctagcgtttcttgcaaagcgaataattcactatgctcatcaatcacatcggcaattttatttaaaatggcagctcgttctgcagtagttgttttacgccaagttttaaacgcttcttgtgctgctgttactgctgcatccacatccgcatcggttgcatcaacaaagtgtgccagtacattaccgtttgccggattgtaagaagcgagtaaatctttaccgcttccctgagtccattcaccattaattaataagccataagttttatcaaaaacatttagatttttcatcgctttgctcctaggtttattacgggaaataaactgttactgagcgaataatatgcgcttagaatttaatctggcaatgtttttgttaaaaaaatgtgaaaagtgtgaggtggttcgcaaaaattgaagaagattaattggaggctaaaaataaggacgccatagcgtccttattgcgagaattaactcttactgttttggtgcaccgattggtaatactgtgcgaccgaagctttcgttgataatttctgccgctgctaagtaaaacgctaataaggctgttaataaaccgaagttaccaccgatgtgagtaagtgagtgatcaccggtgaaatcgccagctgctaataagtagaaggtgatggttaatgctaagaagattgcttgtaatgcacgtgcttttgctaatgtaccgataaacatcattaatgtgaatgtaccccaagccactaagtaccagccgatgaacggtgcagttacgccttcagcgaagaatactttgaataatgcgaatgaccaccagaaagcaccgtagctggtgaatgcagtgaaaccaaaagtgttaccttttgaaaactcaaacatacctgcgatcatttgtgcagtaccaccgaaagcaaaacccatcgcaagcactaagcctacattttcgccaccgaatgtaccgttgttgattaagctaagtaaccaagttgttaatgcaaagccgcataaacctaatgggcccggattcgcagttaaagagttatgatttgacatttaagacctcgagtcattgtttaatgtttaagaaattcgtccttccgattggaaggacgtttgagttgcaagaaataacaagcggttgttatttcttcaaattttgcaaataactatttgcccgtttttagcaaattccagtatttttcgtagatttcaacggctttgcctacgtctgcttgcaagatacctttattaatttcctctttcggcgggaaaattaacggatcattgacaagctctggagagagtagactttttacgccttcattcggcatagaaaagcccattgtttcgattacttctttcgcactttcagggcgtaataagaaatcaataaatttatgtgccgcctctttatttaccgcaccttttggaatgacatagttgtccatccaaatcacggcaccttctttcgggaacacaaattttaaatccggattttcacttttagcacggtgcgcagagccgctccattgcatccctacggaaacctcaccttgtaagtaaggcatttccggtgaatccgagttaaaaactaatacattcggcactaatttttgtaaacgctgataagcactttgaatttcttgttcgttttcgctattcggtgatttaccatcaagtaataaggcaatatgaaacacttcacgcggatcgttcatcatcagcaatttgcctttatactcatcacgccataaatcgccccagctcgaaatcgtactcggatcaaaatcttgtgaattgaccccgataccggttaagccatacacataaggcagagagtatttattttccgggtcgaacggctttgccatcaactccggtgttacgtaatttaagttagttaatttgcttttatctaactcggcaagcattccttctttcgccattttgccaacatagtagctagaaggaaatacgatgtcataaccttttgaatttgaaagttttaacttcgaatacatttcttcattactttcaaatgtcgaataaatgacttcaattcccgtttctttggtaaatttttctaagagtgatgaaggtacgtattccgtccagttataaacgtataatttctcagcagcttgtgcggtaattgcggaaaatgcgaggcttaatacagcaagttttgctaaaaatgcacgaccgaatttaatcaattttttatcctctgaaaaaggccaataaaaaactaggcgtgatacctagtccaaaagcgcagaattatagcgataacagcgctgagtttctataaatagtcgttaaaattgtaaaaatttttgtttatttgaccgcttgtattgactgaatatattaaaatacataaatctgttttaacgctaataatttttaattagaataatcttctttttatttattcggagttattgtgtttttaattgaaaatgcgacttttgctattcctactcgaactttactccattcaatttctttgcaattcgagcaaggtaaagtgtacggtttaatcggacacaatggctcaggcaaatccaccttaattaaattattggcgaaacaaaatacgttatctggcggcagaattctatttaaccagcaagaacttagccgatggtcatcacgagattttgctaaacaagttgcttatcttcctcaacatctcccacaagctaccaatctgactgccagagagcttatcgccatggggcgttatgcgtggaacggtttattcggttctaataaacaaaaagatcatgaagccatcgaacgagccttagccttaaccaacacggaacagtttgccgagcagttggtagatacgctttccggcggtgagcgttctcgcatttggttagcgatgttattagcgcaacaaagcaaattcttgttgttggacgaaccgcttgccgccttggatatcgctcatcaagtagaagtgatggaattggtcaaaaaattggcgcacgagctgaatttgggtgtgattattgtgattcatgatattaatttggcggcacgttattgtgatcagttggtggcgttgcatagcggcaaattattagcgcagggtgatgcgtttgagattgtaaacagcccgaaattaaaacaaatttacggtattgatctgaatgtgatcgaacaccctgaaaccaaacgaccggtgagtttttattgatgaaacaacttatttttttacctcggaacacacagaaaaacacagaaaatatttatcgtattttccgtgagcttccgtgtttctccgtggttaaaacgctacaagcggtcgtttttacacttttttttgcaatgtcttgtggggtgaaggcaaaatcttttgcgaccttggattggacggttgccgaaacattaatcgcgttaggcgagaagccggtggcggtcggtgatgtaaaaagttatcagcagtgggtcagtgaaccggcgttaccgaataacaccttagatctcggcgtgcgaatgcaaccgaatccggaacagattcttgccttaaaacagagcgatcacgatttacattttattaatagcagtttttacgcccaagccaccgcaacactcgagccgttttcctctgtgacattagtcgatttttatacggaaggcgatgcttggcaaaatattgtgaatgctagccgtaaagtcgcgtttattgcggataaacaaacggaatttgagcagctcatggctaattatttgcaaaaaatgggtgaaatccgaccgcttgttcagccttatttggagcgcccgattgccttagtacagtttattgatacgcgccatttacgcatttatgccgcaaatagtccgtttggtgcggtgttgtcacaactcggttttcacaatgcgtggagcggttcgcaaaatgcgtggggctttgagacgattgatgttactcagttagccaaacttgtgccgaatagccgtttagtggtggtaaaaccgtatccggcgaatattggatccgccttgcgttataacaccttgtggcaacatttggctatggcgaaagatccgttaattttaccggcagtatggacattcggtggtattccttccgcccaacgctttgccgaaatgtttgctaacggattattgcacggaggcgaacaatggtaaaagcgagcaaattattgttcagcggattagccgtgctatttgtcgggctattgctaacgacattaacgttacaattaccaaacggaagcgggttggtttcgctctttttgccgagcgaaaatctggaactattgctgattcaaagttatagcttaccgcgtattgtgatggcattactttccggcggtttgctaggtttagcgagcttattattacagcaagtgatggcgaatccgttggcatcggataatacgcttggcattagtagcggtgcgcaattcgccttatttttaacggcgatttttttaccggattggctggaatacggctcaagtgcggtcgcattaatcggtgcggcattcagcctgattttagtgctgagtttggcgatgcgaaaaacaatgtcgcccttattgttgatccttgctggtttagtggtaaatctctattttggttcattttccgcattaatgatgctgttttatccggaagaatctcgaggtttggcacaatggggggctggctctttagtacaagaaagctggcgggattcgttattgctgattgctcaagcgatacctgcgatcttgattattagtttattggttcgtccgctaaccattttggcattaaatgatgcgaatgcgcagagcttaggtgtgccggtagctaaattgcgagtgctcggtgtattgatcgcggcatttttaattgcagttgtggtggcgaaagtcggtatgttgggttttatcggcttggcttcggcaactatcgttcgccaactgcatattcgccgttttagtcatcagctatgtgccgcttttgtgctgggggcgttattgttggcgaatacggatttgctgttacagttatttgccttttttagcgggattcatttaccgaccggtgcggtggtcgcattattaggtacgccgttgttgctttggctaatgtttagtgccttaccgcataccggacgtttacaagaggcgggttcgcaaaaaattcgtcaatttagaccgcttgttcttgctttgatagtgggcggcttagcgttggcaatttgcttagcgttatttgtcggcaaaggtatcaatggctggcaatggacgcaacaaagcgagttgattgcattgcgcctccctcgtttaatggcggcgatagcagtcggaattttattatcggttgccggtgtaattttacagcgtttaacgctcaatccaatggcaagccccgagttattgggcgtttcttccggcacatcaatgggcatcttagccgctttatttctgtttggcgtacaacaaacagaatggttttggttagcagggattctcggtgcttgtgtggcattattggtattaacggcgattaatcagcgtagcggtatgttgccggaaaaagtgttgctgaccggtattagcttatcggcattattcgatacgttgcaacgtttagcgattgccagcggtgatccccgagcgaatcagttgattgcctggacatccggatcaacgcaaaatgttactaatgaaatggctatcggcttgctagcggtcagttttgcactactttttgcaagtttgattttcagccgttggcttgctttactggcgttacaagcaccgatggcacaatcgctaggattaaatctcaaacaggttcgctggagtttaattttatttagtgcgttattaactgcgctagcgaccttggttatcgggccgctaagctttatcggtttactggtgccgcaaatggttcgctttttaggggtaaaaaaagtctcgcaacagattttgatctcagcttgtttgggcggattgataatgtcgcttgccgactggctcggcagacagttattgtttccgtatgaaattccggcaggcttagtcgccacattagttggtggaacttatttcttattaatgctaagaagagtttaaccttcacaatttaaaaaattcttaacaacattttagggtgaataaaatgaaaaaaacgtttttctattcgacagtcgcttcggcagttgccttagccatctcaccggcaatcgcacaagaaactgcggtattggatgaggtgtcggtggttggttctgtttctaaagcaggtaaggtggaatatatgacacctaaatcggtatctgtattaacagaagaacagattaaagagaaaggttataaacaagctgatgaaattggtcgttatgaagcaggtatcttaagccagccgtatggaggagatattgatacccatgattggattcgtattcgtggttttagcccaactcttcgcattgacggtacggcaatgtatagctttggtttctatcattggcaaccgaatatgtatggcttagaaagtattgaagttgtaaaaggtgctgattctcttacttatggttcagcacaaagtggcggattaattaatttagtgagcaagcgtccgacaaaagagccgaaaggtgagttgaagtttacgttgggaaatagaaacgagagaggtttttcagcagattatagtaatgctattagtgaaaatgttcgtttccgtctagtcggtgatttcaaccgaagagatggtgagccgaaaggcagttatatggatgcttattactttgctccaagtctttcgtgggatattagtaaaaataccagtttgactttattagcaagtgttcagcatgataatggtcgtccaagttcaggttttttccctgccggttatgaaagattatcttctttaggattatctaatcgtactaactttgcagaaaatgtaccggaatatttgcgccgtaatcaatattctgtcggttatgaatttactcataaatttagtgatgatttagtttatcagtcaaattatcgctatgcttatagcaataaagaccaatttagtgcttctatcggttgggatggttcatctttaagtacaatgacggcaagaggaaaaacctttacgcattcattagataatcgcttaagtaaaacatgggcgatagatcgtgttgaaaatatattgacggtcggtttcgattacacgattggtaaaaactatgcggcaaacggttatggtagtgaaatattaagcaatttatacggtaattatccaacggcggtgcaaccgtttgatgcagtatcaccttatgtaaataaagaaaaacaattaggcgtatatgtacaaaatcaattccgttttgacaataaattgctagtaaatttaggtgctcgccgtgattttgcaaaaggtgattattatagtacgtacggtggtgaagggtatgatctaaatcataatagctactcagccggtgtaatgtacgttaccgattcaggtttatctccgttttataactattctgaatctttccgcccaatctcaggttctaatgttaatgggcacatagtacgctataagccttatgaaggttcgcaacatgaagtaggttttaaatatttaccgagttttgttgatggaacactctctattgcttattttgatttaaaagagaaaaatggtttggttcagggacaagtgaacggacaagttattcaattgcaaacagagaaagccaaaagtaaaggtgttgaattacaaacagatatgaagctgaatgataatatttcggcattattagcttatacttatactgatgctaaagtaaataatatacgtaaggcgattattcctcgtcatacatattccgctttcatgaattacgcattcacaaataatacattagttggtcttaaagtaggagcgggagttcgatacgtaggtacaagtactaatggtgtaatagaagaaaaaattccggcttatacattagtggacttaatggctaaatatgatttcaacaagcattgggttgcacaagttaatgtttcgaatttgagtaacaaaaaatacataagtgcatgtgatacctattggtgttatatgggagaaggacgcaaagttacagcgaacttaacctacaaattctaatttgcaaaacctatcaaaagagctgataatctcagctcttttttatcataatcataaggaaacaatatgcaatttaaagactatttagccaccttttcagcggttgatcatcttgccggtttaaatgtgcgtaatgcacaaggggaagtgattcatcatattccggctgtggaaggcaaattgggttcacttaaactttacaacgccttagcggaaaaatttgacgggaaattaaccgcttcaacggcacagcaaggcatcgaatggtttgccgaacacgtggaagatgcaaaacaaaatgccggcaaacacccgaatatcgacttattatttaaagtcattagcgaagatttagcattaacgctagagcctgtcgctaagtaagtagtgtgaagtaattcataaacaacaagcggtcgaaatttgcaaaaaatttgcagaatccgaccgcttgcttttagggaaaactgagaactatttggttaataaatctaacgcttcttggtattttgccacggttttttcaatcacgtctgacggaactttcggtgccggagcctgtttattccaaccgctgttttccaaccagtcacgcacaaattgcttgtcgaatgacggcgggtttgtgccttcttggtaagtatctaccgaccagaaacggcttgagtcaggggttagcacttcatccattaaagttagcgtaccgttctcatctagaccgaattcaaatttggtgtcgcaaataataatgccttttgtgagcgcatattccgccgcttcggtataaagtgcaatcgccgcatcacgcacttttgccgctaattccgcaccgatttggcgttcacattcttcgtatgaaatattgatatcgtgatcacccacttccgctttgcttgacggagtgaaaatcggttgtggcaatttgcttgcttccactaaaccttccggtaattttaagccacaaattgtgccggtttggttatagtcttttaaacccgaaccggttaaatagccacgcacaatcgattcgatttttaccggtgttaagcgtttacaaactacggcacggtgctgaattgcttccgcttcttctttgggtaaaacatcaaaaacagaatcaccagtaaaatgatttggcataatgtgggctaactttttgaaccagaaattagagatttgggtgagaatttcgcctttacgaggaatcggatcatctaagattacatcaaatgcggataaacggtcggtggcgaccatcaacatacgtttatcatcaatttcataaagatcacgtacttttcccgaatagattttttttaagctaatttgcatggttaaaaattcctttagaacaaaaaattaagcgaattatacccttttacgcaaacgattgcgaatttattctaaaagaagaaatttttatcaaaaacaacttgcaatctataaattttgagcgtattttaaatagcaactcaacaaatttatacgaaattttatataagagaacccattatgaactttatccgtactcatcatcaccatcattcaacctgatatctttcgggcatttgagtgtggtcggaagatagcaaatcttccgagtacgtataaagcacaatcgcatatcgcagcaaaatacataacctctcggaaggcaactttcgagaggtttttttatatccgaaatttaaacacaaccttaaacacaacataggaaagacaaaatgacaaccacaaaccgtttacgtatcgctctgcagaaaaaagggcgtttaagcaaagattgcaacgaattactcaagcaatgcggggtaaaaattaactggaatgaacagcgtttaatcgcttatgcggaaaatatgccgattgaaattttacgtgtgcgtgatgacgatattcctggcttggtttttgaaggtgtagtggatctcggcattattggggaaaatgtactggaagaagaggaactcggtcgtcttgctcgaggtgagcaggttgaatataaaaaattacgcaccttggattttggcggctgccgtttgtcgctggcgattgatcgtgatcgcagttataacggtgtgcaagactttgttaattcacgtattgccaccagctatccgaacttactcaaacgctatatgaacgaaaagggcgtagcgtttaaaagcaccttacttaacggctctgtcgaagtcgccccttccgccggtttagccgatgcgatttgcgatttggtttcatccggcgcaacgttagaagcgaacggtttaaaagaagtggaagtgatttatcaatccaaagcctgcctgattcaacgtgccgaaccgctttcagccgaaaaacaagcgttagtcgatcgtttactcacccgtattcaaggcgtgcaacaagcggcggaaagtaaatacattatgctgcacgcaccaaaagataaactcaaagaaatcaccgcacttttaccgggtgtggaaaacccaaccattctcccgctcgctaatgattccgcccgtgttgcgatgcacgtcgtcagccaagaaaacttgttttgggaaacgatggaacaactcaaagcaatgggcgcaagctcggtattagtactgccgattgagaagatgttggcgtaatgaccacgcactaacgtacgtggttacgcataatgatgtcgctctgcgacattgtacagaataaggttgcggagcaaccataccataagtaaccccatacgagagtatggggcgtggagagaaaaatatgcaaaccctaatttggaaaaacctaaccgaacaacaacgccaagcgtcacttactcgtcctgcaattagctcctcgctgaatattcaacaagcggttgatgcgattcgtgaaaacgtactggcaaatggcgataaggcattatttgagctttcggaaaaattcgacaatgtgaaattagataatcttgttgtttcaaaagcgcagattcaagcggcaagtgatcgtttatcagatgaactaaaacaggcgatccaaaatgccaaagcaaatatcgaaaaatttcacacagctcaaattccacagccggttgacatcgaaactcaagctggtgtgcgttgccaagtgctaactcgcccgattaatcgtgtcggcttatacattccaggtggttcagcaccactattttccaccgttttaatgttagctattccggcaaaaattgccggttgtaaaaaagtggtgctttgctcaccgccaccgattgccgatgcgattttgtatgcggcgaatttgtgtggcgtggaaaccatttaccaagtgggcggtgcgcaagcgattgtggcaatggcattcggcacggaatccgtggcaaaagtggataaaattttcgggccgggtaatagctttgtaaccgaggcgaaacgccaagtgtcgcaaacagtaaatggtgcagcgattgatatgcaagcaggcccttcggaagtgttagtgttggcggataaaaatgccgatcctgaatttgtggcgagcgacttgctttcccaagcggaacacggtgcagacagccaagtgattttggtcacgaatagtgaaacgttagcaaaacagaccgcacttgcgattgaaaaccaacttgcaaaattgccgagaaaagagaccgcttgcaaagcactagaacacagccgaattttcatcgccgaaagccttgaacaagcggtcgaaatcagcaatgaatacgcccctgaacacttggtggttcaagtggaaaacgcccgctctttactcgatcaactcgacaacgcaggctcgattttcctaggggcatattcccctgaaagtatgggcgattacgccagcggtaccaaccacgtgctaccgacctacggttacacccgcaccacatcaagcctaggtttagcggatttcagcaaacgaatgaccgtgcaagagctcaccccgcaaggtttcaaagatttggcaaaaacggtggaagtaatggcaagtgcggaacagttggaggcgcataaacaggcggtgagtattcggttggcgaagattgcctagccccacgcactgatgtgcgaggttacgcataatgttgtcgctctgcgacaagtaaatcggttgcagagcaaccgtataatgattaaccccatacgtcagtatggggtataaaataggaacaaaatatgcaaatctcacaactctctcgaaaaaatgtacaagccctaactccataccaatcggcacgtcgcttgggtggcaatggcgatgtgtggctgaatgcgaatgaatacccaacttcgccaaactttgatttaattaaccgcacttttaaccgctatccggaagcacaaccagccgatatagtaaatggctacgcccaatatgcaggcgttcgccctgaaaacgtgatcgttacccgtggtggcgatgaaagcattgagctgattattcgagcattctgtgagccgagcgatagcgtgctttattgtccgccgacttacggaatgtatagcgtatcggcggaaacttgcggtgtcgcactcaaaacagtgcctttaactactgattttcagcttaatttgcctgaaatcgaacgcaatcttgacagcgtaaaagtggtgtttgtctgtagcccaaacaacccgactggcacgctcgtcaagcggtcggatttacttaaacttttgcaaatcaccgcagggcgagcaattgtagtggtggacgaagcctacatcgaattttgccccgaagcgacaatggtaagcgagcttgccaacttcccacacttagcgattattcgcacgctctcgaaagcctttgccttagcgggcttgcgttgtggctttacccttgccaacgaagaattaatcggtgtcctgcaaaaagtgatcgccccgtatcctttgccagtgccagtttccgacatagccgcccaagccttgtctgaacaaggtatcgctcaaatgcaatcacaggtgcaaaacgtgctagataaccgagcgtggttgattgccgaactgcaaaaattgccttgcgtagaacagattttcgacaccgaagctaactatgttctcgttaagttccaagacggacaaaaagtgtttaaagcattgtgggaaaaaggcattatcttgcgtgatcagcacaaagcgttgggattgcagaattgtattcggatttcgattgggacgaggggggagttggagagaacggtggaagcaattagaaatgcctagcacgagccgtgctaggttccacaatcccagccacgctgtggctgttaattagataatatagagccacagcgtggctcagattaagcagccccatacggctcgtatggagaataaaaggagaaatatgagctataccaaacttttttatcatatcgtttttcgcacgctacaaagcgttcctgcaattaacgaagaaaatgagaaagagttgtaccaatatatttgggcattttgtcagcaacaaaaatgcactttgcatcgcataaacggaatgcctgatcatttacatttattggtagaaattcacccaagtatggcggtggcagattttgtaaaacagcttaaaaatgcgagccataaatggcttgaacatcatagtgatctttttcctgatttttacgcttggtcgaaaggttattgtgcgttgagttatagcgaacacgaaattgggaaaattatcaattacatcaaagggcagaaagaacatcataaaacgtggagttttgttgatgagatgaaagcgttgcttggaaatgtaaatgaatatctcgaacaagatttataacctagcacgagccgtgctaggttccataaacccagccacgctgtggctgataattagataatatagagccgcagggcggctcggattaagtagccccgtacggctcgtatgggggatcacaggagcaaacatgacacaaccaaccctattcatcgaccgagacggcactctgattgacgagccgaaaactgatttccaaattgatagcttggagaaacttaaatttgaacgcaatgtgattcctgcgttactgaaattaaaagatcactaccgttttgtgatggtcagcaatcaagacggtttgggaacggagtcgtttccacaggaaaatttcgataaaccgcataatgcgatgttagagattttccgctcgcaaggcattgaatttgatgcgattttgatttgtccgcacaagccagaagataactgcgattgccgtaaaccgaagatcaaattgctgaaaaaatatatcgacaaaaaactgttcgatcctgaccgcagttttgtgatcggcgaccgtgccaccgatgtgcaactggcggaaaatcttggtattcaggcgttgcaatatcacccagaaaaattggattgggatctgattgtggaaaaattattgccaaaaacgaccgcttgtgaacgtccgccacgctatgcggaagtggttcgcaccaccaaagaaaccgacatcaaagtgcaagtgtggctggacgaaacaggcgtaaaccaaatcagcacaggcgtgggctttttcgaccatatgctagaccaaatcgccacgcacggcggtttccgaatgaacgtgcaatgtaaaggcgacttgtggattgacgaacatcacaccgttgaagacaccgcacttgcactcggcacggcattaaaacaggcgttaggcgacaaatgtggtattcaacgtttcggctttgtgctaccaatggacgaatgtaaagcggaatgcacaatggatttatcgggtcggccatatttcaaatttaaggcgaaatttaagcgtgaaaaagtgggcgatttcagcaccgaaatgaccgagcatttcttccaatcgctcgcctacaccctaatggcaacgctccacctgaaaacccaaggcgacaacgaccaccacaaaatcgaaagcctgttcaaggtgttcggcagaaccttaagacagtgcatcaaagtggaagggaatgaattgccgagttcaaagggtgtgttgtgattttacgtgggaatgccctacactggcgtgtagggttacgcatagtgcggttgctctgcaaccaatctagcttgtcgcagagcgacaatacaatgcgtaacctagcacaagagtgctaggcaaaagtgtagttgggttttgcaaagttttttggtaatttggctgcttgtactattgagatggattaatgaaatgcttaacaaagaaacacttaataatttactacgatcaattgatgtatacattcaaaataatcctaatgaagacatacaactggaaaaatgtaatttctgcaaagatgttataagtatgttttatgaaaattatgaagagtggaaattaaattgcccttttagcatgcagaatattggagaatacctaaatgaaaaatatataacaattcgtggtatcgatgataagttttatctaacttgtgcaaggttttttagagaatatttattgtcagaacaaagaaaaggacattatatacctattttgaatgatgattggaataaatttaaaagaaaatcccctgatttaattgataaaaatcataattcttggttagagtatttgctaaataatcaatttgatattgatgtgttaaatcattatttaggtgataaatcctttcaagcttttctaaattatgaaaacaatctaaaaaatgcagaggaaaagtcagagaatctcaaagttaatattgcagataaagcaagtaaattagaaaatttcattaaagaaaaagagaaaagggttaatgagttagcagaattattaaaagaacaaaaaacagcatttaattttgttggcttatctaaaggttttgaaaaattactttctcaaaaactatggagtaaatggacttcgtttgggattatgtctgtattttgtgttcttttgattgcattaccaatagttattattggtggaagattttttaattggtttgcagaatataatattgaatggagcaagattggttgggaacaaatgttaccaatgttaggtttagaatttatttttatttattttttcagagttgccttaacacattataattcaatccaaacccaaataatgcaacttgaattacgacaatctctttgccaatttattcaaagttatgctgattatgcaaaagagataaaagaaaaagatggtgtttcactagaaaaatttgagaatttaatttttagtagcattctttcaacaccagataaagtaccaagtacatttgatggtttagaacaattatctaatttgataaaagaatttaaaaaataaaatagcaggaaactaaatgccaaacctaatcatcatcaacacaggctgtgcaaacctgtcatcggtaaaatttgcattcgaccgtctggggattcaggcggagattagttgcgatttagacaaaatcaaatcggcagataaattgctgttgcctggggtggggacggctgtagcggcgatgaagattttgcaagatcgtgatttgattgacacgatccgcaacgccactcaaccaatgctcggtatttgtttgggaatgcagctaatgactgaattttctgccgaaggtgaggtgggaacgcttgggctaatgagcggcaaaaccgagctaatcccaaatacaggtttgccgttgccacatatgggctggaacaaggtgcaatatcaagccgaccacccattatttcacggtattgagcaaaacagtcatttctattttgtgcatagctatgcggtattgccgaatgaaaacactatcgccaccgctgattatggcgtgcctttctcggctgcgattgcgagcaaaaacttctatggcgtgcagttccacccagagcgttctggcaaaaatggagcgatgttgttgaagaattttgtggagcttatttagtgcctcatactgccgtatgaggttacgcatagtgcggttgctccgcaaccaattttgtttgtcgcagagcgacaacattatgcgtaacctagcacgagagtgctaggtaaacgtgcggtagatatttgcgaagtttttggagaatttgaccgcctgtaatggaacataaatatggagaaaatagaaaaattaccaaactggattttaaaaatactgccacttttgactggaaatatgtcactttcagaatttcaagagtggctttatcagcctgatacagagaaattttttcctaataatatatatattgaattgatttcatttgattataaaactaagttggtttttatagatgaattcatttctcaatttatttcctttgaaatgaaattagaattaagaagagtttgtatatttttatctgaaccaacgattctttaccttgaagaaaaagatcttggtatattacccgtatcaaaagggttattaaaattcatatattctgaattaaatcgaatatcatatgatataaagtattgggaatgggaagagaataattataagtacgggcaagaattaagaaaactttttaagctgtatgcaactatgatagtttcattattgagtgaatatggaagaaacactgatagttatattattaaaactctagctacaatttactcctatcaaaaataagcaggataaaaagtgaatttaataactatcaacataagcggtgtaaactggctagtttaacccccatacgagccgtatggggctacataatccgagccacgctgtggctctttgatacagccgcagagcggctgagtttattcagcctagcacggctcgtgctaggtacaggaacacaatatgcaaaaaaaatcaatcatcatccccgcccttgacctaatcgacggcaatgtcgttcgcctacatcaaggggactatgcgaaacaaaccacttattccgataatccgcttgagcaattcgcaaactatctcgcacaaggggcagagcagctgcatttggttgatctgacgggggcgaaagatcctgcgaaaagacagaccgcacttattggaaagattattgcggcgacaaattgccaaatccaagtgggcggtggtattcgcaccgagcaggacgtggcggatttattggcagtgggggcaaatcgtgtagtgattggctcaacggcagtcaaagatcgagctatggtcaagggctggtttgaaaaatacggtgcggagaaatttgtactggcgttagacgtgaacattgacgcaagcggtcaaaaaatcattgccattagcggttggcaagaggcgagtggtgtatcactcgaagaactgatcgaagattatcaagcggtcggattacagcatgttttatgcaccgatatttcccgagatggcacgttagcaggctctaatgtggatctttaccgtgaaatctgtgccaaatatcctgaaatccatttccaatcatcaggcggaattggctcgcttgacgatattaaggcgttaaaaggcacaggtgtgtcgggcgtgatcgtagggcgtgcgttgttagaaggcaaatttaatgtcgcggaggcaatcgaatgttggcaaaacggataatcccttgtttggacgtgcgtgatggtcaggtggtcaaaggcgtgcagttccgtaatcacgaaattattggcgatatcgtaccgcttgcgaaacgctatgcggaagaaggggcggacgagttagtgttttacgacattaccgcctcatcggacggtcgcacggtggataaaagctgggtggagcgtgtggcacaagtgatcgatattccgttttgcgtagcaggtggaattaagacgattgaagacgcagaaaaattgttcgctttcggagcggataaaatctcgatcaattcccccgcacttgccgatccgaatttgattaccgcattggcagatcgctttggcgtgcaagctgtggtagtcggtattgatagttggtttgaaaaagaaaccggcaaatattgggttaatcagtacaccggcgatgaaaaacgcactcgccaaaccaactggcaactgctcgactgggtgcaagaagtgcaaaaacgtggggcgggtgaaatcgtactaaatatgatgaaccaagacggcgttcgcaacggctacgatttaacccaactcaaattagtacgtgaagtatgcaacgtgccgttaatcgcctctggcggcgcaggcgaaatggtgcatttccgagatgcttttacccaagccaacgtggacggagcattggcagcaagcgtgttccacaagcggattattgagattggggagttgaaagcgtatcttaacgcggaaggtgttgagatacgtcgttaatacctagcacgagccgtgctaagttcaagaatcctagccgctctgcggctgtatatctgaaagaaaaagagccacagcgtggctcagattatgtaaccctatacggctcgtatagggtaaggaataatatgcaaaacaaaatcaactggcaaaaagtagatcaattactccccgtcattatccaacacttccaaaccagtgaagtgctgatgttgggctatatgaaccaagaggcgttagctaaaaccttagcagagaaagtggtaaccttctattctcgcaccaaacgacgcttgtggacgaaaggcgaaacatcggggcattttctcaatgtggtggatatgagtttggattgcgataacgatacgttattgattttagtgaatccaatcgggccgacttgccatacgggcgagaggagctgtttccaccaatttgaaagccagtctgaaggcgattggacgtggtttgcgaaattggaacaggtgcttgccgagcgtaaatatgccgatccagaaagctcttatactgcaaaactgtatgccaaaggtgtgaagaaaatcgctcaaaaagttggcgaagaaggtgttgaaaccgcattggcagcggtgtcgcaagataaagaagaagtggtaagcgaagcggcggacttagcctatcacttgactgtattattacattcgatgaatcttgaatggggcgatgtgattgctaaattaaaagagcgtcatcaaggtatagggcttcaccctgaaggttcaaataaataacataagcggttgagttttgtaaaaaatttgcaaaatttgaccgcttgcgtataatgcgcccctcaaaattggttgccgagttcccttacctcggctttttatttttaaaaaggaataatatgaactttcaaattgatttttcagacgcacaaaagcgtcgttctcttgttttactttcccttttccatatctttattatcgcgatcagtaactatttggtgcagattacttttgaggtaaaaattccgtttaccgacattgtgattccaaccacatggggcacatttactttcccgtttgtgtttttggcgacggatttaaccgtacgagtatttggtgcaagtcttgcccgtaaaattatttttgtcggtatgttgccggcgttactgattagttatgtgatttcggtgctgttttttgagactcaattccaaggctttaatgcgttaaacgaatttaatctgtttgtgttccgtattgcgttggcaagtttttgtgcttatgtagtcgggcagctattggatattgtggtgtttaatcgcttacgtcagggcaaaacgtggtggttagctccgatgtgttcgactatcttcggtacattgattgatactttcgctttctttgcagtagcgttttataaaagcgatgatgcttatatggcggaacattggttcaccatcggtacggtggactatgcgtttaaactgtttgttagcttattactgtttttaccgctctatggcgtgttactcaattatttagtcaaaaaatttaaactgaaatagtcgtttggggattatgctgaaaaaaggtataatccccttacttttttctgcgtatttgcaagaaaattgagaaatttaaccgcttgaattaagaagagagaacagcatgagcaagattccattaagaaccgaagaagagattgagaaattacgtgtcgcttgtaaattagcctctgacgtattggtaatgattgagccgtatgtaaaagaaggtgtaagtaccgcagaattagaccgtatttgccacgaatatatcgtaaacgaacagcaggcgattccggcgtgtttaaattatcacggctttccgaatgccacttgtatttcattgaacgaagtggtgtgtcacggtattccgagtgcggatcgtaaattgaaaaaaggcgatattttaaatattgatgtaacggtaattaaagacggttactacggcgataactcgaaaatgtatgtggtcggagagccgagtattcgtgataaacgtttaattgaagtgacattagaatcgctttatatcggtttacgcacagtaaaaccaggtattcgtttaaaagaaatcggtaaaaccattcagcaatatgtggaaaaacaaggtttctctgtggtgcgtgaatactgcggtcacggtatcggtaccgaattccattgtgatccgcaagtacttcactacaattctgatgatggtggtgtagtgctgcaagaaggtatggtgtttactattgagccgatggtgaatgcgggtaaaaaagaaatccgtaatatgccggacggctggacggtaaaaaccaaagaccgtagccattcagcgcagtttgagcaccaaattgtggtgaccaaagaaggctgtgaagtgatgacgattcgtgatgaagaaattgccgagggtcgtatttctcgtatcatgaaaaacgtgtaatcgtgataaataaaaaatccgccgtaggttttcacttacggcggatttttttatttagcaatggcgaattagagtttttcaaggtttgccattttggcaatcaaccatttaatgccatttccggcaaaggcgatttgtaaacgggttgcttcgccgctgccttccacattaacaattgtgccttgtccgaatttagcgtgctgcaccttttgccccattttccaactattgtcttctaaacaagaagcggtcgtttttgctgaattttttgcaaaaggtgtgctttgggcaaaacttgccgcacggttgatagagcctctcaaacgcacttctcgaatatgctgttcgggcaattcggcaataaaacgagaagcgatatgacgctcttctttgccgtataaacgtctgagttcggcataactgatcgttaattttttcttcgctcgagtaatgccgacataagccaaacggcgttcttcttgcagtctgccttcgtcaaagctcattccgctcgggaaaataccttcttccacaccgaccataaatacacgagggaactctaaacctttcgcggaatgtaacgtcattaattcgacataatcctgatgcggggaggcttgcgcttcaccagcttctaatgaggcgtgagttaaaaatgcggtgagatccgacatttcttccgcttcgtcaggcttgctgaattgtttggtagcggtgaccagctcttctaagttctcaatacgaacttcgcctttttctcctttttcttgtttatacatttcgtataaaccggattttttaatcacaaaatcggtttgttcaaacagtggcatttgttcggtttcttgttcgagcgcattaatcaattcgacaaaacgcagcaaggcggaagcggctctgccggacagttgttcttcttgcacagctacttgaatcgcctgccataaggttatttggcgattacgggtaatttgacgaatcgtatctaacgtgcgttcgccaatccctcttggcggtgtgttaatcacacgttcaaatgctgcatcgtcttggcgattagcaatcaagcgtaaatatgccagtgcatctttgatttcttggcgttcgaagaaacgcataccgccgtaaatacggtaaggaatattcgcttgaattaatgcttcttcaatcactcgggattggctgttactacgatataacaccgcacattcatttaggctgccttcgtcttctttccattgtttgatttgtgaggcaacaaaacgagcttcgtctaattcattgaaagcacaataaatttcaaccggatcgccatcaccctgatcggtccataaattcttacctaagcggtcttcgttattggaaattaactcattggcggtcgccaaaatatgtccggttgaacggtaattttgctcaagacgaatagtttccgctttttggtagtcatttaagaaacgctgaatattttcaacctgcgcaccacgccagccgtaaatcgattggtcgtcatcgccgacaatcatcacgttaccggtttcaccggcaagcagacggattaagtcatattgaatattgttggtatcttggaactcatcgatcaaaatctgctgaaaacgttgctgatagcgctgcaagatcggcggtttgtctcggaaaagttcataagctcgaatcaataattcggcaaaatctaacagaccagcacgatcgcaggcatcttgatagatttggtagatttggactaatttcttctcgttcggatcgttatgatgatcaatatctttcggacgtttacctttatctttttgcgcactgatataccacgccacgtgtttcggtgggaaatgtttttcatcaatattgtgcaactttaacaaacgtttaagtaaacgttgctgatcctcactatccataatttggaaatcttgtggcagattagcgtcaagataatgtgaacgtaacaagcggttagcaatgctgtggaacgtaccgacccacataccgaacaggcggtgatgactgctggaagaaagagtatgttcgatacgatgacgcatttccgccgccgctttattggtaaaggttactgccagaatattcgattccggtacgttttctacaccgattaaccacgcaatacgatgggtaagcacccgtgttttaccggatccggctcccgctaatactaaataattgcccaacggtgcagcgacagcctctcgctgcttatcatttaaaccgtctaataataaagaaaaatccattaccgcctcgtatttaattaatgtttgtttatacagttaatcctattatagatcaaagcggttaaatttagcgaaagttttgcaaagagtttggaactttttttgatttagacttactatagagtgtcatttatattgacgaatttttaactccctttcttgttttataaggacatatacaatgatcaagaacgtagcaaaaatttcggctgtaacggcagctacactacttttagcgggctgctttagtgcaagcagtttaaacagagatgcacaggctccggtagctccacaagttgctccagtagttgaagaaacggttacaccggcaaaagaatacacattaagcggtgattttttatttgattttgacaagtcgaatctaactgcgaagggtaaagcgacattgaataatattgcacaagaaattaaagcatcaggtgcaaaaaaagtaatcattaccggttatacagaccgtttaggttctcctgcatacaaccaaaaactttcacaagaacgtgcaaattcagcaaaagcatatcttgtaaatcaaggtgtaaaagctcagatgaaagctgttggccgtggggaagctaaccaagtaaaattgtgtaaaaatgaatcagctgataagctaaaatcgtgcttgaagcctaatcgccgagtacacattaaagcagaataatatctgttttatcttgtcaattttaaattcaataacgtattaatttttattgggttttttcttctttttacccgccttccaataaggcgggtatatcatactgattgtaaatttatatacaatctttctcctttcgtataaaagcgtaagttcactagtgaacaatgttcattttctttattatatacaagtgattggaccaagcttttgttggtcttttttatttttagttacagagttagttaatgatttttactctgtaccccatatttctatgtagtaagggataatttacctcatgaataaaatttttaaagtcatctggaatcatgcgactcaatcttttgtagttgtatctgagttaacgaaagcaaaaggaatgtctgcttctgttaccgatgaaagaggctcacctacagcttcaattttaaatttaggtacagtggcttttggggctgtagtattaggcgggactttagttgcccatgatgcacatgctgtttattctgctggggagggacaagctactggtcaaaatgcgattgctattggtattggtagtacttattattctagttatatagctgaggcttctggtgcgtcatctattgcaattggtgagggagcgaaagctcaacatattaattcaacttccattggtcaaggctcaaaagcagtagcttgtggttcaatggcattgggtctaagttccttagctaatggtagtgattctattgctataggttcatatgctaatgctgttctagatcaagctgttgctattggtagtggaaccttagctgcgtgtcagtcaacagcagtaggtaataatgtgaaggctgttggctcatcttctgttgctattggtggtgacgatttagatgaaacctctaaacttaatttagatggttcgtttagtagtactatcaatggcgggagtgttaatgctgagtttaagaaaatctctggtcgtgatcttgttgatttaagtcaaccatatgtaaatacttggggagatactcgatacagaactcagtatgtagcaactaactcatcaggttctgcatcggttgctatcggtgtacaagcggtttcttccggacacttaagtaccgcaattggtacgggagcaagaacagctggtctagcagcaaccgcattaggggttacggcaaaagcttccggagacggttcatttgccgggggtccaaatgctgaagcgttaggtgttcagtcaatagcatttggtgcggactcaaccgcagatggtgaagatgcaaccgcagttggtggtaaagcaagagctaccggagactatgcgaatgcattaggtactacggcaaatgcgagtgcaaacttttccactgctgttggttataattcggttgctacaggtaaatcttctaacgcattaggtacggaatctcttgctgtgcaggcttattcaaatgcgattggttatgatgctcaagcaagaggattatcatcgaccgctgtaggtaaagatgcgattgcttatggtgccggtgatttggcgattggtaaaggggcgcatgcaagtagcacaaatttaatgaatgctgcagaaaataacttacctaagatttcagatgtacaaaatgagacttttggccctgcgacgtctattggtgcttttgcgaatgcgacaggtagaaatacgattgcattcggtaataatgcctttgtatttaatacaaataaggatctactaggcgctattgctattggtggtaatacggtcgcatctgaaaattacgctatttccttgggctataaatcatcggtggataaggctgatgctattgctattgggcgtaatgcctctgcaacaatagaagacgctatcgctttgggagctgaggcgacaacttctgctgctgtgccaaccaattcagcaaatgtgaatggattaacttattctggctttgaaggaagtcagccgacttcagtagtatcggtaggatctgttacccaaaaacgccagatccagaatgtcgctgccggccaaatttctgcaacttcaacagatgctatcaatggttctcaattatatgcgacgcaacaagttttaagtaatacagctaatacggttaaaacaattttaggcggtaattcacaactagctaataccggacgtattacaatgtcagatattggtaatactgggaaaacaaccgttcatgatgcaattgcagcagtaaaagaaaatgtagcagcaggtaaaaatacacaagtaacacaagtttccgcaccaaatggttcaacaacttataccgtagatgcttggaatacaactgtaactaatggttctaaagaagtcagtgttacatcaaaaacagataatactaataaggttttagcttatacggtagacctttctacgtccgcaaaaaataatattacgaccgcaaatgcaactgctaatacagctaatgcgacagcgaatactgcaaatacaactgctaacacagctaatgcaacagctaatacagcgaatacaacggctaatacagctaatgcaacagctaatacagcgaatacaacggctaatacagctaatacaacagcgaatacagcgaatacaacggctaacacagctaatgcaacagcgaatactgccaatacaactgctaacaaagctaatacaaccgctaatactgcattggaagaagtgaaaaaaggctggaatattacaacgaaggcgaatggcggtagtgtaacaggtaactctacagaacaagtgagcatgggcgagttagtcacatttgaagcgggaagtaatattaatttaacgcaaaaaggtgcaaatattacgattgcaaccagcgacaagccaacctttaacacagtaaccacgcagaattttaatgtacaaaatggtggaacggttgatatgggaggcaatgttgtctctaacgtgggtacagctcagaagggtacggatgcggttaactacgatctactaaataaaacagttaaagcggcaagtagttcagttgttgcgggaactaatgcaaatgttcagagtaaagcaagtgcagatggtacggtttatacagtaaatgcatacaacacaacagtaagtaatgcgacagatacagtaacagtgacgcctactttcaatgcgcaaaccaatacgactaactatgcaattgatttatctgcacaaacaaagcagaacattacaactgcaaataccacagcacacaatgccaatgcgacagcgaatgcggcgaatgcgacggtaaataaaggctggaacattacgacagcgaagagcggcacaggtaatgtagtaaataatactgatgcaaatgtcaaaatgggcgataaggtcattattaccgcaggtgataatgtcaatatctctcaaaatggcaaaaatattacgattgcaactagcaataagccaacgtttagcaatgtcacgacgaaggacttaaatgttcaagcgggcggtacggttaatatgggtggcaatgcaattacgaatgttgcaaacggcacgaaaccgacagatgccgttaacttacaacagttaaatgcttcaaaagtcgcggtgttagcagggttaaatactggcgtaacaagcaaaccgaatgcgacaaccggtggtacagattatgtcgtgaatagttggaatactacggcacaagcggcggcaaatggtaatgttacggtaacaagtaaagttgatagtgcgaaaaatacaattgattacacaattgatttaacaaaagaaactaaagatacaattaccaatgcaaacgtaacggcacataatgcaaataccacggcaaatttagcgaatacaaccgcaaatacggctaatgcaacagtaaataaaggctggaatttaaccgctaataacgatacgaataaagccaatattcaaatgggcgatacggtggatttctcacaaggagataacatcgttgtgactcgagagggtaaaagtatcaagattgcaacgtcgttaacaccgacctttaccgatatgacaacgaccaatctttcagtgaagaatggtggaaatgtcgatatgggtggaaataaggtacagaatgttgcaaatggtacgaatgcaaatgatgcagtaaatttacaacaattaaatgcaagccgtacttttgttgaggctggaacacatgccaatgttacttcggcagttggaacagatggttcaacgacttataccgtaaatgcgtggaataccacagctaaaggttcaagtgatattaaagtcactaatgtaacggacgctacgggtagaacgatcgattacacgatcgatttatcagacagtgcgaagaacaatatcaccactgcaaataatacggcgaatgcagcgaatgcgacggtaaataaaggctggaacattaccacagcgaaaacagggacaggtaatgctgagaatatcagtgatacgaatgttcaaatgggtggtaaggttattattactgcaggcgataacgtaaatgtttcacaaaacggcagcaatattaccattgcaacaagcaaaactccgacgtttaccagtgtgacggcaggtaatacgcaaattacaaatgaaggcttaactattcagaatggcccaagcattaccaataatggtgtaaatgcaggtaataaagcgattacaaatgttgcaaatggtacaaatgcgaatgatgcggttaatttacaacaattaaatgcttcaaaagtagcggtgttagcgggtttaaatacggcagttactgcgaccgcaaacatgacaacaggcggaacggattataaagttgatgcttggaatactacagcacaaggtgcaacggatattagcgtaacagaaacggtagatgtgaatacgaaagcaattaagtattcaatcgatctttcacagtcagcgaaaagtaatatcactactgcaaataccacagcacacaatgctaatgcgacagcaaatacggcaaatgcaacagtaaataaaggctggaatttgaccgctaataaagctgatgccaataaagcaaatatccaaatgggtgatacggtagatttctcgcaaggagataatattgttattactcaagacggtaaaggtattaagattgctacttcgttaacaccgacatttacagatgttactgtaggtgatgatactaaactgaccaatgatggtttaactattaaaaatggtccaagtattacgaataaaggtattgatgcggcgagtaaacctattactaatgttgcaaaaggtgtaaacggtacggatgcggtaaatctggatcaattaaacgaagttaaagcagcgacaacgactacagtaacttcaaaagacaactcgatctcagtaactgagtcgttaactaacggtcgagaatatgatctctcaattgctaaatcagatttagtgactaacctagatggcacaactgcgaataaaaatgcaggtaatacttttgtaacgggtgataaccttgtaaatgtattgaacaatacaagcttcaacgtaacctcaggtagcgtggatagcggtaaggtaacggggactaaggccgagcaagtaaaagctggcgagactgtaacatttaaagcagggaataaccttgttttagcgcaagacggtcaaaactttacttactcattatcgaatactttagatttaacagataaaggttcgatcaagttaggtaatacgactctcgcagataacaatgtgagcgtaggtaatgtatctgttacggataaaggcattaatgcagcgaatacaacaatcagcaatgtaaaagacggcaaagttgaggcaggcagtaaagaagcggtaaatggcggtcagttatttaacgcaacgactaacttaaccaatgcgggcttaaactttgtgggtaacaacgtaagcggtgtaattcacaaaaacttaagtgatacattagcgattgttggtgagttagataataccgccgcagcaagtgcgaagaatgttcgcgttgatacagaaaacggcaaattagtaattaagctaagtgaaaacccaacgtttactacggtaaccacaggtaacacaatcttagatgacaaaggcttaactattaaaaatggtccaagtattaccaataacggcattgatgcaggcaacaagcagattactaatgttgctaaagctgtaaacggtaccgatgcggttaacttagatcagttaaatacaacggtaaaagcggcaagcagttcagttattgctgggagtaatgctaatgtgacaagtaaaacggatgcgaacggcacggtatatacagtcaatgcatttaatactacggcgagtgcgggttcagatgcagtaactgtgaatggtacttttgatccggctacgaatagcacaaattatgctgtagatttatctgagaaaatgaagaaaacgatcgcagatacttcaacaacagtgaataaaggttggaacattaccacctctaaatctgctggcgaagcgaaggatatcagtgtatcaaacgtgaaaatgggggatacggtaactattgatgcaggtaaaaacatcaatatcacgcagaatggtgcaacaatttcaattgcaactagcgataaaccgacatttacgacggcaactgttggtaatacaagcttaaacggcgatgatattaagttaggtaatacgacaattaatggtaatggcttaaccattaataacggcccaagtattactaacgaaggtattgatgcggcaaataaaccgattacgaacgtagcaaacggtgtaaacggtacagatgcggtaaatcttaaccagttaaatgaaacgaaagccgcgctcataacaacagtgacatcggatgataagtcaattacggttaaagagaatttaacgaacggtcgtatttacgatatctctgtagcacaagcggaagtggtaactaacccgaatggcacgactgcaaataataaagcaggcaatacgtttgtaacgggtgataaccttgtaaacgtgctgaacaatacaagctttaatgtgacctcaggtagcgtagatagcggtaaggtaagtggtacaacggctgaacaagttaaagcaggtgaaacggtgacgtttaaagccggcaataatcttgttttagcacaagacggtcaaaactttacttactcgttatcgaatactttagacttaacggataaaggttcgattaagttaggcaataccacaatcacagataataacgtaactgtaggtggcgtatctgttacagataaaggcattaacgctgcgaataatacgattagcaacgtaaaagatggcgaagtatcggcaaccagcaaagatgcagtaaatggtagtcagttgtatacgacaaaccaaaacgtaacgaatgtgacgaatactgtaaataaaggctggaatattacgacttcagcatccaacggttcggcagaaggtaccagcttaacgaatgtgaagatgggcgatacggtaacgattgatgcaggtaaaaacatcaatatcacacaaacggcaggtaagatctcgattgcaaccagcgataacccaaccttcagtaatgtgacggtgggtgatacgaagatcaataatgatggtgtaaccattaataatggccctagtgtgacgaaaaatggtattgatgcagcgaatactactatcagcaatgtaaaagacggcaaagttgaggcaggtagcaaagaagcggtaaatggcggccagttatttaacgcaacgactaacttaactaatgcgggtttaaactttgtgggtaacaacgcaagcggtgtaattcacaaaaacttaactgatacattatcgattgtgggcgagttagcaacagatgcagcagcaagtgcgaagaacgttcgtgtcgatacagagaacgacaaattagtgattaagattagtgaaaacccaacatttaccacggtaaccacgggcaacacaactttaaatgacaaaggcttaaccattaaagacggcccaagtattaccaataacggcattgacgcaggtaataaacaaattacgaacgttgcagaaggtaaaaaaggaacggatgcggttaacttagatcagctaaatagaacgacagcggctgcgaaaaccgaattagcgaacagcaataccacaacggttacacgtgagaaaggtgccgatggtcaagatatttacaaggtggaagtaaataaaggtgacgtcacagtaaataacgatggcacagtgtcaacaccggattcaagtgattcatttgctacggtaacggatgtggtaaatgccctcaacaacgtatcttggacaatccaaggcaacggtgttgacgaagataaagtgacagcgggtaaccaagttaactttgtgaatggtgcaggtacaaccgcagaggtaagttctgatggtacgaaaacggatgttacattcaacgtaaacaaatcaggcttaactgtgaataacggtaaagtaacggcaaatcagtcaggtgatgcatttgcgaccgcagaagatgtagcaaaagcaattacagactctgagctaacttcaacagtagtatcaggtaatagcaaccttgttgtcaccaatacgacaaccggcaataacaccgagtttaaagttacattatcaaacaatctcaccctaacggataaaggtagcgtgaagattggtaacacaacgctaaacaacgatggtttaactgtaggtaatacttcagtgacagcggatggcgtgaaagtgggtaatgtaaccattaacaatgacggaattgatgccggcggtaataagattaccaatgttgcaaacggtacgaatgcaaccgatgcagtaaacgtatcacaattagatgcgaaaacagcagcggcgaaaaccgagttagcaaacggtaataccacgaccgttacaccaaaaacaggtgataatggccaaaccatttacacggttgaggtaaacaaagcgccagtgactatcaatagtacaacgggtgtagcggaaacttcagcagcaggagataaagcgaataatagctttgcaactgtaggtgatgtggtaaatgctctcaacaacgtatcttggacaatccaaggcaacggtgctgataaagataaagtgacagcgggtaaccaagttaactttgtgaatggtaatggcacaactgcacaagtgactgcaaatggtgctggcacacaaactaacgtgacatttaacgtaaataccacaacggctacgattactgacggtaaagcaaaagtagcaaatggtgatgcgtacttaaatgcaacaacagtggctgatcttgtgaataacacgagttggtcgattgatgcaggtactgtagccggttcaaacggtagaagtgattatgttgcgaatagcaatagttcaatttctgccggtgagcaagttaattaccaagccggtcaaaatattgtcattggcggtgaaggtaagaatgtggttattgctacgaatccgaatgcaagttttgattcagtagcggtgaaaaatcaagtgactgtcggtgatactacgatcaataacgaaggcgtgagcattaatcgtggtccaagtatgacgaaatcaggtatcgatgccgcaggtacgaagattgctaatttacaagacggtttagtttctgccgatagtacggaagctgtaaacggtagccagttatatacaactaaccaaaatgttacgaatttaacgaatgaagtagcgaaaggttggaatattgaagcattaacggttgaaggttctacaggttcggtgactacgacgggtaaatcgaatgttgcgatgggtaatactgttgcggtaagagcaggtaacaatattaatcttgcgaagaaaggtaatgaaattgcaattgcgacttcagataagccaacctttaatacggtatcaaccaataacgttgttctgaaagatgacaatggtaaggacgtggcaaatatcaatgctgtaactggtgaagatggtgtaagtgaagtatctattgcaggtaataacgttactcaggcggacggctcagtaagtaatgctagtcgtattaccaatgttgcggcaggtaagaaagataacgatgctgtaaacgtagcgcaattaaaaggtgcggtgaacaacatcaacaatagtatcaatgcagtgaataacaaagttgataaggttgatcgaaacttacgtgcaggtattgcaggtgcaatggcagcgggtaacttataccatgtaactatccctggtaagtctatggtagctgccggtgtgggtacttacaaaggtcaaagtgcggtagcggtaggttattcacgtttatcggataacggtaagattggtgtgaaattctctgtaaacactaatacacgtggtgactccggtgcagcggcaagtgtaggttatcagtggtaatcactaacttgtagcaagcaataataaaaacctcagttcgaaagaactgaggtttttttatgaggaaaatgtgcaaaaaatcagtgaaatttgaccgcttgtcaggtcatcggaaaacaaaaaagcacgagctaaactcgtgctttgtcatatcaaagttaatgaccgcttaatacttttgccggttctaattttgccgctcgggttgccggatagaggctggcgaatagacttaacacaatggttgcaattagcacataagcgacatcttgccagtgtagttcgcttggtaggaaatctacgaagtaaacgccgtctgatagcagcttgatactgaaaaatccttcgattgctttaattattgcggttaaatttagcgatagtatcacaccgagtataatcccagctaacgcccctttcataccggacaataaaccgtaccatagaaaaatacgtttgataaaactattattggcaccaagtgtgcgcataatcgcaatatcgccttgcttatcttttactgccataatcagcgtagaaataatattaaaacacgccacgccgatcactaataccattgcgatatacatcacggtacgaaccaactgaatatcgttatacatatagccgaatttttcaatccaagtgttgagatacagcggttgattaaagttagcaagttccggcatttgcagttcttgtactttaaacggctcttttaatgccaactcaatgcccgaatattcattcggttgatattccaataactcttgggctttttcaattggtaataacgcatagctatggtcgagttgcccctccagtttcagtacgccagttaccggtaagctgaaacgtaacggttgagccaatttgccgtcctcggtcggttgcggtaataacagcgtgacttcatcacctgcggcgacttccaaatctttagcaataccggcaccaagaatcaagccaccttgttgatggaacgcttgccattgctcacgcggaatataatggctaagcgaactgactttatcttgcttaaccggatcaacgcctcgaacttgggcgattttcaattgcgtaccgttttcgatcaagccggtaaagctaacgaaaggcgaaaccgcagtcacatttgggttactttttgcgagattttccagttttttacccgcttgtatcggggcgttttcattaccatgataggaatacagttcagcgtgcggaacaacggaaagcacacgctgatttagttctcgctcgaagccattcatcgcacttaagccgataattaatactgccacaccaagtgcaatgccgacactggaaaacagcgagattaaggagaccaaccgatttttttgtttgcctcgctgataacgccagctaataaaaaagggggtattcattaatctgcctcgcttaatacaccatctcgcatcacaaagcggcgagctaatttatttgctagatttaagtcgtgagtgaccaacaaaaaggcgatattttgttcggcattcagttgtttgatcagctcaaaaatactttcggtggttttttggtcgaggttaccggtcggttcatcggctaacacgagcgccggattattgactaacgcacgggcaatcgccacacgttggcgttcgccaccggaaagcgctgaaggacgatggctaattcggtgcgataatccgaccgcttgtagcattttttcggcacgattgcgtgcttcgcttttattttgattaccgattagcattggcatcatcacgttttcaagcgcagtaaaatccgccattaagtgatggaattggtaaacgaaaccgagatgttggttacgcagttgtgccagtttattggcagttaatttttgtagcgattgttgtttgatccaaacttcgcccgaactcggttgatccaaaccgccaagcgtatgtaatagggtgcttttgcctgaaccggatgagccgacaatcgcgactaattcaccgctattcatcgaaaatgaaacgtctttgaggacttgcaccttttggttgccctcatcataaaatttgctgatattttcacagcgtagtaattcgatcatattgtttttatcttcatttaagtggaaatatttagaaccacggaacacactcaatacacagaaattttttccgtactatcctagtattccgtagttaatagtatttatatcccaattcgaggtttctcctgtaaaccacagaacacacggaatactcagaaatcattgaatttttttccgtgttatctgtgtattccgtggttgaaattattcatatctcaatgcttgagccggttcgatttttgctgcacggtatgccggataaagggtacaaaccaatgacaacacaatcgaagtcacgataatggttgctacctgcattggcgaaatcagtgtcggtagatgaatattcggattgagtaatgccacaatctcatccaaattgagcgtgataatcgtaccgataatgccacccaaaatcgaaccgattacgccgacaatcgcaccttggaaaataaaaatttgtgtcacttgtcgtttagttaaaccttgggtttgtaagatggcgatttcaccttgtttatctaccaccatcagactgagtgaggtcacgatattggaaatagcaacgataatgatcaggctgatcaataaacccatcatatttttttccatacgaaccgcttggaaaaattcacctttttgttctcgccaatcgctgatttggtagttatttgcagcgaaatgttggctaagatcggtaacttggaatggatcttgcaaatataaccgcataccttgcacttggtcttcagttatccgcagtaaacgaccaacatcggcaagattggcgaaaagagtatattcgctcgcttcattgttagtatggtaaataccgaccacgttaaataaacgctgcaccggcacacgccccatcggcgtatattgactgttttcggtaatcatcaaacggattttttcacccgtactaatatttaacttgttagcaagacgtgaaccgatcaatacgttaaattcaccttgaggtaagagcgttttaacagcttcgccaatcaacattggatcgtcgctttcattctcaacaccgagtaactgaccggcgttgatcccttgccggctttggataatcacattcgccttattaatcgccacacttttactggcaaatgccggtaagctaagcgattgatttttatcgaaatgtccttcttgtggcaacacaatggcgtgcggcagtgttgaaagcaaattacgcttttgcatattctccaagccattcattaccgacagcacgatcactaatgccattacgccaagcacgatcccaaaacttgccaagttggtcactaagcgcccaaaccggtcggcacttttagaacgccaatagcgaaaggcgataaaaagagttgttaaattcatagtttatattgttagccatttatacctaatactcaaaaagcaagcggtcaaatttaccgaatttttgcaaattttcgctaattttaaaccgcttgtatcttttaggaatcaggctatttcgtggaatattattttccgttgagtacaaattcttccatattctgcgtcactttattcactaaagtggtaaccgcagaatcgcttgcccacgcaacgtgcggggtaattaataagttcggtaaacgttttgccgcctgcattaacggattgtctttttccggcggttctttgactaatacgtccagcgccgcacctgcaatcttgccctgttctaaagccgctaataatgctgcttcatccactaatgggcctctgccggtattgattaaataagcggtcggtttcattaatgctaaggtttcggcgttaatcaaattttgagttgaatcggtgagcgggcaatgtaatgaaataatatccgcttgtttaaatacttcttcaaaagcggtataaccttcacgaatttcgcttgcacctttgtgttctgcaaaaatgactttcattccgaccgcttgtgctaagcgagccacttccgaaccggtgttgcctttaccgaaaatagctaaggttgagccgcgaatatcggttaccggatgatcgacatagcagaattgtccgcaagtcgcccaacgatccgaggtaatttgatcacgatgataaccgattaagctgtgttttaacgcaaaaatcatgcctaaaacgtgttctggcacggttgtggtggaatagccggtgacgtttttaaccacaatacctaactcttttgctgcgactaaatcaacgttattagtacctgtggcggtaatcgaaattaatttcagtttcggtaattgagccagtaactctctgccaagtaatactttgctggtaacgataatatccgcatctttcgcgcgctcaaaggtttgcgaagcatcggtactgtcgtattccgtccaagtatgaggaaatgacgggcgagggatttcgtgggtaggtacaccagttttatctaaaaaaacgatattaagtgcagtcataggacgctccttaaatttttaccacggaaagtgaacttcccgtggtaataggaattagtttgacgtatcaatttcttcgaatgatttcactaaatcatcgatcgctttcatttggctgacgaacgcttccaattttgataatggtaaagcagacgggccgtcacatttcgcactgttcggatccggatgcgcttcaaggaataaaccggctaaaccgatcgccataccactacgagctaattcggttacttgatcacggcgaccgccggatgccgcaccgaacgggtcacggcattgtaatgagtgggttacgtcaaaaatgaccggacagcctttcgatacttttttcataatgttaaagccgagcatatccaccactaaattatcgtaaccgaagttggtaccacggtcgcaaaggatcacgttttcgttaccacattccgcaattttttctacgatattccccatttgaccagggcttaagaattgtggttttttcacgttgattaccgcaccggtacgtgccattgcttcaactaaatccgtttgacgggctaaaaacgctggtaactggataatatccaccacttccgcaaccggtttgcactgataaatttcgtgtacgtcggtaatgatatttacaccgaaggtatcttttaattcttggaagatttttaaaccctcttccatacccggtccacggtaagaatgaattgacgagcggttcgctttatcgaaagaagctttaaatacataaggcacactaagtttgttggtcacttctacatattgttcacagacacgcattgccatatcacggctttctaatacgttcataccgccgaataaagtaaacggcttgtcatttgccacttcaatattgccgacttttacgattttgttgttcataagatttcctttatttatttggctctagccgagctaaaattattttctctaaaagcgaattatcacaatagagtgcagatttttcagaagcgaggatcatttcttgttgtgagacgccattaaaatgtaagcggtaaccaaatttttgtgcaagttgaataataaattcacgttgcactcgaccattcccttctctaaatggatgtaaaatatttatttcgcctaaatagtaggctaatttatttgctacttctaatttagataatagaagaaaagcttcattttgataacgtttgtgtaacttagcaaattcaggttgaatgcgatgaggactagcaaatacagtttttccttttgttattccaacacctctaatttctccagcccattcataaatatcattgaatagccgacgatgaatttcctgtaagtgtgcaagatcgaaatttccttctacaggcaataaacgaagttttatagactgcagggcgacaatgcggctttctttttcttctaattcttgttccgttttcgcatttaatttattgaacaaaacaccatttttatcagtgtaacgatctgattccgcatatttcatagatacttttttctacttcatcaaagctaatttgattctcaatccaagcattaaagagattaagtgtttgctgatcaagatataatccttctaataagttattatctatagcagcttgaactgcatctaatcggaattttcgctcttgctctgtcataatatagcccttaatgtaatctactttctttgcttttttgctctaaacctttcatttcgagtttaagcattacggcggaaggatcttccggacattgatcgataaaataactgagatcttcatatgccgcttgatagcagtccatacttgctaaaaccataccacgatcacgaatttcatacggatcttccggactgaatgcaaggcggtattcaattacgcgtaaggtttcttcgtattttttctcacgggtcagcgccattttaaagacggtttctactcgttcaagtaattcattcggctgagctttgcgcagtaaatccggcgataattcaacaccataaccgacttcgccttcaagccatttaatcaagagttccatcggtaagaaactaccgtcccaggggttaataaaacgtaccgtggttttacctttttcatctttcatttcggcacgtaagatcaattgggtcgggaaatttactgggtaaagcggtaagtccaaagctgccgctaaatataacacaattgcgccaacagaaaccggcataccctgatgacgacgaatcacttggttaagcaataaattatcggtatggaaataaccttcataatcacagttaaatttccattcctgatagacgagatcaagtaattgttgaatgcgttcggcatctgatgtggcatttacttgataacgggctttttttactagcgccgacattaagcccaatacttgcggctcactcaaagaattatcaatcagtaacgttagacgaaccatttctcggtataaatatttttgtagttcactacgactaatttctacttttggatcttccagttctttgagtaattcttgaataatatcgtccattattttgcctttcttactgctttcgtcagacggtcattgccgccgtaatcttggaatgaggctacttcatcccattgatattgtttgaaaatttgttgaaccgcttgagcctgttgccaaccgtgttcgagcattaatgcgccgttatcatataagtaaagcggtgcgttttggataattttttgcaaatcactcaaaccgtcttcttcggcaaccagtgcagaaagaggttcaaaacgtacatcgccgtatttaagattttcatcttgtttatcaatgtaaggcggattgctaacaataagatcaaattgctggttttcaagggcagaaaaccaatcgctttgtaaaaagctcacgttattaaagcctaaattttggcgattggtttcggcaagtgcaactgcttccgctttaaaatccacgccgagaatctgcgccttatcaccaagttcggaagcaagtgctaaggcgattgcaccggtaccggtacctaaatctaaaatttgcaaagtttgctgtgtttttaaccgcttataagcccagtctaatgcgatttcaaccaagcgttccgtatccggtcgagggattaacgtatgtggtgaaacttttaacggcaacgaccaaaattctttttcacctaaaatatacgccattggttcaccttgtaagcggcgagtaagcaacgcttccaattgagatatttccgtttggcttagttcggtttcaccaaaagcaaaaattgcagattttgagcgttttgtgaccgcttgtaacagtatgtttgcgtctgttttaggatgaagatagggatcttgagctaaatttgcttgtaacgcatttactgcataagcgagccattcggtataagtcattagaaccttttatcgggttatcatagggcagaaggttctgccctatatgatgggtttagtttgttgggcgtacacaatgaccggtacgagccgtacttcccactttttgttgaattgtaaatgaattctgagcgaagttacttactgctaaattaattgggttgctctttttcgtcatctgtttgctcagagcattgtagtattgtttttcagagctgtttaacgctttatccatttttaatgcttgctgaatttcatccgtatgggcacggtttacgctaccttgagtaaatttatacgttagggtgtggttagcgtagctccagcttccttcacggttaatatcgtagctgaaaatcggattatcattcggtaacaccatcttgcctaaataagttgctttgccgtcttgtgtcaattcaactttattacttgttgcaatactgccaccatccatacgacattcccatgtgccaataaaactttgggttgtcgcttcgcgacttgctgctggtgtgttattggtggtgtaagtggtacaggcacttaagagcgcaaccgaagttgctaagaaaattttattcatatttgctttccaaaagtaagggtaaaagagtgaaggtggttagccccaccttcgatctaaattaagcgttgtcagaaagcgcagctaactgatccgcttggtattcggtaataattggttgaattaattcatcaattttaccgttcatcacttcatctaaacggtaaaccgttaggttaatgcggtgatctgttacacgaccttgtgggtagttataggtacgaatcttatccgaacggtcacccgaaccaagtaagttacggcgagtatccgcttgttctgccgcttggcgttcttgttctacttgaacaatacgagaagctaatactgcaagtgcttttgccttgtttttgtgttgtgaacgttcgtcttggcactctactacaataccggtcggaatgtgcgtgatacgtaccgcagaatcggtggtattaacgtgctgaccgccggcacctgatgaacgataagtatcgatacgtaaatctgctgggttaatttccggcatttcagattccggcaattccggcattactgcaaccgtacaagcagaggtgtggatacggccttgtgattcggttttcggtacacgttgtacacggtgaccgcccgattcgaatttaagttgaccatatacaccttcaccgctgattttaacgatgatttctttatatccgccttgttcactttcgttggcggacatttcctcgattctccagcgtttgctttcacagtaacggctgtacatacggtataaatcgccggcgaaaatacctgcttcgtcaccgcccgtaccggcacgaatctctaagaatgcgttgtattcgtcattcggatctttcggcagtaataggatttgtaaatgttgttccaaattttcgatttcggctttattttccgcaatttcttccgccgccatatctttcatatccggatcatcaagcagaatttgtgcttcttcgatatcgttgtttaattttttccaacgattgaaagtggttaccacttcttcaagttgtgaatattcttttgaataagcacggaatttgtcttgatcgttaatcacggatggatcgcctaataaggcttgtaattcctcatggcgttcacttaggctttctaatttgttgataatagattctttcattgcttttatttagtaaatgatggacagaaatagaggaaattatagcggaattttggacaaattgcttgtataaaaatctagagtgattttttcttgaaaatttacaagatttccacaggattttaaggtatta

SEQ ID NO: 8 - DNA, 1778 bp, Influenza A virus
agcaaaagcaggggaaaataaaagccaccgaaatgaaggcaatactattagtcttgctatatacatttacagccgcaaatgcagacacattatgtatcggttatcatgcaaataattcaactgacactgttgatacagtactagaaaagaatgtaacagtaacacactctgttaaccttctagaagacagacataacggaaaactatgtaaactaaggggggtagccccattgcatttgggtaaatgtaacattgcaggatggctcctgggaaacccagaatgtgaattactattcacagcaagctcatggtcttacattgtggaaacatctaactcagacaatgggacatgttacccaggagatttcatcaattatgaagagctaagagagcagttgagctcagtgtcatcatttgaaagatttgagatattccccaaggcaagttcatggcccaatcatgaaacgaatagaggtgtgacggcagcatgcccttatgctggagcaaacagcttctacagaaatttaatatggctggtaaaaaaaggaaattcatacccaaagctcagcaaatcctatgttaacaataaggagaaggaagtcctcgtgctatggggcattcaccatccacctaccagtactgaccaacaaagtctctaccagaatgcagatgcctatgtttttgtggggtcatcaaagtacaacaagaaattcaagccagaaatagcaacaagacccaaggtgagaggtcaagcagggagaatgaactattactggacactagtagagcctggagacacaataacattcgaagcaactggaaatctagtggtaccaagatatgccttcgcaatgaaaagaggttctggatctggtattatcatttcagatacaccagtccacgattgtaatacgacttgtcaaacacccaaaggtgctataaacaccagcctcccatttcagaatatacatccagtcacaattggagaatgtccaaaatatgtcaaaagcacaaaattgagaatggctacaggactaaggaatatcccgtctattcaatctagaggtctgtttggagccattgctggctttattgaggggggatggacaggaatgatagatggatggtacggttatcaccatcaaaatgagcagggatcaggatatgcagctgaccgaaagagcacacagaatgccattgacggaatcactaacaaagtaaactctgttattgaaaagatgaacacacaattcacagcagtgggtaaagaattcaaccacctggaaaaaagaatagagaatttaaacaaaaaggttgatgatggttttctggatgtttggacttacaatgccgaactgttggttctattggaaaatgaaagaactttggattaccatgactcaaatgtgaagaacctatatgagaaagtaagaagccagctaaaaaacaatgccaaggaaattggaaatggctgctttgaattttaccacaaatgtgatgacacgtgcatggagagcgtcaaaaatgggacttatgattacccaaattactcagaagaatcaaaactaaacagagaggaaatagatggggtaaagctggaatcaacaaggatttaccagattttggcgatctattcaactgtcgccagttcattggtactgtcagtctccctgggggcaatcagtttctggatgtgctccaatgggtctttacagtgcagaatatgtatttaaaactaggatttcagagacatgagaaaaaacacccttgtttctact

SEQ ID NO: 9 - DNA, 1701 bp, Influenza A virus
atgaaggcaatactagtagtcctgctctatacatttacaactgcaaatgccgacacattgtgtataggttatcatgcgaacaattcaactgacaccgtagacacagtactagaaaagaatgtaacagtaacacactctgtcaaccttctagaaaacaagcataatgggaaactatgtaaactaagaggggtagctccattgcatttgggtaaatgtaacattgctggctggctcctgggaaatccagaatgtgaatcactctccacagcaagctcatggtcctacattgtggaaacatccaattcagacaatgggacgtgttacccaggagatttcatcaattatgaggagctaagagagcagttgagctcagtgtcatcatttgaaagatttgagatattccccaagacaagttcatggcccaatcatgacacgaacagaggtgtgacggcagcatgtcctcatgctggaacaaacagcttttacagaaatttaatatggctggtaaaaaaaggagattcatacccaaagatcaacaaatcctacattaacaataaagagaaagaagttctcgtgctatgggccattcaccatccatctaccagtgccgaccaacaaagtctctacaaaaatgcagatgcctatgtttttgtgggatcatcaagatacagcaggaagtttgagccagaaatagcaacaagacccaaggtgagggaccaagcagggagaatgaactattactggacactagtagagcctggagacaagataacattcgaagcaactggaaatctagtggtaccgaggtatgcttttgcattgaaaagaaattctgggtctggtatcatcatttcagatacatcagtccatgattgtgatacgaattgtcagacacccaatggtgctataaacaccagcctcccatttcaaaatatacatccagtcacaattggagaatgtccaaaatatgtaaaaagtactaaactgagaatggccacaggattaagaaatatcccatctattcaatctcgaggcctgtttggggccattgctggctttatcgaagggggctggacaggaatgatagatggatggtatggttatcatcatcagaatgagcagggatcaggatatgcagccgacctgaagagcacacagaatgccattgacgggatcactaacaaggtaaattctgttattgaaaagatgaacacacaattcacagcagtaggtaaagagttcagccacttggaaagaagaatagagaatttaaataaaaaggttgatgatggttttctagatatttggacttacaatgccgaactgttggttctactagaaaatgaaagaactttggattaccacgactcaaatgtgaaaaccttatatgaaaaagtgagaagccagctgaaaaacaatgccaaggaaattggaaatggctgctttgaattttaccacaaatgtgatgacacgtgcatggaaagcgtcaaaaatggaacttatgattaccctaaatactcagaggaagcaaaattaaacagagaggaagtagatggggtaaagttggaatcaacaaggatttaccaaattttggcgatctattcaacggtcgccagttcattggtactagtagtctccctgggggcaatcagtttctggatgtgctctaatgggtcgctacagtgcagaatatgtatttaa

SEQ ID NO: 10 - DNA, 1557 bp, Influenza A virus
tgcagggtagataatcactcactgagtgacatcgaagccatggcgtctcaaggcaccaaacggtcatatgaacaaatggagactagtggggaacgccaggatgccacagaaatcagagcatctgtcggaagaatgattggtggaatcggaagattctacatccaaatgtgcactgaactcaaacttagtgattatgagggaaggctaattcaaaatagcataacaatagagagaatggtgctctctgcttttgatgagagaaggaataaatacctagaagagcatcccagtgctggaaaggatcctaagaaaactggaggacccatatatagaagagtagacggaaagtggatgagagaactcatcctttatgacaaagaagaaataaggagagtctggcgccaagcaaacaatggtgaagatgcaacagccggtcttactcatatcatgatttggcactccaatctgaacgatgccacctatcagagaacaagagcgcttgttcgcactggaatggaccccagaatgtgctctctaatgcaaggttcaacacttcccagaagatctggggccgcaggtgctgcagtaaaaggagttggaacaatagcaatggagttaatcagaatgataaaacgtggaatcaatgaccgaaacttctggaggggtgaaaatgggcgaaggacaaggattgcatatgaaagaatgtgcaatattctcaaaggaaagtttcaaacagctgcccaaagggcaatgatggatcaagtgagagaaagtcgaaacccaggaaatgctgaaattgaagatctcatttttctggcacggtcagcacttattctaagggggtcagttgcacataaatcttgcctgcctgcttgtgtgtacgggcttgcagtagcaagtgggcatgactttgaaagagaagggtattcactggtcgggatagaccccttcaaattacttcaaaacagtcaagtgttcagcctgatcagaccaaatgaaaacccagcccacaaaagtcaattggtgtggatggcatgccactctgctgcatttgaggatttaagagtatcaagcttcataagagggaagaaagtggttccaagaggaaagctttccacaagaggggttcagattgcttcaaatgaaaatgttgaagctatggactctagtaccctagaactaagaagcagatactgggccataaggaccagaagcggaggaaacaccaatcaacagaaggcatccgcgggccagatcagtgtgcaacctacattctcagtgcaacggaatatcccttttgaaagagcaaccgttatggcagctttcagcggaaacaatgagggacgcacatcagacatgcgtacggaagttataaggatgatggaaagcgcaaagccagaagatttgtccttccaggggcggggagtcttcgagctctcggacgaaaaggcaacgaacccgatcgtgccttcctttgacatgagtaatgaagggtcttatttcttcggagacaatgcagaggaatatgacaattaaagaaaaatacccttgggtccc

SEQ ID NO: 11 - DNA, 1701 bp, Influenza A virus
atgaaggcaatactagtagtcctgctatatacatttacaactgcaaatgccgacacattatgtataggttatcatgcgaacaattcaactgacaccgtagacacagtactagaaaagaatgtaacagtaacacactctgtcaaccttctagaaaacaggcataatgggaaactatgtaaactaagaggggtagctccattgcatttgggtaaatgtaacattgctggctggctcctgggaaatccagagtgtgaatcactctccacagcaagctcatggtcctacattgtggaaacatccaattcagacaatgggacgtgttacccaggagatttcatcaattatgaggagctaagagagcagttgagctcagtgtcatcatttgaaagatttgagatattccccaagacaagttcatggcccaatcatgacacgaacagaggtgtgacggcagcatgtcctcatgctggaacaaacagcttctacagaaatttaatatggctggtaaaaaagggaaattcatacccaaagatcaacaaatcctacattaacaataaagagaaggaagttctcgtgctatgggccattcaccatccatctaccagtgccgaccaacaaagtctctaccaaaatgcagatgcctatgtttttgtgggatcatcaagatacagcaggaagttcgagccagaaatagcaacaagacccaaggtgagggaccaagcagggagaatgaactattactggacactagtagagcctggagacaagataacattcgaagcaactggaaatctagtggtaccgagatatgctttcgcattgaaaagaaattctggatctggtattatcatttcagatacatcagtccacgattgtgatacgaattgtcagacacccaatggtgctataaacaccagcctcccatttcaaaatatacatccagtcacaattggagaatgtccaaaatatgtaaaaagtactaaactgagaatggccacaggattaagaaatatcccgtctattcaatctagaggcctgtttggggccattgctggctttatcgaagggggctggacaggaatgatagatggatggtacggttatcaccatcaaaatgagcagggatcaggatatgcagccgacctgaagagcacacagaatgccattgacgggatcactaacaaggtaaattctgttattgaaaagatgaacacacaattcacagcagtaggtaaagagttcagccacttggaaagaagaatagagaatttaaataaaaaggttgatgatggttttctagatatttggacttacaatgccgaactgttggttctattagaaaatgaaagaactttggattaccacgactcaaatgtgaaaaacttatatgaaaaagtgagaagccagctgaaaaacaatgccaaggaaattggaaatggctgctttgaattttaccacaaatgtgatgacacgtgcatggaaagcgtcaaaaatggaacttatgattaccctaaatactcagaggaagcaaaactaaacagagaggaaatagatggggtaaagttggaatcaacaaggatttaccaaattttggcgatctattcaacggtcgccagttcattggtactagtagtctccctgggggcaatcagtttctggatgtgctctaatgggtcgctacagtgcagaatatgtatttaa

SEQ ID NO: 12 - DNA, 1701 bp, Influenza A virus
atgaaggcagtactagtagtcctgctatatacatttacaaccgcaaatgccgacacattatgtataggctatcatgcaaacaattcaactgacaccgtagacacagtactagaaaagaatgtaacagtaacacactctgtcaaccttctagaaaacaggcataatgggaaactatgcaaactaaaaggggtagctccattgcatttgggtaaatgtaacattgctggatggcttctgggaaatccagagtgtgaatcactctccacagcaagctcatggtcctatattgtggaaacatctaattcagaaaatgggacgtgttacccaggagatttcatcaattatgaggagctaagagagcagttgagctcagtgtcatcatttgaaagatttgagatattccccaagacaagttcatggcccaatcatgacacggacagaggtgtgacggcagcatgtcctcatgctgggacaaacagcttctacagaaatttagtatggctggtacaaaagggaaattcatacccaaaagtcaacaaatcttacattaacaataaagagaaggaagttctcgtgctatgggccattcaccatccatctaccagtgccgaccaacagagtctctacaaaaatgcagatgcctatgtgtttgtgggatcatcaagatacagcaggaagttcgagccagaaatagctacaagacctaaggtgagagaccaagcagggagaatgaattattactggacactagtagagcctggagacaagataacattcgaagcaactggaaacctagtggcgccgagatatgccttcgcattgaaaagaaattctggatctggtattatcatttcagatacatcagtccacgattgtgatacaacttgtcagacacccaatggtgctataaacaccagcctcccatttcaaaatatacatccagtcacaattggagaatgtccaaaatatgtaaaaagtactaaactgagaatggccacaggtttaaggaatatcccgtctattcaatctagaggcctatttggtgccattgctggttttatcgaagggggttggacaggaatgatagatggatggtacggttatcaccatcaaaatgagcagggatcaggatatgcagccgacctgaagagcacacagaatgccattgacgggatcactaacaaggtgaactctgttattgaaaagatgaacacccaattcacggcagtaggtaaagagttcagccacttggaaaaaagaatagagaatttaaataaaaaggttgatgatggttttctagatatttggacttacaatgccgaactgttggttctattggaaaatgaacgaactttggattaccacgactcaaatgtgaaaaacttatatgaaaaagtaagaagccaactaaaaaacaatgccaaggaaattgggaatggctgctttgaattttaccacaaatgtgatgacatgtgcatggaaagcgtcaaaaatggaacttatgattaccctaaatactcagaggaagcaaaactaaacagagaggaaatagatggggtaaagttggaatcaacaaggatttaccaaattttggcgatctattcaacggtcgccagttcattggtactggtagtctccctgggggcaatcagtttctggatgtgctctaatgggtcgctacagtgcagaatatgtatttaa

SEQ ID NO: 13 - DNA, 1418 bp, Influenza A virus
catgaagactatcattgctttgagctacattttatgtctggttttcgctcaaaaacttcccggaaatgacaacagcacggcaacgctgtgcctggggcaccatgcagtgccaaacggaacgctagtgaaaacaatcacgaatgaccaaattgaagtgactaatgctactgagctggttcagagttcctcaacaggtagaatatgcgacagtcctcaccaaatccttgatggagaaaactgcacactaatagatgctctattgggagaccctcattgtgatggcttccaaaataaggaatgggacctttttgttgaacgcagcaaagcctacagcaactgttacccttatgatgtgccggattatgcctcccttaggtcactagttgcctcatccggcacactggagtttaacaatgaaagcttcaattggactggagtcgctcaggatggaacaagctctgcttgcaaaaggagatctaataaaagtttctttagtagattgaattggttgcaccaattaaaatacaaatatccagcactgaacgtgactatgccaaacaatgaaaaatttgacaaattgtacatttggggggttcaccacacgagtacggacagtgaccaaatcagcctatatgctcaagcatcagggagagtcacagtctctaccaaaagaagccaacaaactgtaatcccgaatatcggatctagaccctgggtaaggggtgtctccagcataataagcatctattggacaatagtaaaaccgggagacatacttttgattaacagcacagggaatctaattgctcctcggggttacttcaaaatacgaagtgggaaaagctcaataatgaggtcagatgcacccattggcaaatgcaattctgaatgcatcactccaaatggaagcattcccaatgacaaaccatttcaaaatgtaaacaggatcacatatggggcctgtcccagatatgttaagcaaaacactctgaaattggcaacagggatgcggaatgtaccagagaaacaaactagaggcatattcggcgcaatcgcgggtttcatagaaaatggttgggagggaatggtggacggttggtacggtttcaggcatcaaaattctgagggcacaggacaagcagcagatcttaaaagcactcaagcagcaatcaaccaaatcaacgggaaactgaataggttaatcgagaaaacgaacgagaaattccatcaaattgaaaaagaattctcagaagtagaagggagaattcaggacctcgagaaatatgttgaggacactaaaatagatctctggtcgtacaacgcggagcttcttgttgccctggagaaccaacatacaattgatctaactgactcagaaatgaacaaactgtttgaaagaacaaagaagcaactgaggg

SEQ ID NO: 14 - DNA, 1421 bp, Influenza A virus
ctattaaccatgaagactatcattgctttgagctacattttatgtctggttttcgctcaaaaacttcccggaaatgacaacagcacggcaacgctgtgcctgggacaccatgcagtgccaaacggaacgctagtgaaaacaatcacgaatgaccaaattgaagtgactaatgctactgagctggttcagagttcctcaacaggtagaatatgcgacagtcctcaccaaatccttgatgggaaaaattgcacactgatagatgctctattgggagaccctcattgtgatggcttccaaaataaggaatgggacctttttgttgaacgcagcacagcttacagcaactgttacccttatgatgtgccggattatgcctcccttaggtcactagttgcctcatccggcaccctggagtttaccaaagaaggcttcaattggactggagtcgctcaggatggaacaagctatgcttgcaaaaggggatctgttaaaagtttctttagtagattgaattggttgcacaaattagaatacaaatatccagcgctgaacgtgactatgccaaacaatgacaaatttgacaaattgtacatttggggggttcaccacccgagtacggacagtgaccaaaccagcctatatgttcaagcatcagggagagttacagtctccaccaaaagaagccaacaaactgtaatcccgaatatcgggtctagaccctgggtaaggggtgtctccagcataataagcatctattggacaatagtaaaaccgggagacatacttttgattaacagcacagggaatctaattgctcctcggggttacttcaaaatacgaagtgggaaaagctcaataatgaggtcggatgcacccattgacaactgcaattctgaatgcattactccaaatggaagcattcccaatgacaaaccttttcaaaatgtaaacaggatcacatatggggcctgtcccagatatgttaagcaaaacactctgaaattggcaacagggatgaggaatgtaccagagaaacaaactagaggcatattcggcgcaatcgcaggtttcatagaaaatggttgggagggaatggtggacggttggtacggtttcaggcatcaaaattctgaaggcacaggacaagcagcagatcttaaaagcactcaagcagcaatcaaccaaatcaacgggaaactgaataggttaatcgagaaaacgaacgagaaattccatcaaatcgaaaaagaattctcagaagtagaagggagaattcaggacctagagaaatatgttgaagacactaaaatagatctctggtcttacaacgcggagcttcttgttgccctggagaaccaacatacaattgatctaactgactcagaaatgaacaaactgttcgaaagaacaagaaagcactg

SEQ ID NO: 15 - DNA, 1778 bp, Influenza A virus
agcaaaagcaggggaaaataaaagcaaccaaaatgaaggcaatactattagtcttgctatatacattcacagccgcaaatgcagacacattatgtataggttatcatgcaaataattcaactgacactgttgatacagtactagaaaagaatgtaacagtaacacactctgttaaccttctagaagacagacataacggaaaactatgtaaactaaggggggtagccccattgcatttgggtaaatgtaacattgctggatggctcctgggaaacccagaatgtgaattactattcacagcaagctcatggtcttacattgtggaaacatctaactcagacaatgggacatgttacccaggagatttcatcaattatgaagagctaagagagcagttgagctcagtgtcatcatttgaaaggtttgagattttccccaaggcaagttcatggcccaatcatgaaacgaacagaggtgtgacggcagcatgtccttatgctggagcaaacagcttctacagaaatttaatatggctggtaaaaaaagaaaattcatacccaaagctcagcaaatcctatgttaacaataaggagaaggaagtcctcgtgctatggggcattcaccatccacctaccagtactgaccaacaaagtctctaccagaatgcagatgcctatgtttttgtggggtcatcaaagtacaacaagaaattcaagccagaaatagcaacaagacccaaggtgagaggtcaagcagggagaatgaactattactggacactagttgagcctggagacacaataacattcgaagcaactggaaatctagtggtgccaagatatgccttcgcaatgaaaagaggttctggatctggtattatcatttcagatacaccagtccacgattgtaatacgacctgtcaaacacccaaaggtgctataaacaccagcctcccatttcagaatatacatccagtcacaattggagaatgtccaaaatatgtcaaaagtacaaaattaagaatggctacaggattaaggaatatcccgtctattcaatctaggggcctgtttggagccattgctggctttattgagggggggtggacaggaatgatagatggatggtacggttatcaccatcaaaatgagcagggatcaggatatgcagccgaccgaaagagcacacagaatgccattgacgggatcactaacaaagtaaactctgttattgaaaagatgaacacacaattcacagcagtgggtaaagaattcaaccacctggaaaaaagagtagagaatttaaataaaaaggttgatgatggttttctggatgtttggacttacaatgccgaattgttggttctattggaaaatgaaagaactttggattaccatgactcaaatgtgaagaacctatatgagaaagtaagaagccagctaaaaaacaatgccaaggaaattggaaatggctgctttgaattttaccacaaatgtgatgacaagtgcatggagagcgttaaaaatgggacttatgattaccccaaatactcagaagaatcaaaactaaacagagaggagatagatggagtaaagctggaatcaacaaggatttaccagattttggcgatatattcaactgtcgccagttcattggtactgttagtctccctgggggcaatcagtttctggatgtgctccaatgggtctttacagtgcagaatatgtatttaaaattaggatttcagagacatgagaaaaaacacccttgtttctact

SEQ ID NO: 16 - DNA, 1701 bp, Influenza A virus
atgaagactaccattgctttgagccacattctatgtctggttttcgctcaaaaacttcctggtaatgacaacaacatggcaacgctgtgccttggacaccatgcagtgccaaacggaacgatagtgaaaacaatcacgaatgaccaaattgaagttactaatgctactgagctggttcagagtttctctacaggtgaaatatgcaacagtcctcatcagatccttgatggagaaaactgcacactaatagatgctctattgggagatcctcagtgtgatggcttccaaaacaataaatgggatctttttgttgaacgaagcaaagcccacagcaactgttacccttatgatgtgccggattatgcctcccttaggtcactagttgcctcatccggtacactggagtttaacaatgaaagcttcaattggactggagtaactcaagacggagcaagctctgcttgcaaaaggagatccagcaaaagtttctttagtagattgaattggttgactcacttaaacttcaaatacccagcattggaagtgaccatgccaaacaatgaacaatttgacaaattgtacatttggggggttcaccacccggctacggacaaggaccaaatctccctgtatgctcaagcagcaggaagaatcatagtatctaccaaaagaagccaacaagctgtaattccgaatatcgggtctagacccagagtaagggatatccctagcagaataagcatctattggacaatagtaagaccgggagacatacttttgattaacagcacagggaatctaattgctcctaggggttacttcaaaatacgaagtgggaaaagctcaataatgagatcagatgcacccattggcaaatgcaattctgcatgcatcactccaaatggaagcattcccaatgacaaaccattccaaaatgtaaacaggatcacatacggggcctgtcccagatatgttaagcaaaacactctgaaattggcaacaggaatgagaaatataccagagaaacaaactagaggcatatttggcgcaatagctggtttcatagaaaatggttgggagggaatggtggatggttggtacggtttcaggcatcaaaattctgagggaagaggacaagcagcagatctcaaaagcactcaagcagcaatcgatcaaatcaatgggaagctgaatagattgatcggaaaaaccaacgagaaattccatcagatcgaaaaagaattttcagaagtcgaagggagaattcaggaccttgagaaatatgttgaggacactaaaatagatctctggtcatacaacgcggagcttcttgttgccctggagaaccagcacacaattgatctaactgactcagaaatgaacaaattgtttgaaaaaacaaagaagcaactgagggaaaatgctgaggatatgggcaatggctgtttcaaaatataccacaaatgtgacaatgcctgcatagaatcaatcagaaacggaacttatgaccacgatgtgtacagagatgaagcattaaacaaccgattccagatcaagggggttgaactgaagtcagagtacaaagattggattctatggatttcctttgccatatcatgctttttgctttgtgttgctttgttggggttcatcatgtgggcctgccaaaaaggcaacattaagtgcaacatttgcatttga

SEQ ID NO: 17 - DNA, 1737 bp, Influenza A virus
ggatatttctattaaccatgaagactatcattgcttttagctacattttatgtctgactttcgctcaaaaacttcccggaagtgacaacagcatggcaacgctatgcctgggacaccatgcagtaccaaacggaacgttagtgaaaacaatcacggatgaccaaattgaagtgactaatgctactgagctggttcagagttcctcaacaggtagaatatgcaacagtccccaccaaatccttgatgggaaaaattgcacgctggtagatgctctattgggagaccctcattgtgatgatttccaaaacaagaaatgggacctttttgttgaacgaagcacagcctacagcaactgctacccttattatgtgccggattatgcctcccttaggtcactagttgcctcatccggcaccctggagttcacccaagaaagcttcaattggactggagttgctcaagatggatcaagctatgcttgcagaaggaaatctgttaacagtttctttagtagattaaattggttgcataatttgaattacaaatatccagcgctgaacgtaactatgccaaacaatgacaaatttgacaaattgtacatttggggggttcaccacccgggtacggacagggaccaaaccaacctatatgttcaagcatcagggagagttatagtctccacccaaagaagccaacaaactgtaatcccgaatatcggatctagaccctgggtaaggggtgtctccagcataataagcatctattggacaatagtaaaaccgggagacatacttttgattaacagcacagggaacctaattgcccctcggggttacttcaaaatacaaagtgggaaaagctcaataatgaggtcagatgcacccattggcaactgtaattctgaatgcattactccaaatggaagcattcccaatgacaaaccttttcaaaatgtaaacaggatcacatatggggcctgtcccagatatgttaagcaaaacactctgaaattggcaacagggatgcggaatgtaccagaaaaacaaactagaggcatattcggcgcaatcgcaggtttcatagaaaatggttgggaggggatggtggacggttggtacggtttcaggcatcaaaattctgaaggcacaggacaagcagcagatcttaaaagcactcaagcagcaatcaaccaaatcaccgggaaactaaatagagtaatcaagaaaacgaacgagaaattccatcagatcgaaaaagaattctcagaagtagaagggagaattcaggacctagagaaatacgttgaagacactaaaatagatctctggtcttacaacgcggagcttcttgttgccctggagaaccaacatacaattgatttaactgactcagaaatgagcaaactgttcgaaagaacaaggaagcaactgcgggaaaatgctgaggacatgggcaatggttgcttcaaaatataccacaaatgtgacaatgcctgcataggatcaatcagaaatggaacttatgaccatgatgtatacagagacgaggcattaaacaatcggttccagatcaaaggtgttcagttgaattcaggatacaaagattggatcctatggatttcctttgccacatcatgctttttgctttgtgttgttctgctggggttcattatgtgggcctgccaaaaaggcaacattaggtgcaacatttgcatttgaatgcattaattaaaaacac

SEQ ID NO: 18 - DNA, 28038 bp, Porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaactagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccmtgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactctcttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 19 - DNA, 28039 bp, Porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcggtctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacttgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccattatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaaatggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgaaaaggttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgtttttttaaagtggatacttacaactccactgtttataaattcttggctgttttacctccaaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 20 - DNA, 28038 bp, Porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgccatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgttagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttttagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacactcgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttctctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaacactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgacgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaatacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctttatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttttgatggggagaacgtgtctaaagaaggcttctttccctatattaatggtgtcatcaccgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcactggttatgctgccaatgtatttgctactgagcccaatggccacataccagaaggttttagttttaataattggtttcttttgtccaatgattccactttggtgcatggtaaggtggtttctaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtgatgttaagtttacgtccctttactttcaattcacaaagggtgagttgattactggcacgcctaaaccatttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaattttgaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatggatacac

SEQ ID NO: 21 - DNA, 27989 bp, Porcine epidemic diarrhea virus
ctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgtatcacttgcaccttacatttcacagcaccaagttatatggaggctgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcgttgagaagtttaaagtcttccttaactgtgttcaccctgttgtaccacgtgtcattgaaacttcttttgtggaattagaagagacgacatttaaaccaccagcactcaatggtagtattgctattgttgatggctttgctttctattatgatggaacactatactatcccaccgatggtaatagcgttgttcctatctgctttaagaagaaaggtggtggtgatgtcaaattctctgatgaagtctctgttaaaaccattgacccagtttataaggtctcccttgaatttgagttcgagtctgagactattatggctgtgcttaataaggctgttggtaattgtatcaaggttacaggtggttgggacgatgttgttgagtatatcaatgttgccattgaggttcttaaagatcacatcgatgtgcctaagtactacatctatgatgaggaaggtggcaccgatcctaatctgcccgtaatggtttctcagtggccgttgaatgatgacacgatctcacaggatctgcttgatgttgaagttgttactgatgcgccagttgatttcgagggtgatgaagtagactcctctgaccctgataaggtggcagacgtggctaactctgagcctgaggatgacggtcttaatgtagctcctgaaacaaatgtagagtctgaagttgaggaagttgccgcaaccttgtcctttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgatggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcgcttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgataagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagacatgatttctattactatggtagtattgccatctgatggtgatgctaattatgacaaaaattatgcacgcgccgtcgtcaaggtatctaagcttaaaggcaagttattgcttgctgttggtgatgccacgttgtattccaagttgtcccatctcagcgtggtaggtttcgtatccacacctgatgatgtggagcgtttctacgcaaataagagtgtggttattaaagtcactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgtctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgtttctgctggttctgtcactattgaacgtgtcacgcatgacggctgttgttgtagtaagcgtgttgtcactgcaccagttgtgaatgctagcgtattgaagcttggcgtcgaggatggtctttgtccacatggtcttaactacattgacaaagttgttgtagttaaaggtactacaattgttgtcaatgttggaaaacctgtagtggcaccatcacacctctttcttaagggtgtttcttacacaacattcctagataatggtaacggtgttgtcggccattatactgtttttgatcatgacactggtatggtgcatgatggagatgcttttgtaccgggtgatctcaatgtatctcctgttacaaatgttgtcgtctcagagcagacggctgttgtgattaaagaccctgtgaagaaagtagagttagacgctacaaagctgttagacactatgcattatgcatcggaaagattcttttcctttggtgattttatgtcacgtaatttaattacagtgtttttgtacatccttagcattttgggtctctgttttagggcctttcgtaagagggatgttaaagttctagctggtgtaccccaacgtactggtattatattgcgtaaaagtgtgcgctataatgcaaaggcgttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcagacttctctcacacacaggtagtatggcaacaccttagagacccattaattggtaatgtgatgcctttcttttatttggcatttctggcaatttttgggggtgtttatgtaaaggctattactctctattttattttccagtaccttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgctaccgacaggtcctgccactattcttattgacaaggttgaattcagtaatggtttttactatctttatagtggtgacacattttggaagtacaactttgacataacagatagcaaatacacttgcaaagaatcacttaaaaattgtagcataatcacagactttattgtttttaacaataatggttccaatgtaaatcaggttaagaatgcatgtgtttatttttcacagatgctttgtaaacctgttaagttagtggactcagcgttgttggccagtttgtctgttgattttggtgcaagcttacatagtgcttttgttagtgtgttgtcgaatagttttggcaaagatctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataaccttcatgttgacctttaatgattgtcgtatgcacactaccatacctactgtttgcattgcaaataagaagggtgcaggtcttcctagtttttcaaaggttaagaaattcttctggtttttgtgtctgttcatggttgctgttttctttgcactaagctttcttgattttagtactcaggttagcagtgatagcgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagctcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatttcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcttacattgtaacacagaacacacttggcatgttgggctatgcaactttgtacttcttgtgcactaaaggtgttagatatatgtggatttggcatttgggatttttgatctcatatatacttattgcaccatggtgggttttgatggtttatgccttttcggccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaatgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatgtgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccaggtgaatcttttaatatcttggcgtgctatgatggtgctgcagctggtgtttatggcgttaacatgcgctctaattacactattagaggctcgttcattaatggcgcttgtggttcacctggttataatattaacaatggtaccgttgagttttgctatttacatcagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtaggtaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgcagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgttcttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgatgactgcggcatataactatttttacgctagtgacattcttagttgtgctatgacactatttgctagtgtgactggcaactggttcgttggtgctgtttgttataaagctgctgtttatattgccttgagatttcctacttttgtggctatttttggtgatattaagagtgttatgttctgttaccttgtgttgggttattttacctgttgtttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttggatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcaagagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccattacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagttaagtgggagttcgatggtggttgtaacactattgagctagaaccaccacgtaagttcttggtggattctcctaatggtgcacagatcaagtatctctactttgttcgtaaccttaacacgttacgtaggggtgctgttcttggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgcgttaagatgttggccaatggttctggtaatggacaagctgttactaatggtgtggaggctagtactaaccaggattcatacggtggtgcttccgtgtgtctatattgtagagcacatgttgagcatccatctatggatggtttttgcagactgaaaggcaagtacgtacaggtgccactaggtacagtggatcctatacgttttgtacttgagaatgacgtttgcaaggtctgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagctgaacacgatttcttcacttggaaggatggtcgtgcaatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtttatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaactactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcaccagaaacaccttaagtccatagttaatactaggggcgcttcggttgttattggtactactaagttttatggtggttgggacaatatgcttaagaaccttattgatggtgtcgaaaatccgtgtcttatgggttgggattacccaaagtgcgacagagcactgcccaatatgatacgcatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagttttcaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttacaacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttactacctaccttaccctgatccttcaagaatcctctctgcaggtgtgtttgttgacgacgttgttaaaactgatgcagttgtattgcttgaacgttatgtgtcattggctatagatgcctacccgttatctaagcatgaaaaccctgaatataagaaggtgttttatgtgcttttggattgggttaagcacctgtataaaactttgaatgctggtgtgttagagtctttttctgtcacacttttggaagattctactgctaaattctgggatgagagcttttatgccaacatgtatgagaaatctgcagttttgcaatctgcagggctttgtgttgtttgtggctctcaaactgttttacgttgtggtgattgtctacggcgtcctatgctttgtactaagtgtgcttatgatcatgtcattggaacaactcacaagttcattttggctatcactccatatgtgtgttgtgcttcagattgtggtgtcaatgatgtaactaagctctacttaggtggtcttagttattggtgtcatgaacacaagccacgtcttgcattcccgttgtgttctgctggtaatgtttttggtttgtacaaaaattctgctaccggctcacccgatgttgaggactttaatcgcattgctacatccgattggactgatgtttctgactacaggttggcaaatgatgtcaaagactcattgcgtctatttgcagcggaaactatcaaggccaaggaggagagcgttaagtcatcctacgcttgtgcaacactacatgaggttgtaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcaccctgcttttaacatacctgaagcttattctagcttagtgccctattaccaactgattggtaagcagaagattacaactatccagggacctccaggtagtggtaaatctcactgtgttatagggctaggtttgtactatccaggtgcacgtatagtgtttacagcttgttctcatgcagcggtcgattcactttgtgtgaaagcctccactgcttatagcaatgacaaatgttcacgcatcataccacagcgtgctcgtgttgagtgttatgacggtttcaagtctaataatactagtgctcagtaccttttctccactgtcaatgctttgccagagtgcaatgcggacattgttgtggtggatgaggtttctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgcactgtgtctgagatggtctatgaaaaccaattcattcctgtgcacccagatagcaagcagtgttttaaaatcttttgcaagggtaatgttcaggttgacaatggttcaagcatcaatcgcaggcaattggatgttgtgcgtatgtttttggctaaaaaccctaggtggtcaaaggctgtttttatttctccttataacagccagaattatgttgccagccgcatgctaggtttacaaattcagacagttgactcatcccagggtagtgagtatgactatgtcatttatacacaaacttcagatactgcccatgcctgtaatgttaacaggtttaatgttgccatcacaagggctaagaaaggcatattatgtataatgtgcgataggtccctttttgatgtgcttaaattttttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggcttccgttttgatatcaacatacccaaccatcacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaatttgcacaccttttgcctctacttaaacgcggccaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtacaatccatactgtattgatatacagcagtggggatacaagggatcacttagccttaaccaccatgagcattgtaatgtacatagaaacgagcatgtggcttctggtgatgccataatgactcgctgtctagccatacatgattgctttgtcaagaacgttgactggtccatcacatacccatttattggtaatgaggctgttattaataagagcggccgaattgtgcaatcacacactatgcggtcagttcttaagttatacaatccaaaagccatatatgatattggcaaccctaagggcattagatgtgccgtaacggatgctaagtggttctgctttgacaagaatcctactaattctaatgtcaagacattggagtatgactatataacacacggccaatttgatgggttgtgcttgttttggaattgcaatgtggacatgtatccagaattctctgtggtctgtcggtttgacactcgctgtaggtcaccactcaacttggagggttgtaatggtggttcactgtatgttaataatcatgcattccatacaccggcttttgacaagcgtgcttttgccaagttgaagccaatgccatttttcttctatgatgatactgagtgtgacaagttacaggactctataaactacgttcctcttagggctagtaattgcattactaaatgtaatgttggtggagctgtctgtagtaagcattgtgctatgtaccatagctatgttaatgcttacaacacctttacgtcggcgggctttacgatttgggtgcccacttcgtttgacacctacaatctgtggcagacatttagtaacaacttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgcacatctaagtgtgtcatttgggactatgaagccgaacgtccacttactacttttacaaaggatgtctgtaaatataccgactttgagggtgacgtttgcacactctttgataacagcattgttggttcattagagcgattctctatgacccaaaatgctgtgcttatgtcacttacagctgttaaaaagcttactggcataaagttaacttatggttatcttaatggtgtcccagttaacacacatgaagataaaccttttacttggtacatttacactaggaagaacggcaagttcgaggactatcctgatggctattttacccaaggtagaacaaccgctgattttagccctcgtagtgacatggaaaaggacttcctaagtatggatatgggtctgtttattaacaagtacggactcgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaatctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgttattaatttaaaagattcatccattagtgatgttgtgttaggtttgttgaagaatggtaagttgctagtgcgtaataatgacgccatttgtggtttttctaatcatttggtcaacgtaaacaaatgaagtctttaaattacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgatgctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctaccgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgcctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctccctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaacaacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttttagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgga

SEQ ID NO: 22 - DNA, 27989 bp, Porcine epidemic diarrhea virus
ctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgttacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccaaaaacatttgtggttggctgttattttctaactgtaattacttcctcgaagagttagagcttacttttggtcgtcgtggtggtaacatcgtgccagttgaccaatacatgtgtggcgctgacggtaaacctgttcttcaggaatccgaatgggagtatacagatttctttgctgactccgaagacggtcaactcaacattgctggtatcacttatgtgaaggcctggattgtagagcgatcggatgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattctcaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagcgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagttcatcgccgaagtgcctgagaagttggctgcggctgttacagtttttgtcaacttcttgaatgagctttttgagtctgcctgtgactgcttaaaggtcggaggtaaaacctttaacaaggttggctcttatgttctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcgtacagttgttgttgacggacttgcattcttcgagagtgacgggttttacagacatcttgctgatgctgacgttgtcattgaacatcctgtttataagtctgcttgtgagctcaagccagtttttgagtgtgacccaatacctgattttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtccctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggacagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaaccgttctattcttataagaatgttgatttttaccaaggagattttagtgaccttgttaaacttccatgtgactttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcacttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgactggcggtgcattgcttgaagccataaatgtatttaaaaagagtaacaaaacagtgcctgctggcaactgtgttacttttgagtgtgcagatatgatttctattactatggtagtattgccatctgacggtgatgctaattatgacaaaaattatgcacgcgccgtcgtcaaggtatctaagcttaaaggcaagttattgcttgctgttggtgatgctatgttgtattccaagttgtcccacctcagcgtgttaggtttcgtatccacacctgatgatgtggagcgtttctacgcaaataagagtgtggttattaaagttactgaggatacacgtagtgttaagactgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtctaagtacattgttcctgctggttctgtcactattgaacgtgtcacgcatgacggttgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcgcacctctttcttaagggtgtttcctacacaacattcctagataatggtaacggtgttgccggccattatactgtttttgatcatgacactggtatggtgcatgatggagatgtttttgtaccaggtgatctcaatgtgtctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacatacttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttctgaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagcttttttgattttagtactcaggttagcagtgatagtgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtatcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcgcgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcacgagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcacattagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacacctcaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatgcagattgtcgataaagatggtacttattaccttccttaccctgatccttcaagaattctctctgcaggtgtgtttgttgatgacgttgttaaaactgatgcagttgtattgcttgaacgttatgtgtcattggctatagatgcctacccgttatctaagcatgaaaatcctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgaggttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcttccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggcttccgttttgatatcaacatacccaaccatcacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaatttgcacaccttttgcctctacttaaacgcggccaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtacaatccatactgtattgatatacagcagtggggatacaagggatcacttagccttaaccaccatgagcattgtaatgtacatagaaacgagcatgtggcttctggtgatgccataatgactcgctgtctagccatacatgattgctttgtcaagaacgttgactggtccatcacatacccatttattggtaatgaggctgttattaataagagcggccgaattgtgcaatcacacactatgcggtcagttcttaagttatacaatccaaaagccatatatgatattggcaaccctaagggcattagatgtgccgtaacggatgctaagtggttctgctttgacaagaatcctactaattctaatgtcaagacattggagtatgactatataacacacggccaatttgatgggttgtgcttgttttggaattgcaatgtggacatgtatccagaattctctgtggtctgtcggtttgacactcgctgtaggtcaccactcaacttggagggttgtaatggtggttcactgtatgttaataatcatgcattccatacaccggcttttgacaagcgtgcttttgccaagttgaagccaatgccatttttcttctatgatgatactgagtgtgacaagttacaggactctataaactacgttcctcttagggctagtaattgcattactaaatgtaatgttggtggagctgtctgtagtaagcattgtgctatgtaccatagctatgttaatgcttacaacacctttacgtcggcgggctttacgatttgggtgcccacttcgtttgacacctacaatctgtggcagacatttagtaacaacttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgcacatctaagtgtgtcatttgggactatgaagccgaacgtccacttactacttttacaaaggatgtctgtaaatataccgactttgagggtgacgtttgcacactctttgataacagcattgttggttcattagagcgattctctatgacccaaaatgctgtgcttatgtcacttacagctgttaaaaagcttactggcataaagttaacttatggttatcttaatggtgtcccagttaacacacatgaagataaaccttttacttggtacatttacactaggaagaacggcaagttcgaggactatcctgatggctattttacccaaggtagaacaaccgctgattttagccctcgtagtgacatggaaaaggacttcctaagtatggatatgggtctgtttattaacaagtacggactcgaagattacggctttgagcacgttgtgtatggtgatgtttctaaaaccacccttggtggtttacatctactaatttcgcaggtgcgtctggcctgtatgggtgtgcttaaaatagacgagtttgtgtctagtaatgatagcacgttaaagtcttgtactgttacatatgctgataaccctagtagtaagatggtttgcacgtatatggatctccttcttgacgattttgtcagcattcttaaatcgttggatttgagtgttgtatctaaagttcatgaagttatggtcgattgtaaaatgtggaggtggatgttgtggtgtaaggatcataaactccagacattttatccgcaacttcaggccagtgaatggaaatgtggttattccatgccttctatttacaagatacaacgtatgtgtttagaaccttgcaatctctataactatggtgctggtattaagttacctgatggcattatgtttaacgtagttaaatatacacagctttgtcaatatcttaatagcaccacaatgtgtgtaccccatcacatgcgcgtgctacatcttggtgctggctccgacaagggtgttgcacctggcacggctgtcttacgacgttggttgccactggatgccattatagttgacaatgatagtgtggattacgttagcgatgctgattatagtgttacgggagattgctctaccttatacctgtcagataagtttgacttagttatatctgatatgtatgatggtaagattaaaagttgtgatggggagaacgtgtctaaagaaggcttctttccctatattaatggtgtcatcactgaaaagttggcacttggtggtactgtagctattaaggtgacggagtttagttggaataagaagttgtatgaactcattcagaggtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacactcagcctaccacaagatgtcactaggtgccagtccactattaacttcaggcggttcttttcaaaatttaatgtgcaggcacctgctgtcgttgtgttgggtggttatctacctagtatgaactcctctagctggtactgtggcacaggtcttgaaactgctagtggcgtgcatggtattttcctcagttacatcgattctggtcagggctttgagattggcatttcacaggagccgtttgatcctagtggttaccagctttatttacataaggccactaatggtaaccataatgctattgcacgactgcgcatttgccagtttccagataataaaacattgggccctactgttaatgatgttacaacaggtcgtaactgcctattcaacaaagccattccagcttatatgcaggatggaaaaaatatcgttgtcggcataacatgggacaatgatcgtgtcactgtttttgctgacaagatctatcatttttatcttaaaaatgattggtcccgtgttgcgacaagatgttacaataaaagaagttgtgctatgcaatatgtttatacacctacctactacatgcttaatgttactagtgcaggtgaggatggcatttattatgaaccatgtacagctaattgcagtggttacgctgccaatgtgtttgccactgattctaatggccacataccagaaggttttagttttaataattggtttcttttgtccaatgattccactttgttgcatggtaaggtggtttccaaccaacctttgttggtcaattgtcttttggccattcctaagatttatggactaggccaatttttctcattcaatcaaacgatggatggcgtttgtaatggagctgctgcgcagcgtgcaccagaggctctgaggtttaatattaatgacacctctgtcattcttgctgaaggctcaattgtacttcatactgctttaggaacaaatctttcttttgtttgcagtaattcttcagatcctcatctagctaccttcgccatacctctgggtgctacccaagtaccttattattgttttcttaaagtggatacttacaactccactgtttataaatttttggctgttttacctcctactgtcagggaaattgtcatcaccaagtatggtgatgtttatgtcaatgggtttggatacttgcatctcggtttgttggatgctgtcacaattaatttcactggtcatggcactgacgatgatgtttctggtttttggaccatagcatcgactaattttgttgatgcactcatcgaagttcaaggaaccgccattcagcgtattctttattgtgatgatcctgttagccaactcaagtgttctcaggttgcttttgaccttgacgatggtttttaccctatttcttctagaaaccttctgagtcatgaacagccaatttcttttgttactctgccatcatttaatgatcattcttttgttaacattactgtatctgcttcctttggtggtcatagtggtgccaaccttattgcatctgacactactatcaatgggtttagttctttctgtgttgacactagacaatttaccatttcactgttttataacgttacaaacagttatggttatgtgtctaaatcacaggacagtaattgccctttcaccttgcaatctgttaatgattacctgtcttttagcaaattttgtgtttccaccagccttttggctagtgmctgtaccatagatctttttggttaccctgagtttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctagctccacttttaacagcactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccattagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttactctcgactggacattctttcagccgatgttcaggttgaccgtctcatcaccggcagattatcagcacttaatgcttttgttgctcaaaccctcactaagtatactgaggttcaggctagcaggaagttagcacagcaaaaggttaatgagtgcgttaaatcgcaatctcagcgttatggtttttgtggtggtgatggcgagcacattttctctctggtacaggcagcacctcagggcctgctgtttttacatacagtacttgtaccgagtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatcttaatctcactggtgaaattgcagatttagagcagcgttcagagtctctccgtaatactacagaggagctccaaagtcttatatataatatcaacaacacactagttgaccttgagtggctcaaccgagttgagacatatatcaagtggccgtggtgggtttggttgattattttcattgttctcatctttgttgtgtcattactagtgttctgctgcatttccacgggttgttgtggatgctgcggctgctgctgtgcttgtttctcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatttttaatactacgacactttctttcctcaatggtaaagcagcttattatgacggcaaatccattgtgattttagaaggtggtgaccattacatcacttttggcaactcttttgttgcttttgttagtagcatcgacttgtatctagctatacgtgggcggcaagaagctgacctacagctgttgcgaactgttgagcttcttgatggcaagaagctttatgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattactttcgtccaattggttaatctgtgcttcacttgtcaccggttgtgtaatagcgcagtttacacacctatagggcgtttgtatagagtttataagtcttacatgcaaatagaccccctacctagtactgttattgacgtataaacgaaatatgtctaacggttctattcccgttgatgaggtgattcaacaccttagaaactggaatttcacatggaatatcatactgacgatactacttgtagtgcttcagtatggccattacaagtactctgcgttcttgtatggtgtcaagatggctattctatggatactttggcctcttgtgttagcactgtcactttttgatgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagccaattattccaaatttctctcaacagcttcccagcgtagttgagattgttgaacctaacacacctcctacttcacgtgcaaattcacgtagcaggagtcgtggtaatggcaactacaggtccagatctccaagtaacaacagaggcaataaccagtcccgcggtaattcacagaatcgtggaaataaccagggtcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaattaaacaatgtttgactggcttatcctggctatgtcccagggtagtgccattacactgttattactgagtgtttttctagcgacttggctgctgggctatggctttgccctctaactagcggtcttggtcttgcacacaacggtaagccagtggtaatgtcagtgcaagaaggatattaccatagcactgtcatgaggggaacgcagtaccttttcatctaaacctttgcacgagtaatcaaagatccgcttgacgagcctatatggaagagcgtgccaggtatttgactcaaggactgttagtaactgaagacctgacggtgttgatatgga

SEQ ID NO: 23 - DNA, 27994 bp, Porcine epidemic diarrhea virus
acttaaaaagattttcattctacggatagttagttctttttctagaccttgtctactcaattcaactaaacgaaattttgtccttccggccgcatgttcatgctgctggaagctggcgtggaatttcgttaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgccggctatggctagcaaccatgtcacattggcgtttgccaatgatgcagaaatttcggcttttggcttttgcactgctagtgaagccgtctcatactattctgaggccgccgctagtggatttatgcaatgccgttttgtgtccctcgatctcgctgacactgttgagggattgcttcctgaagactatgtcatggtggtgatcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagatttcttcgctgactccgaagacggtcaactcaacattgctgggatcacttatgtgaaggcctggattgtagagcgatcggacgtctcttatgcgagtcagaatttaacatctattaagtctattacttactgttcaacctatgagcatacttttcttgatggtactgccatgaaggttgcatgtactccaaagatcaagaagaatgttgttttgtctgagccacttgctactatctacagggaaattggttccccttttgtggataatgggagcgatgctcgttctatcattaggagaccagtgttcctccacgcttttgttaagtgtaagtgtggtagttatcattggactgttggtgattggactttctatgtctccacttgctgtggctttaagtgcaagccagtccttgtgtcctcatgctctgctatgcctggttctgttgtggtcacacgcgctggtgctggcactggtgttaagtactacaacaacatgttcctgcgccatgtggctgacattgatggattggcattctggcgaattcttaaggtgtagtccaaagacgacctcgcttgctctggtaagttccttgaacaccatgaggaaggtttcacagacccttgctactttttgaatgattcgagccttgctactaagcttaagttcgacatccttagtggcaagttttctgatgaagtcaaacaagctatcattgctggtcatgttgttgttggcagtgcactcgttgacattgttgacgatgcactgggacaaccttggttcatacgtaagcttggtgaccttgcaagtgcaccttgggagcagcttaaggctgtcgttagaggccttggcctcttgtctgatgaggttgtgctctttggcaaaagacttagctgtgccactcttagtatcgttaacggcgtttttgagtttctcgccgatgtgccagagaagttggctgcggctgttacagtttttgtcaacttcttgaatgagttctttgagtctgcctgtgactgcttaaaggtcggaggtaagacattcaacaaggttggttcctatgttctttttgacaatgcattggttaagcttgtcaaggcaaaagctcgcggcccacgacaggcaggtatttgtgaagttcgctacacaagcctggttgttgggagtactaccaaggtggtttccaagcgcgttgaaaatgccaatgtgaatctcgtcgtcgttgacgaggatgtaaccctcaacaccactggtcgtacagttgtcgttgatggacttgcattcttcgagagtgacgggttttacagacatcttgctgatgctgacgctgtcatcgaacatcctgtttataagtctgcctgtgagctcaagccagtttttgagtgtgacccaatacctgattttcctttgcctgtggccgctagtgttgcagagctctgtgtgcaaaccgatctgttgcttaaaaattacaacactccttataaaacttacagctgcgtagtgagaggtgataagtgttgcatcacttgcaccttacagttcaaagcaccaagttatgtggaggatgctgttaattttgtagacctatgtaccaagaacattggtactgctggttttcatgagttttacataacggcccatgaacaacaggatctgcaagggtttttaaccacttgttgcacgatgtcaggttttgagtgttttatgcctacaatcccacagtgtccagcagtgcttgaagagattgatggtggtagcatatggcggtcttttatcactggtcttaatacaatgtgggatttttgcaagcgtcttaaagtcagctttggactggatggcattgttgtcactgtagcacgcaaatttaaacgacttggtgctcttttggcagaaatgtataacacttatctttcaactgtggtggaaaacttggtactggccggtgttagcttcaagtattatgccaccagtgtcccaaaaattgttttgggcggttgttttcacagtgttaaaagtgtttttgcaagtgtcttccagattcctgtccaggcaggcattgagaagtttaaagttttccttaactgtgttcaccctgttgtaccacgtgtcattgaaacttcttttgtggtattagaagagacgacatttaaaccaccagcactcaatggtggtattgctattgtagatggcttcgctttctattatgatggaacactatactatcccaccgatggtattagtgttgtgcctatctgttttaagaagaaaggtggtggtgatgttaaattctctgatgaagtctctgttaaaaccattgatccagtttataaggtctcccttgaatttgagttcgagtctgagactattatggctgtgcttaataaggctgttggtaatcgtatcaaggttacaggtggttgggatgatgtcgttgagtatattaacgttgccattgaggttcttaaagatcacgttgaagtgcctaagtactacatctatgatgaggaaggtggcactgatcctaatctgcccgtaatggtttctcagtggccgttgaatgatgacacgatctcacaggacctgcttgatgtggaagttgttacggatgcaccaattgattccgagggtgatgaagtagactcctctgcacctgagaaggtggcagatgtggctaactctgaacctggggatgatggtcttcctgtggcacctgaaacaaatgtagagtctgaagttgaggaagttgccgcaaccttgtcctttattaaagatacaccttctacagttaaggacccttttgcttttgactttgtaagctacggaggacttaaagttttaagacaatctcataacaattgttgggttacttctaccttggtgcagctacaattgcttggcatcgttgatgaccctgcaatggaactttttagtgctggtagagttggtccaatggttcgcaaatgttatgagtcacaaaaggctattttgggatctttgggtgatgtgtcggcttgcctagagtctctgactaaggacctacacacacttaagattacctgttctgtagtctgcggttgtggtactggtgaacgtatctatgagggttgtgcttttcgtatgacgccaactttggaaccgtttccatatggtgcttgtgctcagtgtgctcaagttttgatgcacacttttaaaagtattgttggcaccggcatcttttgccgagatactactgctctctccttggattttttggttgtaaaacctctttgtgcggctgcttttataggcagggatagtggtcattatgtcaccaatttttatgatgctgctatggctattgatggttatggtcgtcatcagataaagtatgacacactgaacaccatttgtgttaaagacgtgaattggacagcacctcttgtccctgccgttgattctgtagtggagcctgttgtcaaaccattctattcttataagaatgttgatttttaccaaggagattttagtgaccttgttaaacttccatgtgactttgttgttaatgctgcaaatgagaagttgtctcatggtggcggcatagcaaaggccattgatgtttataccaagggcatgttgcagaagtgttcaaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaactcaggtgttgctcttacacctttgattagtgttggaatttttagtgttcctttggaagaatctttatctgcttttcttgcatgtgttggtgatcgccactgtaagtgcttttgttatggtgacaaagagcgcgaggcgatcattaagtacatggatggcttggtagatgctattttcaaagaggcgcttgttgacactactcctgtccaggaagatgttcaacaagtttcacaaaaaccagttttgcctaattttgaacctttcaggattgaaggtgctcatgctttctatgagtgcaaccctgaaggtttgatgtccttaggtgctgacaagctggtgttgtttacaaattccaatttagatttttgtagtgttggtaagtgtcttaacgatgtgaccagcggtgcattgcttgaagccataaatgtatttaaaaagagtaacaaaacagtgcctgctggcaactgtgttactttagcttgtgcaaatatgatttctattactatggtagtattgccatttgatggtgatgctaattatgacaaaaattatgcacgcgccgttgtcaaagtatctaagcttaaaggcaagttagtgcttgctgttgatgatgccacgttgtattccaagttgtcccacctcagcgtgttaggtttcgtgtccacacctgacgatgtggagcgtttctacgcaaataagagtgtggttattaaagtcactgaggatacacgtagtgtcaaggctgttaaagtagaatccactgctacttatggacaacaaattggaccttgtcttgttaatgacaccgttgtcacagacaacaaacctgttgtcgctgacgttgtagctaaggttgtaccaaatgctaattgggattcacattatggttttgataaggccggtgagttccacatgctagaccatactgggtttacctttcctagcgaagttgttaacggtaggcgtgtgattaaaaccacagataataattgttgggttaatgtcacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgttcctgctggttctgtcactattgaacgtgtcacgcatgacggctgttgttgtagtaagcgtgttgttactgcaccagttgtgaatgctagtgtgttgaagcttggcgtcgaggatggcctttgtccacatggtcttaactacattggcaaagttgttgtagttaaaggtactacaattgttgtcaatgtaggaaaacctgtagtggcaccatcacacctctttcttaagggtgtatcctacacaacattcctagataatggtaacggtgtcggccattatactgtttttgatcatggcactggtatggtgcatgatggcgatgcttttgtaccgggtgatcttaatgtatctcctgttacaaatgttgttgtctcagagcagacggctgttgtgattaaagaccctgtgaagaaagcagagttagacgctactaagctgctcgacactatgaattatgcatcggaaagatttttttcctttggtgatttcatgtcacgtaatttaattacagtgtttttgtacatccttagcattttgggtctctgttttagagcctttcgtaagagagatgttaaagttctagctggtgtaccccaacgtactggtattatattgcgtaaaagtatgcgctataatgcaaaggcgttgggtgtctttttcaagctaaagctttattggttcaaagttcttggtaagtttagtctgggtatttatgcattgtatgcattactattcatgacaatacgctttacacctataggtagccccgtctgtgatgatgttgttgctggttatgctaattctagttttgacaagaatgagtactgcaacagtgttatttgtaaggtctgtctctatgggtaccaggaactctcggacttctcccacacacaggttgtatggcaacatcttagagacccattaattggtaatgtgatgcctttcttttatttggcatttttggcaatttttgggggtgtctatgtaaaggctattactctctattttattttccagtaccttaatagtcttggtgtgtttttgggcctacagcagtccatttggtttttgcagctcgtgccttttgatgtctttggtgatgagatcgtcgtctttttcatcgttacacgcgtattgatgttcattaagcatgtttgccttggctgcgataaggcatcttgtgtggcttgctctaagagtgctcgccttaagcgcgctcctgtccagactatctttcagggtactagtaaatccttctacgtacatgccaatggtggttctaagttctgtaagaagcacaatttcttttgtttaaattgtgattcttatggtccaggctgcacttttattaacgacgtcattgcaactgaagttggtaatgttgtcaaacttaatgtgcaaccgacaggtcctgccactattcttattgacaaggttgaattcagtaatggtttctactatctttatagtggtgacacattttggaagtacaactttgacataacagatagcaaatacacttgcaaagaggcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagtttcggcaaagacctgtcaagttgtaatgacatgcaggattgcaagagcacattgggttttgatgatgtaccattggatacctttaatgctgctgttgctgaggctcatcgctatgatgtcctcttgactgacatgtcattcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataacatttatgttgacctttaatgattgtcgtatgcatactaccatacctactgtttgcattgcaaataagaagggtgcgggtcttcctagtttttcaaaggttaagaaattcttttggtttttgtgtctgttcatagttgctgctttctttgcactaagctttcttgattttagtactcaggttagcagtgatagcgattatgatttcaagtatattgagagtggccagttgaagacttttgacaatccacttagttgtgtgcataatgtctttattaacttcgaccagtggcatgatgccaagtttggtttcacccccgtcaacaatcctagttgtcctatagttgttggtgtatcagacgaagctcgcactgttccaggtatcccagcaggtgtttatttagctggtaaaacacttgtgtttgctattaacaccatttttggtacatctggtttgtgcttcgatgctagtggcgttgctgataagggcgcttgcatttttaattcagcttgcaccacattatctggtttgggtggaactgctgtctactgttacaagaatgggctagttgaaggtgccaaactttatagtgagttggcacctcatagctactataaaatggtagatggtaatgctgtgtctttacctgaaattatttcacgcggctttggcatccgtactatccgtacaaaggctatgacttattgccgtgttggccagtgtgtgcagtctgcagaaggcgtttgttttggcgccgatagattctttgtctataatgcagaatctggttctgactttgtttgtggcacagggctcttcacattgttgatgaacgttattagtgttttttccaagacagtaccagtaactgtgttgtctggtcaaatactttttaattgcattattgcttttgttgctgttgcggtgtgtttcttatttacaaagtttaagcgcatgttcggtgatatgtctgttggcgttttcactgtcggtgcttgtactttgttgaacaatgtttcttacattgtaacacagaacacacttggcatgttgggctatgcaattttgtatttcttgtgcactaagggtgttagatatatgtggatttggcacttgggatttttgatctcatatattcttattgcaccatggtgggttttgatggtttatgccttttcagccatttttgagtttatgcctaacctttttaagcttaaggtttcaacacaactttttgagggcgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcataacgatacgttatacacaccacccactgtgagttacaattcaactctacaggctggcttgcgtaagatggcacaaccttctggtgttgttgagaagtgcatagtccgtgtttgctatggtaatatggctcttaatggcctatggcttggcgatattgttatgtgcccacgccatgttatagcgtctagtactactagcactatagattatgattatgccctttctgttttacgcctccacaacttctccatttcatctgggaatgttttcctaggtgttgtgagtgcaactatgcgaggtgctttgttgcagataaaggttaatcaaaacaatgtccacacgcctaagtacacctatcgcacagttagaccgggtgaatcttttaatattttggcgtgctatgatggtgctgcagctggtgtttacggcgttagcatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggatcgctgtagacaggtttaatgagtgggctgttcataatggtatgacaacagtgggcaatactgattgcttttctattcttgctgctaagactggagttgatgtacaacgtttgttggcctcaatccagtctctgcataagaattttggtggaaagcaaattcttggccatacctcgttgacagatgagtttactacaggtgaagttgtacgtcaaatgtatggcgttaatcttcagggtggctatgtgtcacgcgcctgcagaaatgtcttgctggttggttcttttctgactttcttttggtcagaattagtttcctacactaagttcttctgggtaaatcctggttatgttacacctatgtttgcgtgtttgtcattgctatcctcacttttgatgttcacactcaagcataagacattgtttttccaggtcttcttaatacctgctctgattgttacatcttgcattaatttggcatttgatgttgaagtctacaactatttggcagagcattttgattaccatgtttcccttatgggttttaatgcacaaggtcttgttaacatctttgtctgctttgttgttaccattttacacggcacatacacatggcgcttctttaatacacctgcgagttctgtcacttatgtggtagctttgctgactgcggcctataactatttttacgctagtgacattcttagttgtgctatgacactatttgctagtgtgactggcaactggttcgttggtgctgtttgttataaagttgctgtgtatatggccttgagatttcctacgttcgtggctatttttggtgatattaagagtgttatgttctgttaccttgtgttgggttattttacctgttgcttctacggtattctctactggttcaacaggttctttaaggttagtgtaggtgtctatgactatactgttagtgctgctgagtttaagtatatggttgctaatggcctacctgcaccaactggaacacttgattcactactgttgtccgccaaattgattggtattggtggtgagcggaatattaagatttcttccgttcagtctaaactgactgatattaagtgtagtaacgttgtgcttttaggctgtctttctagcatgaatgtttcagcaaattcaacagaatgggcttattgtgttgacttgcataacaagatcaacttgtgtaatgacccagaaaaagcgcaggaaatgctacttgctttgttggcatttttccttagtaagaatagtgcctttggtttagacgacttattggaatcttattttaatgacaatagtatgttgcagagtgttgcatctacttatgtaggtttgccctcctatgtcatttatgaaaatgcacgccaacagtatgaagatgctgttaataatggttctccacctcagttggttaagcaattgcgccatgctatgaatgtagcaaagagcgaatttgaccgtgaggcttctactcagcgtaagcttgatagaatggcggaacaggctgcagcacagatgtataaagaggcaagggcagttaataggaagtccaaagttgtaagtgctatgcattcactgctttttggtatgttgagacgtttggatatgccttctgtagacaccattctcaacttggcaaaggatggggtggtacctctgtctgtcataccggcagtcagtgctactaagcttaacattgttacctctgatatcgattcttataatcgtacccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgttaagctccagaataatgagattattcctggtaagctgaagcagcgctccattaaggcagaaggagatggcatagttggagaaggtaaggcactttacaataatgagggtggacgtacttttatgtatgctttcatttcagataaaccggacctgcgtgtagttaagtgggagttcgatggtggttgtaacactattgagctagaaccaccacgtaagttcttggtggattctcctaatggtgcacagatcaagtatctctactttgttcgtaaccttaacacgttgcgtaggggtgctgttcttggctacataggtgccactgtacgcttgcaggctggtaaacaaacagaacaggctattaactcttcattgttgacactttgcgctttcgctgtggatcctgctaagacctacatcgatgctgttaaaagtggtcacaaaccagtaggtaactgtgttaagatgttggccaatggttctggtaatggacaagctgttactaatggtgtggaggctagtactaaccaggattcatatggtggtgcttccgtgtgtctatattgtagagcacatgttgagcatccatctatggatggtttttgcagactgaaaggcaagtatgtacaggtgccactaggtacagtggatcctatacgttttgtacttgagaatgacgtttgcaaggtttgtggttgttggctgtctaatggctgcacttgtgacagatccattatgcaaagcactgatatggcttatttaaacgagtacggggctctagtgcagctcgactagagccctgtaatggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggggccatagccgaacacgatttcttcacttggaaggatggtcgtgcaatctatggtaacgtttgtagaaaggatcttaccgagtatactatgatggatctgtgttacgctttacgtaactttgatgaaaacaattgcgatgttcttaagagcattttgattaaggtaggtgcttgtgaggagtcctactttaataataaagtctggtttgaccctgttgaaaatgaagacattcatcgtgtctatgcattgttaggtaccattgttgcacgtgctatgcttaaatgcgttaagttctgtgatgcaatggttgaacaaggtatagttggtgttgtcacattagataatcaggatcttaatggtgatttttatgattttggtgattttacttgtagtatcaagggaatgggtgtacccatttgcacatcatattactcttatatgatgcctgttatgggtatgactaattgccttgctagtgagtgttttgttaagagtgatatatttggtgaggattttaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactaccatacctattacggcatttggacctttgtgtcgcaagtgctggattgatggtgttccactggtaactacagctggttatcattttaaacagttaggtatagtttggaataatgacctcaacttacactctagcaggctctctattaatgaattactccagttttgtagtgatcctgcactgcttatagcatcatcaccagcccttgttgaccagcgtactgtttgcttttcagttgcagcgctaggtacaggtatgactaaccagactgtgaaacctggccatttcaataaggagttttatgacttcttacttgagcaaggtttcttctctgagggctctgagcttactttaaagcacttcttctttgcacagaaggttgatgcagctgttaaggattttgactactataggtataatagacccactgttctggacatctgccaagctcgcgtcgtgtatcaaatagtgcaacgctattttgatatttacgagggtggttgtatcactgctaaagaagtggttgttacaaaccttaacaagagcgcaggctatcctttgaacaagtttggtaaagctggtctttactatgagtctttatcctatgaggaacaggatgaactttatgcttatactaagcgtaacatcctgcccactatgacacagctcaaccttaaatacgctattagtggcaaagaacgtgcacgcacagtgggtggtgtctcgcttttgtcaaccatgaccactcggcagtatcatcagaaacaccttaaatccatagttaatactaggggcgcttcggttgttattggtactactaagttttatggtggttgggacaatatgcttaagaaccttattgatggtgttgaaaatccgtgtcttatgggttgggattacccaaagtgcgatagagcactgcccaatatgatacgcatgatttcagccatgatcttaggctctaagcacaccacatgctgcagttctactgaccgctttttcaggttgtgcaatgaattggctcaagtccttactgaggttgtttattctaatggagggttttatttgaagccaggtggtactacctctggtgatgcaaccaccgcatatgcaaactcagttttcaatatcttccaagcagtaagtgccaatgttaacaaacttcttagtgttgacagcaatgtctgtcataacttagaagttaagcaattacaacgtaagctctatgagtgctgttatagatcgactatcgtcgatgaccagttcgtcgttgagtattatggttacttgcgtaaacatttttcaatgatgattctttctgatgatggcgttgtttgttataacaatgactatgcatcacttggttatgtcgcggatcttaacgcattcaaggctgttttgtattaccagaacaacgtcttcatgagcgcctctaaatgttggatcgagcctgacattaataaaggtcctcatgaattttgttcgcagcatactatgcagattgtcgataaggagggtacttattaccttccttaccctgatccttcaagaatcctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtataaaactttgaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaaccaagctctacttaggtggtcttagttactggtgtcatgaacacaagccacgtcttgcattcccgttgtgctctgctggtaatgtttttggcttatacaaaaattctgctaccggttcacccgatgttgaagactttaatcgcattgctacatccgattggactgatgtttctgactacaggttggcaaatgatgtcaaggactcattgcgtctatttgcagcggaaactatcaaggccaaggaggagagcgttaagtcatcctatgcttgtgcaacactacatgaggttgcaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgacgctgtaacatataaaactaccgccacaacaaaacttgttcctggcatggtttttgtgcttacctcacataatgttcagccattgcgtgcaccaaccattgctaatcaagaacgttattccactatacataagttgcatcctgcttttaacatacctgaagcttattctagcttagtgccctattaccaattgattggtaagcagaagattacaactatccagggaccccccggtagtggtaaatctcactgtgttatagggctaggtttgtactatccaggtgcacgtattgtgtttacagcttgttctcatgcagcggtcgattcactctgtgtgaaggcctccactgcttatagcaatgacaaatgttcacgcatcataccacagcgtgctcgtgttgagtgttatgatggtttcaagtctaataatactagtgctcagtaccttttctccactgtcaatgctttgccagagtgtaatgcggacattgttgtggtggatgaagtttctatgtgcactaattatgacttgtctgtcataaatcagcgcatcagctataggcatgtagtctatgttggtgaccctcaacagctgcctgcaccacgtgttatgatttcacgtggtactttggaaccaaaggactacaatgttgtcactcaacgtatgtgtgcccttaagcctgatgtcttcttgcacaagtgttatcgctgtcctgcagagatagtgcgcactgtgtctgagatggtctatgaaaaccaattcattcctgtgcaccctgacagcaagcagtgttttaagatcttttgcaagggtaatgtgcaggttgataacggttcaagtattaaccgtaggcaattggatgttgtgcgtatgtttttggctaaaaatcctaggtggtcaaaggctgttttcatttccccttataacagccagaattatgttgccagccgtttgctaggtttacaaattcagacagttgattcatcccagggtagtgagtatgactatgtcatttacgcacaaacctcagatactgcccatgccagtaatgttaacaggtttaatgttgccatcacaagggctaagaaaggcatattatgtataatgtgcgataggtccctttttgatctgcttaaattttttgagcttaaattgtctgatttgcaggctaatgagggttgtggtctttttaaagactgtagcagaggtgatgatttgttgccaccgtctcatgctaataccttcatgtctttagcggacaattttaagactgatcaatatcttgctgttcaaataggtgttaatggacccattaaatatgagcatgttatctcgtttatgggtttccgttttgatattaacatacccaaccaccacactctcttttgcacacgcgactttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactacattaaacccgtcagagctcgtgctccaccaggggaacaattcgcacaccttttgcctttacttaaacgcggccaaccatgggatgtggttcgcaagcgtatagttcaaatgtgtagtgactacctggctaacctatcagacatactaatttttgtgttgtgggctggtggtttggagttgacaactatgcgttacattgtcaagattggaccaagcaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgcattgtgcaatcacgcactatgcgttcagttcttaagttatacaatccaaaagccatatatgatattggcaatcctaagggcattagatgcgccgtaacggatgctaagtggttctgctttgacaagaatcctactaattctaatgtcaagacattggagtatgactatataacacacggccaatttgatgagttgtgcttgttttggaattgcaatgtggacatgtatccagaattttctgtggtctgtcgttttgatactcgctgtaggtcaccactcaacttggagggttgtaatggtggttcactgtatgttaacaatcatgcattccacacaccggcttttgacaagcgtgcttttgctaagttgaagccaatgccatttttcttctatgatgatactgagtgtgacaagttacaggactccataaactatgttcctcttagggctagtaactgcattactaaatgtaatgttggtggagctgtttgtagtaagcattgtgctatgtatcatagctatgtcaatgcttacaacacctttacgtcagcgggctttacgatttgggtgcccacttcgtttgacacctataatctgtggcagacatttagtaacaatttacaaggtcttgagaacattgctttcaatgttttaaagaaaggatcttttgttggtgatgaaggtgagcttcctgtagctgtggtcaatgacaaagtgctcgttagagatggtactgttgatactcttgtttttacaaacaagacatcactacccactaacgtagcttttgagttgtatgccaagcgtaaggtaggactcacccctcccattacgatcctacgtaacttgggtgttgtttgtacatctaagtgtgtcatttgggactatgaagccgaacgtccacttactacttttacaaaggatgtctgtaaatataccgactttgagggtgacgtttgtacactctttgataacagcattgttggttcattagagcgattctctatgacccagaatgctgtgcttatgtcacttacagctgttaaaaagcttactggcataaagttaacttatggctatcttaatggtgtcccagttaacacacatgaagataaaccttttacttggtatatttacactaggaagaacggcaagttcgaggactatcctgatagctattttacccaaggtagaacaaccgctgattttagccctcgtagcgacatggaaaaggacttcctaagtatggatatgggtttgtttattaacaagtacggacttgaagattacggctttgagcacgttgtgtatggtgatgtttcaaaaaccacccttggtggtttacatctactaatttcgcaggtgcgtctggcctgtatgggtgtgcttaaaatagacgagtttgtgtctagtaatgatagcacgttaaagtcatgtactgttacatatgctgacaaccctagtagtaagatggtttgcacgtatatggatctcctgcttgacgattttgttagcattcttaaatctttggatttgagcgttgtatctaaggttcatgaagttatggttgattgtaaaatgtggaggtggatgttgtggtgtaaggatcataaactccagacattttatccacaacttcaagccagtgaatggaagtgtggttattccatgccttctatttacaagatacaacgtatgtgcttagaaccttgcaatctctataactatggtgctggtgttaagttacctgatggcattatgtttaacgtagttaaatacacacagctttgtcaatatctcaatagcaccacaatgtgtgtaccccatcacatgcgtgtgctacatcttggtgctggctccgataagggtgttgcacctggcacggctgtcttacgacgttggttgccactggatgccattatagttgacaatgatagtgtggattacgttagcgatgctgattatagtgttacaggagattgctctaccttatacctgtcagataagtttgacttagttatatctgatatgtatgatggtaagattaaaagttgtgatggggagaacgtgtctaaagaaggcttctttccctatattaatggtgttatcactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacaccatgcatgccaattatatcttctggcgtaattccacaattatgactatgtcttacaacagtgtgcttgatttaagcaagttcaattgtaagcataaggctacagttgttgttaatttaaaagactcatccattagtgatgttgtgttaggcttgttgaagaatggtaagttgctagtgcgtaataatgacgccatttgtggcttttctaatcatttggtcaacgtaaacaaatgaggtctttaatttacttctggttgctcttaccagtacttccaacactcagcctaccacaagatgtcactaggtgccagtctactactaactttaggcggttcttttcaaaatttaatgttcaggcacctgccgtcgtcgttttgggtggttacctacctagtatgaactcttctagctggtactgtggcacaggcattgaaactgctagtggcgttcatggtatttttctcagctacatcgattctagtcagggctttgagattggcatttcgcaagagccgtttgatcctagtggttaccagctttatttacataaggccactaatgagagtcagaatggtaacactaatgctattgcacgactgcgcatttgccagtttcccgataataaaacattgggccctactgttaatgatgttacaacaggtcgtaactgcctattcaacaaagccattccagcttatatgcgtgatggaaaagatattgttgtcggcataacatgggataatgatcgtgtcactgtttttgctgacaagatctatcatttttatcttaaaaatgattggtcccgcgttgcgacaagatgttacaatcgcagaagttgtgctatgcaatatgtttatacacctacctactacatgcttaatgttactagtgcaggtgaggatggcatttattatgaaccctgtacagctaattgcactggttacgctgccaatgtatttgccactgattccaatggccatataccagaatgttttagttttaataattggtttcttttatccaatgactccactttgttgcatggtaaagtggtttccaaccaacccttgttggtcaattgtcttttggccattcctaagatttatggactaggccaatttttctcattcaatcacacgatggatggcgtttgtaatggagctgctgtggatcgtgccccagaggctctgaggtttaatattaatgacacctccgtcattcttgctgaaggctcaattgtacttcatactgctttaggaacaaatctttcttttgtttgcagtaattcctcagatcctcatttagccatctttgccatacctctgggtgctactgaagtaccctactattgctttcttaaagtggatacttacaactccactgtttataaattcttggctgttttacctcctactgtcagggaaattgtcatcaccaagtatggtgatgtttatgtcaatgggtttggctatttgcatctcggtttgttggatgctgtcacaattaatttcactggtcatggcactgacgatgacgtttcaggtttctggaccatagcatcgactaattttgttgatgcactcatcgaggttcaaggaacttccattcagcgtattctttattgtgatgatcctgttagccaactcaagtgttctcaggttgcttttgaccttgacgatggtttttaccccatctcttctagaaaccttctgagtcacgaacagccaatttcttttgttactttgccattatttaatgatcattcttttgttaatattactgtctctgcggcttttggtggtcttagtagtgccaatctcgttgcatctgacactactatcaatgggtttagttctttctgtgttgacactagacaatttaccattacactgttttataatgttacaaacagttatggttatgtgtctaaatcacaggatagtaattgtcctttcaccttgcaatctgttaatgattacctgtcttttagcaaattttgtgtttcaaccagccttttggctggtgcttgtaccatagatctttttggttaccctgcgttcggtagtggtgttaagttgacgtccctttattttcaattcacaaaaggtgagttgattactggcacgcctaaaccacttgaaggtatcacagacgtttcttttatgactctggatgtgtgtaccaagtatactatctatggctttaaaggtgagggtattattacccttacaaattctagcattttggcaggtgtttattatacatctgattctggacagttgttagcctttaagaatgtcactagtggtgctgtttattctgtcacgccatgttctttttcagagcaggctgcatatgttaatgatgatatagtgggtgttatttctagtttgtctaactccacttttagcaatactagggagttgcctggtttcttctaccattctaatgacggctccaattgtacagagcctgtgttggtgtatagtaacataggtgtttgtaaatctggcagtattggctatgttccacctcagtatggccaagtcaagattgcacccacggttactgggaatattagtattcccaccaactttagtatgagtattagaacagaatatttacagctttacaacacgcttgttagtgttgattgtgctacatatgtttgtaatggtaactctcgttgtaaacaattactcacccagtacactgcagcatgtaagaccatagagtcagcattacaactcagcgctaggcttgagtctgttgaagttaactctatgcttaccatttctgaagaggctttacagttagctaccatcagttcgtttaatggtgatggatataactttactaatgtgctgggtgcttccgtgtacgatcctgcaagtggcagggtggtacaaaaaaggtctgttattgaagacttgctttttaataaagtggttactaatggccttggtactgttgatgaagactataagcgctgttctaatggtcgctctgtggctgatctagtctgtgcgcagtattactctggtgtcatggtactacctggcgttgttgacgctgagaagcttcacatgtacagtgcgtctctcataggtggtatggcgctaggaggtataactgctgcaacggcattgccttttagctatgctgttcaagcgagactcaattatcttgctttacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaattcgcagggttcagctttgaaccaacttaccgtacagctgcaacacaacttccaagccatttctagttctattgatgacatttattcccgactggacattctttcagccgatgttcaggttgatcgtctcatcaacggcagattatcagcacttaatgcttttgttgcccaaaccctcactaagtatactgaggttcaggctagcaggaagctagcacagcaaaaggttaatgagtgcgtcaaatcgcaatctcagcgttacggtttttgtggtggtgatggcgagcacattttctctctggtacaggccgcacctcagggcctgctgttcttacatacagtacttgtaccgggtgattttgtaaatgttcttgccatcgctggcttatgcgttaatggtgaaattgccttgactctacgcgagcctggcttagtcttgtttacgcatgaacttcaaaattatactgcgacggaatattttgtttcatcgcgacgtatgtttgaacctagaaaacctaccgttagtgattttgttcaaattgagagttgtgtggtcacctatgtcaatctgactagcgaccagctaccagatgtaatcccagattacatcgatgttaacaaaacacttgatgagattttagcttctctgcccaatagaaatggtccaagtctttccctagatgtttttaatgccacttatcctaatcttactggtgaaattgcagatctagagcagcgttcagagtctctccgtaatactacagaagagctccgaagtctcattaacaacatcaacaacacacttgttgaccttgagtggctcaaccgagttgagacatacatcaagtggccgtggtgggtttggttgatcattgttattgttctcatctttgttgtgtcattactagtgttctgctgcatttccacgggttgttgtggatgctgcggttgctgcggtgcttgtttttcaggttgttgtaggggtcctagacttcaaccttacgaagcttgacacagttgtcaaagatgtctcgaagtctgttaacttgtctttggatgctgtccaagagttggagctcaatgtagttccaattagacaagcttcaaatgtgacgggttttcttttcaccagtgtttttgtttacttctttgcactgtttaaagcgtcttctttgaggcgcaattatattatgttggcagcgcgttttgctgtcgtctttctctattgcccacttttatattactgtggtgcacttttagatgcaactattatttgttgcgcacttattggcaggctttgtttagtctgcttttactcctggcgctataaaaatgcgctttttattatctttaatactacgacactttcttttctcaatggtaaagcagcttattatgacggcaaatccattgtgattctagaaggtggcgaccattacatcacttttggcaactcttttgttgctttcgttagtaacattgacttgtatctagctatacgtgggcggcaagaagctgacctacatctgttgcgaactgttgagcttcttgatggcaagaagctttgtgtcttttcgcaacatcaaattgttggcattactaatgctgcatttgactcaattcaactagacgagtatgctacaattagtgaatgataatggtctagtagttaatgttatactttggcttttcgtactctttttcctgcttattataagcattaccttcgtccaattgtttaatctgtgcttcacttgtcaccggttgtgtaatagcgcagtttatacacctatagggcgcctgtatagagtttataagtcttacatgcgaattgaccccctccccagtactgttattcacgtataaacgaaatatgtctaacggttctattcccgttgatgaggtgattatgctagtacttgaacaccttagaaactggaatttcacatggaatatcatactgacgatactacttgtagtgcttcagtatggccattacaagtactctgtgttcttgtatggtgtcaagatggctattctatggatactttggcctcttgtgttggcactgtcactttttgatgcatgggctagcttccaggtcaactgggtctttttcgctttcagcatccttatggcttgcatcactcttatgctgtggataatgtattttgtcaatagcattcggttgtggcgcaggacacattcttggtggtctttcaatcctgaaactgacgcgcttctcactacttctgtgatgggccgacaggtccgcattccagtgcttggagcaccaactggtgtaacgctaacactccttagtggtacattgtttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtcaaaacacggcgactattcagctgtgagtaatccgagtgcggttctcacagatagtgagaaagtgcttcatttagtctaaacagaaactttatggcttctgtcagctttcaggatcgtggccgcaaacgggtgccattatctctctatgcccctcttagggttactaatgacaagcccctttctaaggtacttgcaaacaacgctgtacccactaacaaggggaataaggaccagcaaattgggtactggaatgagcaaattcgctggcgcatgcgccgtggtgagcgaattgaacaaccttccaattggcatttctactacctcggaacaggacctcacggcgacctccgttataggactcgtactgagggtgttttctgggttgctaaagaaggcgcaaagactgaacccactaatttgggtgtcagaaaggcgtctgaaaagccaatcattccaaaattctctcaacagctccccattgtagttgagattgttgaacctaacacacctcctgcttcacgtgcaaattcgcgtagcaggagtcgtggcaatggcaacaataggtctagatctccaagtaacaacagaggcaataaccagtcccgtggtaattcgcagaatcgtggaaataaccagggtcgtggagcttctcagaacagaggaggcaataataataacaataacaagtctcgtaaccagtccaataacaggaaccagtcaaatgaccgtggtggtgtaacatcacgcgatgatctggtggctgctgtcaaggatgcacttaaatctttgggtattggagaaaatcctgacaggcataagcaacagcagaagcctaagcaggaaaagtctgacaacagcggcaaaaatacacctaagaagaacaaatccagggccacttcgaaggaacgtgacctcaaagacatcccagagtggaggagaattcccaagggcgaaaatagcgtagcagcttgcttcggacccagagggggcttcaaaaactttggagatgcggaatttgtcgaaaaaggtgttgatgcgtcaggctatgctcagatcgccagtttagcaccaaatgttgcagcattgctctttggtggtaatgtggctgttcgtgagctagcggactcttacgagattacatacaactataaaatgactgtgccaaagtcagatccaaatgttgagcttcttgtttcacaggtggatgcatttaaaactgggaatgcaaaactccagagaaagaaggaaaagaagaacaagcgtgaaaccacgctgcagcagcatgaagaggccatctacgatgatgtgggtgcgccatctgatgtgacccatgccaatctggaatgggacacagctgttgatggtggtgatacggccgttgaaattatcaacgagatcttcgatacaggaaattaaacaatgttagaccggcttatcctggctatgttccagggtagtgccattacactgttattactgagtgtttttctagcgacttggctgctgggctatggctttgccctctaaccagcggtcttggtcttgcacataacggtaagccagtggtaatgtcagtgcaagaaggatattaccatagcactgtcacgaggggaacgcagtaccttttcatctaaacctttgcacgagtaattaaagatccgcttgacgagcctatatggaagagcgtgccaggtatttgacttaaggactgttagtaactgaagacctgacggtgttgatatggatacac

SEQ ID NO: 24 - DNA, 27931 bp, Porcine epidemic diarrhea virus
acttaaagagattttctatctatggatagttagctctttttctagattcttgtctactcaattcaactaaacgaaattttgtccttccggccgcatgttcatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgtgtggataactagttccgtctagtttgaaaccagtaactgtcggctatggctagcaaccatgtcacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagatttctttgctgactccgaagacggtcaactcaatattgctgggatcacttatgtgaaggcctggattgtagatcgatcggacgtctcttatgcgagtcagaatttaacatctattaagtctattacttactgttcaacctatgagcatacttttcctgatggtactgccatgaaggttgcacgtactccaaagatcaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcytatgtctccacctgctgtggctttaagtgcaagccagtccttgtggcctcatgctctgctacgcctggttctgttgtggttacacgcgctggtgctggcactggtgttaagtactacaacaacatgttcctgcgccatgtggcagacattgatggattggcattctggcgaattcttaaggtgcagtccaaagacgacctcgcttgctctggtaaattccttgaacaccatgaggaaggtttcacagacccttgctactttttgaatgactcgagccttgctactaagctcaagtttgacatccttagtggcaagttttctgatgaagtcaaacaagctatctttgctggtcatgttgttgttggcagtgcgctcgttgacattgttgacgatgcactgggacaaccttggtttatacgtaagcttggtgaccttgcaagtgcagcttgggagcagcttaaggctgtcgttagaggccttaacctcttgtctgatgaggttgtgctctttggcaaaagacttagctgtgccactcttagtatcgttaacggtgtttttgagtttctcgccgatgtgccagagaagttggctgtggctgttacagtttttgtcaacttcttgaatgagctctttgagtctgcctgtgactgcttaaaggtcggaggtaagaccttcaacaaggttggctcttatgttctttttgacaatgcattggttaagcttttcaaggcaaaagttcgcggcccacgacaggcaggtatttgtgaagttcgttacacaagcctggttattgggagtactaccaaggtggtttccaagcgcgttgaaaatgccaatgtgaatctcgtcgtcgttgatgaggatgtgaccctcaacaccactggtcgtacagttgttgttgatggacttgcattcttcgagagtgacgggttttacagacatcttgctgatgctgacgttgtcattgaacatcctgtttataagtctgcttgtgagctcaagccagtttttgattgtgacccaatacctgattttcctatgcctgtggccgctagtgttgcagagctttgtgtgcaaactgatctgttgcttaaaaattacaacactccttataaaacttacagctgcgtggtgagaggtgataagtgttgcatcacttgcaccttacatttcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagatattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgtcttccagattcctgtccaggcaggcattgagaagtttagagttttccttaattgtgttcaccctgttgtaccacgtgtcattgaaacttcttttgtggaattagaagagacgacatttaaaccaccagcactcaatggtagtattgctattgttgatggcttcgctttctattatgatggaacactatactatcccaccgatggtaatagtgttgtgcctatctgttttaagaagaaaggtggtggtgatgtcaaattctctgatgaagtctctgttaaaaccattgacccagtttataaggtctcccttgaatttgagttcgagtctgagactattatggctgtgcttaataaggctgttggtaatcgtatcaaggttacaggtggttgggatgatgttgttgagtatatcaacgttgccattgaggttcttaaagatcacattgaggtgcctaagtactacatctatgatgaggaaggtggcaccgatcctaatctgcccgtaatggtttctcagtggccgttgaatgatgacacgatctcacaggacctgctcgatgtggaagttgttacggatgcaccaattgattccgagggtgatgaagtagactcctctgaacctgagaaggtggcagatgtggctaactctgaaactgaggctgatgatgtagagtctgaagttgaggaagttgccgcaactttgtcctttattaaagatacaccttccacagttactaaggatccttttgcttttgactttgtaagctatggaggacttaaagttttaagacaatctcataacaactgttgggttacttctaccttggtgcagctacaattgcttggcatcgttgatgaccctgcaatggagctttttagtgctggtagagttggtccaatggttcgcaaatgctatgagtcacaaaaggctattttgggatctttgggtgatgtgtcggcttgcctagagtctttgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgccgagatactactgttatctccttggattctttggttgtaaaacctctttgtgcggctgcttttataggcaaggatagtggtcattatgtcaccaacttttatgatgctgctatggctattgatggttatggtcgtcatcagataaagtatgacacactgaacaccatttgtgttaaagacgtgaattggacagcaccttttgtccctgacgttgagcctgtattggagcctgttgtcaaaccattctattcttataagaatgttgatttttaccaaggagattttaatgaccttgttagacttccatgtgactttgttgttaatgctgcaaatgagaatttgtctcatggtggcggcatagcaaaggccattgatgtttataccaagggcatgttgcagaagtgctcaaatgattatattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagaggtgcttgttgacactattcctgtccaggaagatgttcaacaagtttcacaagaaccagttttgcctaattttgaacctttcaggatcgaaggcgctcatgctttctatgagtgcaaccctgaaggtttgaactccttaggtgctgacaagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagatatggtttctattactatggtagtattgccatctgatggtgatgctaattatgacaaaaattatgcacgcgccgttgtcaaggtatctaagcttaaaggcaagttagtgcttgctgttggtgatgccacgttgtattccaagttgtcccacctcagcgtgttaggtttcgtatccacacctgacgatgtggagcgtttctacgcaaataagagtgtggttattaaagttactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgtcacatgtttacaattacagtttgctagatttaggttcaagtcagcaggtttacaggctatgtgggagtcctattgtactggtgatgttgctatgtttgtgcattggttgtactggcttactggtgttgacaaaggtcagcctagtgattcagaaaatgcacttaacatgttgtccaagtacattgttcctgctggttctgtcactattgaacgtgtcacgcatgacggctgttgttgtagtaagcgtgttgtcactgcaccagttgtgaatgctagcgtgttgaagcttggcgtcgaggatggtctttgtccacatggtcttaactacattgacaaagttgttgtagttaaaggtactacaattgttgtcaatgttggaaaacctgtagtggcaccatcacacctctttcttaagggtgtttcctacacaacattcctagataatggtaacggtgttgtcggccattatactgtttttgatcatggcactggtatggtgcatgatggagatgcttttgtaccgggtgatcttaatgtatcccctgttacaaatgttgttgtctcagagcagacggctgttgtgattaaagaccctgtgaagaaagtagagttagacgctacaaagctgctagacactatgaattatgcatcggaaagattctttttctttggtgatttcatgtcacgtaatttaattacagtgtttttgtacatccttagcattttgggtctctgttttagggcctttcgtaagggggatgttaaagttctagctggtgtaccccaacgtactggtattatattgcgtaaaagtgtgcgctataatgcaaaggcgttgggtgtctttttcaagctaaagctttattggttcaaagttcttggtaagtttagtttgggtatttatgcattgtatgcattactattcatgacaatacgctttacacctataggtagccctgtttgtgatgatgttgttgctggttatgctaattctagttttgacaagaatgagtattgcaacagtgttatttgtaaggtctgtctctatgggtaccaggaactctcggacttctcccatacacaggtagtatggcaacaccttagagacccattaattggtaatgtgatgcctttcttttatttggcatttctggcaatttttgggggtgtctatgtaaaggctattactctctattttattttccagtaccttaacactcttggtgtgtttttgggcctacaacagtccatttggtttttgcagcttgtgccttttgatgtctttggcgacgagatcgtcgtctttttcatcgttacacgcgtattgatgttccttaagcatgttttccttggctgcgataaggtatcttgtgtggcttgctctaagagtgctcgccttaagcgcgttcctgtccagactatctttcagggtactagcaaatccttctacgtacatgccaatggtggttctaagttttgtaagaagcacaatttcttttgtttaaattgtgattcttatggtccaggctgcacttttattaacgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagatagcaaatacacttgcaaagaggcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggygcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgctatgatgtcctcttgactgacatgtcattcaacaattttaccaccagttatgcaaaaccagaggaaaaatttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataacatttatgttgacctttaatgattgtcgtatgcatactaccatacctactgtttgcattgcaaataagaagggtgcaggtcttcctagtttttcaaaggttaagaaattcttttggtttttgtgtctgttcatagttgctgttttctttgcactaagctttcttgattttagtattcaggttagcagtgatagcgattatgatttcaagtatattgagagtggccagttgaagacttttgacaatccacttagttgtgtgcataatgtctttagtaacttcgaacagtggcatgatgccaagtttggtttcacccccgtcaacaatcctagttgtcctatagtcgttggtgtatcagacgaagctcgcactgttccaggtatcccagcaggtgtttatttagctggtaaaacacttgtgtttgctattaacaccatttttggtacatctggtttgtgctttgatgctagtggcgttgctgataagggcgcttgcatttttaattcggcttgcaccacattatctggtttgggtggaactgctgtctactgttacaagaatgggctagttgaaggtgccaaactttatagtgagttggcacctcatagctactataaaatggtagatggtaatgctgtgtctttacctgaaattatttcacgtggctttggcatccgtactattcgtacaaaggctatgacttattgccgtgttggccagtgtgtgcagtctgcagaaggcgtttgttttggcgccgatagattctttgtctataatgcagaatctggttctgactttgtttgtggcacagggctcttcacattgttgatgaacgttattagtgttttttccatgacagtaccagtaactgtgttgtctggtcaaatactttttaattgcattattgcttttgctgctgttgcggtgtgtttcttatttacaaagtttaagcgcatgttcggtgatatgtctgttggcgttttcactgttggtgcttgtactttgttgaacaatgtttcttacattgtaacacagaacacacttggcatgttgggctatgtaactttgtacttcttgtgcactaagggtgttagatatatgtggatttggcacttgggatttttgatctcatatattcttattgcaccatggtgggttttgatggtttatgccttttcagccatttttgagtttatgcctaacctttttaagcttaaggtttcgacacaactttttgagggcgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcataacgatatgttatacacaccacccactgtgagttataattcaactctacaggctggcttgcgtaagatggcacaaccctctggtgttgttgagaagtgcatagtccgtgtttgctatggtaatatggctctcaatggtctatggcttggtgatactgttatgtgcccacgccatgttatagcgtctagtactactagcactatagattatgattatgccctttctgttttacgcctccataacttctccatttcatctgggaatgttttcctaggtgttgtgagtgcaaccatgcgaggtgctttgttgcagataaaggttaatcaaaacaatgtccacacgcctaagtacacccatcgcacagttagaccgggtgaatcttttaatattttggcttgttatgatggtgctgcagctggtgtttacggcgttaacatgcgctctaattacactattagaggctcgttcattaatggcgcttgtggttcacctggttataatattaacaatggtaccgttgagttttgctatttacaccagcttgaacttggttcaggctgtcatgttggtagcgacttagatggtgttatgtatggtggttatgaggaccaacctattttgcaagttgaaggcgctagtagtctgtttacagagaatgtgttggcatttctttatgcagcactcattaatggttctacctggtggcttagttcttctaggatcgctgtagacaggtttaatgagtgggctgttcataatggtatgacaacagtgggcaatactgattgcttttctattcttgctgctaagacaggcgttgatgtacaacgtttgttggcctcaatccagtccctgcataagaattttggtggaaagcaaattcttggctatacctcgttgacagatgagtttactacaggtgaagttatacgtcaaatgtatggcgttaatcttcagggtggttatgtttcacgcgcctgcagaaatgtcttgctggttggttcttttctgactttcttttggtcagaactagtttcctacactaagttcttttgggtaaatcctggttatgttacacctatgtttgcgtgtttgtcattgctgtcctcacttttgatgttcacactcaagcataagacattgtttttccaggtcttcttaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaatacaactgtgagttctgtcacctatgtggtagctttgctgactgcggcatataactatttttatgctagtgacattcttagttgtgctatgacactatttgctagtgtgactggcaactggttcgtcggtgctgtttgttataaagctgctgtgtatatggccttgagatttcctacgtttgtggctatttttggtgatattaagagtgttatgttttgttaccttgtgttaggttattttacctgttgcttctatggtattctctactggttcaacaggttctttaaggttagtgtaggtgtctatgactatactgttagtgctgctgagtttaagtatatggttgctaatggcctacgtgcaccaactggaacacttgattcgctactgctgtctgccaaattgattggtattggtggtgagcggaatattaagatttcttccgttcagtctaaactgactgatattaagtgtagtaacgttgtgcttttaggctgtctttctagcatgaatgtctcagcaaattcaacagaatgggcttattgtgttgacttgcataacaagatcaacttgtgtaatgacccagaaaaagcgcaggaaatgctacttgctttgttggcatttttccttagtaagaatagtgcctttggtttagacgacttattggaatcttattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgctatgaatgtagcaaagagcgaatttgaccgtgaggcttctactcagcgtaagcttgatagaatggcggaacaggctgcagcacagatgtacaaagaggcaagggcagttaataggaagtccaaagttgtaagtgctatgcattcactgctttttggtatgttgagacgtttggatatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgcgggtaccatttggaatataattgatatcaaggacaatgatggcaaggtggtacacgttaaggaggtaaccgcacagaatgctgagtccctgtcatggcccctggtccttgggtgtgagcgtattgttaagctccagaataatgaaattattcctggtaagctgaagcagcgctccattaaggcagaaggagatggcatagttggagaaggtaaggcactttataataatgagggtggacgtacttttatgtatgctttcatttcagataaaccggacctgcgtgtagttaagtgggagttcgatggtggttgtaacactattgagctggaaccaccacgtaagttcttggttgattctcctaatggtgcacagatcaagtatctctactttgttcgtaaccttaacacgttgcgtaggggtgctgttcttggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatatggtggtgcttccgtgtgtctatattgtagagcacatgttgagcatccatctatggatggtttttgcagactgaaaggcaagtacgtacaggtgccactaggtacagtggatcctatacgttttgtacttgagaatgacgtttgcaaggtttgtggttgttggctggctaatggctgcacttgtgacagatccattatgcaaagtactgatatggcttatttaaacgagtacggggctctagtgcagctcgactagagccctgtaacggtaccgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtactaagtctgcgatggaacacgagcaatccatctatagcagacttgaaaagtgtggagccgtagccgaacacgatttcttcacttggaaggatggtcgtgcaatctatggtaacgtttgtagaaaggatcttaccgagtatactatgatggatctgtgttacgctttacgtaactttgatgaaaacaattgcgatgttcttaagagcattttgattaaggtaggtgcttgtgaggagtcctacttcaataataaagtctggtttgaccctgtcgaaaatgaagacattcatcgtgtctatgcattgttaggtaccattgttgcacgtgctatgcttaaatgcgttaagttctgtgatgcaatggttgaacaaggtatagttggtgttgtcacattagataatcaggatcttaatggtgatttttatgattttggtgattttacttgtagtatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataaggcagtactcttcaacaagtatttcaagtattggggactgcaataccaccctaattgtgtggactgcagtgatgagcagtgcatagttcactgtgccaacttcaatacgttgttttccactaccatacctattacggcatttggacctttgtgtcgcaagtgctggattgatggtgttccactggtaactacagctggttatcattttaaacagttaggtatagtttggaataatgacctcaacttacactctagcaggctctctattaatgaactactccagttttgtagtgatcctgcactgcttatagcatcatcaccagcccttgttgatcagcgtactgtttgcttttcagttgcagcgctaggtacaggtatgactaaccagactgtgaaacctggccatttcaataaggagttttatgacttcttacttgagcaaggtttcttctctgagggctctgagcttactttaaagcacttcttctttgcacagaagggtgatgcagctgttaaggattttgattactataggtataatagacccactgttctggacatctgccaagcacgcgtcgtgtatcaaatagtgcaacgctattttgatatttacgagggtggttgtatcaccgctaaagaagtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctattagtggcaaagaacgtgcacgcacagtgggtggtgtctcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggattacccaaagtgcgacagagcactgcccaatatgatacgtatgatttcagccatgatcttaggctctaagcacaccacatgctgcagttctactgaccgctttttcaggttgtgcaatgaattggctcaagtccttactgaggttgtttattctaatgggggtttttatttgaagccaggtggtactacctctggtgatgcaaccaccgcatatgcaaactcagttttcaatatcttccaagcagtaagtgccaatgttaacaaacttcttagtgtcgacagcaatgtctgtcataatttagaagttaagcaattgcaacgtaagctctatgagtgctgttatagatcaactaccgtcgatgaccagttcgtcgttgagtattatggttacttgcgtaaacatttttcaatgatgattctttctgatgatggcgttgtttgttacaacaatgactatgcatcacttggttatgtcgctgatcttaatgcattcaaggctgttttgtattaccagaacaatgtcttcatgagcgcctctaaatgttggattgagcctgacattaataaaggtcctcatgaattttgctcgcagcatactatgcagattgttgataaggatggtacttattaccttccttaccctgatccttcaagaatcctctctgcaggtgtgtttgttgatgacgttgttaaaactgatgcagttgtattgcttgaacgttatgtgtcattggctatagatgcctacccgttatctaagcatgaaaaccctgaatataagaaggtgttttatgtgcttttggattgggttaagcatctgtataaaacgttgaatgctggtgtgttagagtctttttctgtcacacttttggaagattctactgctaaattctgggatgagagcttttatgccaacatgtatgagaaatctgcagttttacaatctgcagggctttgtgtggtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaaccaagctctatttaggtggtcttagttattggtgtcatgaacacaagccacgtcttgcattcccattgtgctctgctggtaatgtttttggcttatataaaaattctgctaccggctcacccgatgttgaggactttaatcgcattgctacatccgattggactgatgtttctgactacaggttggcaaatgatgtcaaggactcattgcgtctatttgcagcagaaactatcaaggccaaggaggagagcgttaagtcatcctatgcttgtgcaacactacacgaggttgtaggacctaaagagttgttgctcaaatgggaagtcggcagacccaaaccacctcttaatagaaattcggttttcacttgttatcatataacgaagaacaccaaatttcaaatcggtgagtttgtgtttgagaaggcagaatatgataatgacgctgtaacatataaaactaccgccacaacaaaacttgttcctggcatggtttttgtgcttacctcacataatgttcagccattgcgtgcaccaaccattgctaatcaagaacgttattccactatacataagttgcatcctgcttttaacatacctgaagcttattctagcttagtgccctattaccaattgatcggtaagcagaagattacaactatccagggacctcccggtagtggtaaatctcactgtgtcatagggctaggtttgtactatccaggtgcacgtattgtgtttgcagcttgttctcatgcagcggtcgattcactctgtgtgaaggcctccactgcttatagcaatgacaaatgttcacgcatcataccacagcgtgctcgtgttgagtgttatgatggtttcaagtctaataatactagtgctcagtaccttttctccactgtcaatgctttgccagagtgtaatgcggacattgttgtggtggatgaggtctctatgtgcactaattacgacttgtctgtcataaatcagcgcatcagctataggcatgtagtctatgttggtgaccctcaacagctgcctgcaccacgtgttatgatttcacgtggtactttggaaccaaaggactacaatgttgtcactcaacgtatgtgtgcccttaagcctgatgtcttcttgcacaagtgttatcgctgtcctgcagagatagtgcgcactgtgtctgagatggtctatgaaaaccaattcattcctgtgcaccctgacagcaagcagtgttttaagatcttttgcaagggtaatgtgcaggttgataacggttcaagcattaaccgcaggcaattggatgttgtgcgtatgtttttggctaaaaatcctaggtggtcaaaggctgtttttatttctccttataacagccagaattatgttgccagccgtgtgctgggtttacaaattcagacagttgattcatcccagggtagtgagtatgactatgtcatttacacacaaacctcagatactgcccatgcctgtaatgttaacaggtttaatgttgccatcacaagggctaagaaaggcatattatgtataatgtgcgataggtccctttttgatgtgcttaaattctttgagcttaaattgtctgatttgcaagctaatgagggttgtggtctttttaaagactgtagcagaggtgatgatctgttgccaccatctcatgctaataccttcatgtctttagcggacaattttaagactgatcaagatcttgctgttcaaataggtgttaatggacccattaaatatgagcatgttatctcgtttatgggtttccgttttgatattaacatacccaaccatcacactctcttttgcacacgcgattttgccatgcgcaatgttagaggttggttgggttttgacgttgaaggagcacatgttgttggctctaacgtcggtacaaatgtcccattgcaattagggttttctaacggtgttgattttgttgtcagacctgaaggttgcgttgtaactgagtctggtgactatattaaacccgtcagagctcgtgctccaccaggggaacaattcgcacaccttttgcctctacttaaacgcggtcaaccatgggatgtggttcgtaagcgtatagtgcaaatgtgtagtgactacctggctaacctatcagacatactaatttttgtgttgtgggctggtggtttggagttgacaactatgcgttactttgtcaagattggaccaagcaagagttgtgattgtggtaaggttgctacttgttacaatagtgcgctgcatacgtactgttgtttcaaacatgcccttggttgtgattacctgtataacccatactgtattgatatacagcagtggggatacaaggggtcacttagccttaaccaccatgagcattgtaatgtacatagaaacgagcatgtggcttctggtgatgccataatgactcgttgtctagccatacatgattgctttgtcaagaacgttgactggtccatcacatacccatttattggtaatgaggctgttattaataagagcggccgaattgtgcaatcacacaccatgcggtcagttcttaagttatacaatccgaaagccatatatgatattggcaatcctaagggcatcagatgtgccgtaacggatgctaagtggttttgctttgacaagaatcctactaattctaatgtcaagacattggagtatgactatataacacacggccaatttgatgggttgtgcttgttttggaattgcaatgtggacatgtatccagaattttctgtggtctgtcgttttgatactcgctgtaggtcaccactcaacttggagggttgtaatggtggttcactgtatgttaacaatcatgcattccatacaccggcttttgataagcgtgcttttgctaagttgaagccaatgccatttttcttctatgatgatactgagtgtgacaagttacatgactccataaactatgttcctcttagggctagtaattgcattactaaatgtaatgttggtggagctgtctgtagtaagcattgtgctatgtaccatagctatgttaatgcttacaacacctttacgtcagcgggctttacgatttgggtgcccacttcttttgacacctacaatctgtggcagacatttagtaacaatttgcaaggtcttgagaacattgctttcaatgtcgtaaagaaaggatcttttgttggtgctgaaggtgagcttcctgtagctgtggttaatgacaaagtgctcgttagagatggtactgttgatactcttgttttcacaaacaagacatcactacccactaacgtagcttttgagttgtatgccaagcgtaaggtaggactcaccccacccattacgatcctacgtaacttgggtgttgtttgtacatctaagtgtgtcatttgggactatgaagccgaacgtccacttactacttttacaaaggatgtctgtaaatataccgactttgagggtgacgtttgtacactctttgataacagcattgttggttcattagagcgattctctatgacccagaatgctgtgcttatgtcacttacagctgttaaaaagctcactggcataaagttaacttatggctatcttaatggtgtcccagttaacacacatgaagataaaccttttacgtggtatatttacactaggaagaacggcaagttcgaggactatcctgatggctattttacccaaggtagaacaaccgctgattttagccctcgtagcgacatggaaaaggacttcctaagtatggatatgggtttgtttattaacaagtatggacttgaagattacggctttgagcacgttgtgtatggtgatgtttcaaaaaccacccttggtggtttacatctactaatttcgcaggtgcgtctggcctgtatgggtgtgcttaaaatagacgagtttgtgtctagtaatgatagcacgttaaagtcatgtactgttacatatgctgacaaccctagtagtaagatggtttgcacatatatggatctcctgcttgacgattttgttagcattcttaaatctttggatttgagcgttgtatctaaggttcatgaagttatggttgattgtaaaatgtggaggtggatgttgtggtgtaaggatcataaactccagacattttatccacaacttcaagccagtgaatggaagtgtggttattccatgccttctatttacaagatacaacgtatgtgcttagaaccttgcaatctctataactatggtgctggtgttaagttacctgatggcattatgtttaacgtagttaaatacacacagctttgtcaatatctcaatagcaccacaatgtgtgtaccccatcacatgcgtgtgctacatcttggtgctggctctgataagggcgttgcacctggcacggctgtcttacgacgttggttgccactggatgccattatagttgacaatgatagtgttgattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgttattactgaaaagttggcacttggtggtactgtagctattaaggtgacggagtttagttggaataagaagttgtatgaactcattcagaagtttgagtattggacaatgttctgtaccagtgttaacacgtcatcgtcagaggcatttttaattggtgttcactatttaggtgattttgcaagtggcgctgtgattgacggcaacaccatgcatgccaattatatcttctggcgtaattccacaattatgactatgtcttacaacagtgtgcttgatttaagcaagttcaattgtaagcataaggctacagttgttgttaatttaaaagactcatccattagtgatgttgtgttaggcttgttgaagaatggtaagttgctagtgcgtaataatgacaccatttgtggcttttctaatcatttggtcaacgtaaacaaatgacgcctttaatttacttctggttgttcttaccagtacttctaacacttagcctaccacaagatgtcactaggtgccagtctactattaactttaggcggttcttttcaaaatttaatgttcaggcacctgccgtcgttgttttgggtggttatctacctagtatgaactcttctagctggtactgtggcacaggcattgaaactgatagtggcgttcatggtatttttctcagttacatcgattctggtcagggctttgagattggcatttcgcaagagccgtttgatcctagtggttaccagctttatttacacaaggccactaatggtaacactagtgctattgcacgactgcgcatttgccagtttccagataataaaacattgggccctactgttaatgatgttacaacaggtcgtaactgcctattcaacaaagccattccagctttgcaggatggaaaaaatattgttgtcggcataacatgggataatgatcgtgtcactgtttttgctgacaagatctatcatttttatattaaaaatgattggtcccgtgttgcgacaagatgttacaataaaagaagttgtgccatgcaatatgtttatacacctacctactacatgcttaatgttactagtgcaggtgaggatggcatttactatgaaccttgtacagctaattgcagtggttacgctgccaatgtatttgccactgattccaatggccatataccagaaggttttagttttaataattggtttcttttgtccaatgactccactttgttgcatggtaaagtggtttcaaaccaacctttgttggtcaactgcctttgggccattcctaagatttatggactaggccaatttttctcattcaatcaaacgatggatggcgtttgtaacggagccgctgcgcagcgtgccccagaggctctgaggtttaatattaatgacacttttgtcattcttgctgaaggctcaattgtacttcatactgctttaggaacaaatctttcttttgtttgcagtaattcctcagatcctcacaaagccatctttaccatacctttgggtgttactgaagtaccctactattgctttcttaaagtggatacttacaaatccactgtttataaattcttggctgttttacctcctactgtcaaggaaattgtcatcaccaagtacggtgatgtttatgtcaacgggtttggctatttgcatctcggtttgttggatgctgtcacaattaatttcactggtcatggcactgacgatgacgtttcaggtttctggaccgtagcatcgactaattttgttgatgcactcatcgaggttcaaggaactgccattcagcgtattctttattgtgatgaccctgttagccaacttaagtgttctcaggttgcttttgaccttgatgatggtttttaccctatttcttctagaaaccttctgagtcatgaacagccaatttcttttgttactttgccatcattcaatgatcattcttttgttaatattactgtctctgcggcttttggtggtcatagtggtgccaacctcattgcatctgacactactatcaatgggtttagttctttctgtgttgacactagacaatttaccattacactgttttataacgttacaaacagttatggttatgtgtctaagtcacaggatagtaattgccctttcaccttgcaatctgttaatgattacctgtcttttagcaaattttgtgtttcaaccagccttttggctggtgcttgtaccatagatctttttggttaccctgagttcggtagtggtgttaagtttacgtccctttattttcaattcacaaagggtgagttgattactggcacgcctaaaccacttcaaggtgtcacggacgtttcttttatgactctggatgtgtgtaccaagtatactatctatggctttaaaggtgagggtattattacccttacaaattctagctttttggcaggtgtttattatacatctgattctggacagttgttagcctttaagaatgtcactagtggtgctgtttattctgttacgccatgttctttttcagagcaggctgcatatgttgatgatgatatagtgggtgttatttctagtttgtctaactccacttttaacaataccagggagttgcctggtttcttctaccattctaatgatggctccaattgtacagagcctgtgttggtgtatagtaacataggtgtctgtaaatctggcagtattggctatgtcccacttcaggatggccaagtcaagattgcacccatggttactgggaatattagtattcccaccaactttagtatgagtattagaacagaatatttacagctttacaacacgcctgttagtgttgattgcgttacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccatcagttcgtttaatggtgatggatataactttactaatgtgctgggtgtttccgtgtacgaccctgcaagtggcagggtggtacaaaaagggtcttttattgaagacctgctttttaataaagtggttactaatggccttggtactgttgatgaagactataagcgctgttctaatggtcgctctgtggcagatctagtctgtgcgcagtattactctggtgtcatggtactacctggcgttgttgacgctgagaagcttcacatgtatagtgcgtctctcatcggtggtatggcgctaggaggtcttactagtgcagcggcattgccttttagccatgctgttcaagcgaggctcaattatcttgctttacagacggatgttctacagcgcaaccagcaattgcttgctgagtcttttaactctgctattggtaatataacttcagcctttgagagtgttaaagaggctattagtcaaacttccaatggtttgaacactgtggctcatgcgcttactaaggttcaagaggttgttaattcgcagggttcagctttgacccaacttaccatacagctgcaacacaacttccaagccatttctagttctattgatgacatttactcccgactggacattctttcagccgatgttcaggttgatcgtctcatcaccggcagattatcagcacttaatgcttttgttgctcaaaccctcactaagtatactgaggttcaggctagcaggaagctagcacagcaaaaggttaatgagtgcgtcaaatcgcaatctcagcgttatggtttttgtggtggtgatggcgagcacatcttctctctggtacaggccgcacctcagggcctgctgtttttacatacagtacttgtaccgggtgattttgtaaatgttattgccatcgatggcttatgcgttaatggtgatattgccttgactctacgtgagcctggcttagtcttgtttacgcatgaacttcaaacttatactgcgacggaatattttgtttcatcgcgacgtatgtttgaacctagaaaacctaccgttagtgattttgttcaaattgagagttgtgtggtcacctatgtcaatctgactagcgaccaactaccagatgtaatcccagattacatcgatgttaacaaaacacttgatgagattctagcttctctgcccaatagaattggtcctagtcttcccctagatgtttttaatgccacttatcttaatctcactggtgaaattgcagatttagagcagcgttcagagtctctccgtaatactacagaagagctccgaagtctcatatataatatcaacaacacacttgttgaccttgagtggctcaaccgagttgagacatatatcaagtggccgtggtgggtttggttgattatttttattgttctcatctttgttgtgtcattattagtgttctgctgcatttccacgggttgttgtggatgctgcggttgttgcggtgcttgtttttcaggttgttgtaggggtcctagacttcaaccttacgaagcttttgaaaaggtccacgtgcagtgatgtttcttggactttttcaatacacgattgacacagttgtcaaagatgtctcgaagtctgccaacttgtctttggatgctgtccaagagttggagctcaatgtagttccaattagacaagcttcaaatgtgacgggttttcttttcaccagtgtttttatttacttctttgcactgtttaaagcgtcttctttgaggcgcaattatattatgttggcagcgcgttttgctgtcatttttctttctgttgcacacttattggcaggctttgtttagtctgcttttactcatggcgctataaaaatgcgctctttattatctttaatactacgacactttcttttctcaatggtaaagcagcttattatgacggcaaatccattgtgattctagaaggtggtgaccattacatcacttttggcaactcttttgttgctttcgttagtagcattgacttgtatctagctatacgtgggcggcaagaagctgacctacatctgttgcgaactgttgagcttcttgacggcaagaagctttatgtcttttcacaacatcaaattgttggcattactaatgctgcatttgactcaattcaactagacgagtatgctacaattagtgaatgataatggtctagcagttaatgtcatactttggcttttcgtactctttactttcgtccaattggttaatctgtgcttcacttgtcaccggttgtgtaatagcgcagtttacacacctatagggcgcttgtatagagtttataagtcttacatgcgaattgaccccctccccagtactgttattgacatataaacgaaatatgtctaacggttttattcccgttgatgaggtgattgaacaccttagaaactggaatttcacatggaatatcatactgacgatactacttgtagtgcttcagtatggccattacaagtactctgtgttcttgtatggtgtcaagatggctattctatggatactttggcctcttgtgttggcactgtcactttttgatgcatgggctagcttccaggtcaactgggtctttttcgctttcagcatccttatggcttgcatcactcttatgctgtggataatgtattttgtcaatagcattcggttgtggcgcaggacacattcttggtggtctttcaatcctgaaactgacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattgcctgatttcgtcacagtcgccaaggccactacaacaattgtctatggacgtgttggtcgttcagtcaatgcttcatctggcactggttgggctttctatgtccggtcaaaacacggcgactactcagctgtgagtaatccgagtgcggttctcacagatagtgagaaagtgcttcatttagtctaaacagaaactttatggcttctgtcagctttcaggatcgtggccgcaaacgggtgccattatccctctatgcccctcttagggttactaatgacaaacccctttctaaggtactcgcaaacaacgctgtacccactaataaggggaataaggaccagcaaattggatactggaatgagcaaattcgctggcgcatgcgccgtggtgagcgaattgaacaaccttccaattggcatttctactacctcggaacaggacctcacgccgacctccgttataggactcgtactgagggtgttttctgggttgctaaagaaggcgcaaagactgaacccactaacttgggtgtcagaaaggcgtctgaaaagccaattattccaaaattctctcaacagctccccagtgtagttgagattgttgaacctaacacacctcctgcttcacgtacaaattcgcgtagcaggagtcgtggcaatggcaacaacaggtccagatctccgagtaacaacagaggcaacaaccagtcccgtggtaattcacagaatcgtggaaataaccagggtcgtggagcttctcagaacagaggaggcaataataataacaataacaagtctcgtaaccagtccaagaacaggaaccagtcaaatgaccgtggtggaatgacatcacgcgatgatctggtggctgctgtcaaggatgcccttaaatctttgggtattggagaaaatcctgacaggcataagcaacagcagaagcctaagcaggaaaagtctgacaacagcggaaaaaatacacctaagaagaacaaatccagggccacttcgaaggaacgtgacctcaaagacatcccagagtggaggagaattcccaagggcgaaaatagcgtagcagcttgcttcggacccagggggggcttcaaaaattttggagatgcggaatttgtcgaaaaaggtgttgatgcgtcaggctatgctcagatcgccagtttggcaccaaatgttgcagcattgctctttggtggtaatgtggctgttcgtgagctagcggactcttacgagattacatataactataaaatgactgtgccaaagtctgatccaaatgttgagcttcttgtttcacaggtggatgcatttaaaactgggaatgcaataccccagagaaagaaggaaaagaagaacaagcgtgaaaccacgcagcagcagaatgaagaggccatctacgatgatgtgggtgtgccatctgatgtgacccatgccaatctggaatgggacacagctgttgatggtggtgacacggccgttgaaattatcaacgagatcttcgacacaggaaattaaacaatgtttgaccggcttatcctggctatgttccagggtagtgccattacactgttattactgagtgtttttctagtgacttggctgctgggctatggctttgccctctaactagcggtcttggtcttgcacacaacggtaagccagtggtaatgtcagtgcaagaaggatattaccatagcactgtcacgaggggaacgcagtaccttttcatctaaacctttgcacgagtaatcaaagatccgcttgacgagcctatatggaagagcgtgccaggtatttgactcaaggactgttagtaactgaagacctgacggtgttgatatggataca

SEQ ID NO: 25 - DNA, 28039 bp, Porcine epidemic diarrhea virus
acttaaaaagattttctatctacggatagttagctctttttctagactcttgtctactcaattcaactaaacgaaattttgtccttccggccgcatgtccatgctgctggaagctgacgtggaatttcattaggtttgcttaagtagccatcgcaagtgctgtgctgtcctctagttcctggttggcgttccgtcgccttctacatactagacaaacagccttcctccggttccgtctgggggttgcgtggataactagttccgtctagtttgaaaccagtaactgtcggctatggctagcaaccaagtcacattggcttttgccaatgatgcagaaatttcagcttttggcttttgcactgctagtgaagccgtctcatactattctgaggccgccgctagtggatttatgcaatgccgtttcgtgtccttcgatctcgctgacactgttgagggattgcttcccgaagactatgtcatggtggtggtcggcactaccaagcttagtgcgtatgtggacacttttggtagccgccccagaaacatttgtggttggctgttattttctaactgtaattacttcctcgaagagttagagctcacttttggtcgtcgtggtggtaacatcgtgccagttgaccaatacatgtgtggcgctgacgggaaacctgttcttcaggaatccgagtgggagtatacagacttttttgctgactccgaagacggtcaactcaacattgctgggatcacttatgtgaaggcctggattgtagagcgatcggacgtctcttatgcgagtcagaatttaacatctattaagtctattacttactgttcaacctatgagcatacttttcctgatggtactgccatgaaggttgcacgtactccaaagattaagaagactgttgtcttgtctgagccacttgctactatctacagggaaattggttctccttttgtggataatgggagcgatgctcgttctatcattaagagaccagtgttcctccacgcttttgttaagtgtaagtgtggtagttatcattggactgttggtgattggacttcctatgtctccacttgctgtggctttaagtgtaagccagtccttgtggcttcatgctctgctacgcctggttctgttgtggttacgcgcgctggtgctggcactggtgttaagtattacaacaacatgttcctgcgccatgtggcagacattgatgggttggcattctggcgaattcttaaggtgcagtccaaagacgacctcgcttgctctggtaaattccttgaacaccatgaggaaggtttcacagatccttgctactttttgaatgactcgagcattgctactaagctcaagtttgacatccttagtggcaagttttctgatgaagtcaaacaagctatctttgctggtcatgttgttgttggcagtgcgctcgttgacattgttgacgatgcactgggacagccttggtttatacgtaagcttggtgaccttgcaagtgcagcttgggagcagcttaaggctgtcgttagaggccttaacctcctgtctgatgaggtcgtgctctttggcaaaagacttagctgtgccactcttagtatcgttaacggtgtttttgagtttatcgccgaagtgccagagaagttggctgcggctgttacagtttttgtcaacttcttgaatgagctttttgagtctgcctgtgactgcttaaaggtcggaggtaaaacctttaacaaggttggctcctatgtcctttttgacaacgcattggttaagcttgtcaaggcaaaagttcgcggcccacgacaggcaggtgtttgtgaagttcgttacacaagccttgttattgggagtactaccaaggtggtttccaagcgcgttgaaaatgccaatgtgaatctcgtcgtcgttgacgaggatgtgaccctcaacaccactggtcatacagttgttgttgacggacttgcattcttcgagagtgacgggttttacagacatcttgctgatgctgacgttgtcattgaacatcctgtttataagtctgcttgtgagctcaagccagtttttgagtgtgatccaatacctggttttcctatgcctgtggccgctagtgttgcagagctttgtgtgcaaactgatctgttgcttaaaaattacaacactccttataaaacttacagctgcgttgtgagaggtgataagtgttgcatcacttgcaccttacatatcacagcaccaagttatatggaggatgctgctaattttgtagacctctgtaccaagaacattggtactgctggttttcatgagttttacattacggcccatgaacaacaggatctgcaagggttcgtaaccacttgttgcacgatgtcaggttttgagtgttttatgcctataatcccacagtgtccagcagtgcttgaagagattgatggtggtagcatctggcggtcttttatcactggtcttaatacaatgtgggatttttgcaagcatcttaaagtcagctttggactagatggcattgttgtcactgtagcacgcaaatttaaacgacttggtgctctcttggcagaaatgtataacacttacctttcaactgtggtggaaaacttggtactggccggtgttagcttcaagtattatgccaccagtgtcccaaaaattgttttgggctgttgttttcacagtgttaaaagtgttcttgcaagtgccttccagattcctgtccaggcaggcattgagaagtttaaagtcttccttaactgtgttcaccctgttgtaccacgcgtcattgaaacttcttttgtggaattagaagagacgacatttaaaccaccagcactcaatggtagtattgctattgttgatggctttgctttctattatgatggaacactatactatcccaccgatggtaatagtgttgtgcctatttgttttaagaagaagggtggtggtgatgtcaaattctctgatgaagtctctgttagaaccattgacccagtttataaggtctcccttgaatttgagttcgagtctgagactattatggctgtgcttaataaggctgttggtaatcgtatcaaggttacaggtggttgggacgatgttgttgagtatatcaacgttgccattgaggttcttaaagatcatatcgatgtgcctaagtactacatctatgatgaggaaggtggcaccgatcctaatcttcccgtaatggtttctcagtggccgttgaatgatgacacgatctcacaggatctgcttgatgtggaagttgttactgatgcaccaattgatttcgagggtgatgaagtagactcctctgaccctgataaggtggcagatgtggctaactctgagcctgaggatgatggtcctaatgtagctcctgaaacaaatgtagagtctgaagttgaggaagttgccgcaaccttgtcttttattaaagatacaccttccacagttactaaggatccttttgcttttgactttgcaagctatggaggacttaaggttttaagacaatctcataacaactgctgggttacttctaccttggtgcagctacaattgcttggcatcgttgatgaccctgcaatggagctttttagtgctggtagagttggtccaatggttcgcaaatgctatgagtcacaaaaggctatcttgggatctttgggtgatgtgtcggcttgcctagagtctctgactaaggacctacacacacttaagattacctgttctgtagtctgtggttgtggtactggtgaacgtatctatgagggttgtgcttttcgtatgacgccaactttggaaccgttcccatatggtgcttgtgctcagtgtgctcaagttttgatgcacacttttaaaagtattgttggcaccggcatcttttgtcgagatactactgctctctccttggattctttggttgtaaaacctctttgtgcggctgcttttataggcaaggatagtggtcattatgtcactaacttttatgatgctgctatggctattgatggttatggtcgtcatcagataaagtatgacacactgaacactatttgtgttaaagacgttaattggacagcaccttttgtcccagacgttgagcctgtattggagcctgttgtcaaacctttctattcttataagaatgttgatttttaccaaggagattttagtgaccttgttaaacttccatgtgattttgttgttaatgctgcaaatgagaatttgtctcacggtggcggcatagcaaaggccattgatgtttataccaagggcatgttgcagaagtgctcgaatgattacattaaagcacacggtcccattaaagttggacgtggtgtcatgttggaggcattaggtcttaaggtctttaatgttgttggtccacgtaagggtaagcatgcacctgagcttcttgttaaggcttataagtccgtttttgctaattcaggtgttgctcttacacctttgattagtgttggaatttttagtgttcctttggaagaatctttatctgcttttcttgcatgtgttggtgatcgccactgtaagtgcttttgttatagtgacaaagagcgcgaggcgatcattaattacatggatggcttggtagatgctattttcaaagatgcgcttgttgatactactcctgtccaggaagatgttcaacaagtttcacaaaaaccagttttgcctaattttgaacctttcaggattgaaggtgctcatgctttctatgagtgcaaccctgaaggtttgatgtcattaggtgctgacaagctggtgttgtttacaaattccaatttggatttttgtagcgttggtaagtgtcttaacaatgtgaccggcggtgcattgcttgaagccataaatgtatttaaaaagagtaacaaaacagtgcctgctggcaactgtgttacttttgagtgtgcagacatgatttctattactatggtagtattgccatctgatggtgatgctaattatgacaaaaattatgcacgcgccgtcgtcaaggtatctaagcttaaaggcaagttattgcttgctgttggtgatgccacgttgtattccaagttgtcccacctcagcgtggtaggtttcgtatccacacctgatgatgtggagcgtttctacgcaaataagagtgtggttattaaagtcactgaggatacacgtagtgttaaggctgttaaagtagaatccactgttacttatggacaacaaattggaccttgtcttgttaatgacaccgttgtcacagacaacaaacctgttgttgctgatgttgtagctaaggttgtaccaagtgctaattgggattcacattatggttttgataaggctggtgagttccacatgctagaccatactgggtttgcctttcctagtgaagttgttaacggtaggcgtgtgcttaaaaccacagataataactgttgggttaatgttacatgtttacaattacagtttgctagatttaggttcaagtcagcaggtctacaggctatgtgggagtcctattgtactggtgatgttgctatgtttgtgcattggttgtactggcttactggtgttgacaaaggtcagcctagtgattcagaaaatgcacttaacatgttgtccaagtacattgtttctgctggttctgtcactattgaacgtgtcacgcatgacggctgttgttgtagtaagcgtgttgtcactgcaccagttgtgaatgctagcgtattgaagcttggcgtcgaggatggtctttgtccacatggtcttaactacattgacaaagttgttgtagtcaaaggtactacaattgttgtcaatgttggaaaacctgtagtggcaccatcacacctctttcttaagggtgtttcttacacaacattcctagataatggtaacggtgttgtcggccattatactgtttttgatcatgacactggtatggtgcatgatggagatgcttttgtaccgggtgatctcaatgtatctcctgttacaaatgttgtcgtctcagagcagacggctgttgtgattaaagaccctgtgaagaaagtagagttagacgctacaaagctgttagacactatgaattatgcatcggaaagattcttttcctttggtgattttatgtcacgtaatttaattacagtgtttttgtacatccttagtattttgggtctctgttttagggcctttcgtaagagggatgttaaagttctagctggtgtaccccaacgtactggtattatattgcgtaaaagtgtgcgctataatgcaaaggctttgggtgtcttcttcaagctaaaactttattggttcaaagttcttggtaagtttagtttgggtatttatgcattgtatgcattactattcatgacaatacgctttacacctataggtggccctgtttgtgatgatgttgttgctggttatgctaattctagttttgacaagaatgagtattgcaacagtgttatttgtaaggtctgtctctatgggtaccaggaactttcggacttctctcacacacaggtagtatggcaacaccttagagacccattaattggtaatgtgatgcctttcttttatttggcatttctggcaatttttgggggtgtttatgtaaaggctattactctctattttattttccagtatcttaacattcttggtgtgtttttgggcctacaacagtccatttggtttttgcagcttgtgccttttgatgtctttggtgacgagatcgtcgtctttttcatcgttacacgcgtattgatgttccttaagcatgttttccttggctgcgataaggcatcttgtgtggcttgctctaagagtgctcgccttaagcgcgttcctgtccagactatttttcagggtactagcaaatccttctacgtacatgccaatggtggttctaagttctgtaagaagcacaatttcttttgtttaaattgtgattcttatggtccaggctgcacttttattaatgacgtcattgcaactgaagttggtaatgttgtcaaacttaatgtgcaaccgacaggtcctgccactattcttattgacaaggttgaattcagtaatggtttttactatctttatagtggtgacacattttggaagtacaactttgacataacagataacaaatacacttgcaaagagtcacttaaaaattgtagcataatcacagactttattgtttttaacaataatggttccaatgtaaatcaggttaagaatgcatgtgtgtatttttcacagatgctttgtaaacctgttaagttagtggactcagcgttgttggccagtttgtctgttgattttggtgcaagcttacatagtgcttttgttagtgtgttgtcgaatagttttggcaaagacctgtcaagttgtaatgacatgcaggattgcaagagcacattgggttttgatgatgtaccattggatacctttaatgctgctgttgctgaggctcatcgttacgatgtcctcttgactgacatgtcgttcaacaattttaccaccagttatgcaaaaccagaggaaaaacttcccgtccatgacattgccacgtgtatgcgtgtaggtgccaagattgttaatcataacgttcttgtcaaggatagtatacctgtggtgtggcttgtacgtgatttcattgccctttcggaagaaactaggaagtacattattcgtacgactaaagttaagggtataaccttcatgttgacctttaatgattgtcgtatgcatactaccatacctactgtttgcattgcaaataagaagggtgcaggtcttcctagtttttcaaaggttaagaaattcttctggtttttgtgtctgttcatagttgctgttttctttgcactaagctttcttgattttagtactcaggttagcagtgatagcgattatgacttcaagtatattgagagtggccagttgaagacttttgacaatccacttagttgtgtgcataatgtctttagtaacttcgaccagtggcatgatgccaagtttggtttcacccccgtcaacaatcctagttgtcctatagtcgttggtgtgtcagacgaagcgcgcactgttccaggtatcccagcaggtgtttatttagctggtaaaacacttgtttttgctattaacaccatttttggtacatctggtttgtgctttgatgctagtggcgttgctgataagggcgcttgcatttttaattcggcttgcaccacattatctggtttgggtggaactgctgtctactgttataagaatggtctagttgaaggtgctaaactttatagtgagttggcacctcatagctactataaaatggtagatggtaatgctgtgtctttacctgaaattatctcacgcggctttggcatccgtactatccgtacaaaggctatgacctactgtcgcgttggccagtgtgtgcaatctgcagaaggtgtttgttttggcgccgatagattctttgtctataatgcagaatctggttctgactttgtttgtggcacagggctctttacattgttgatgaacgttattagtgttttttccaagacagtaccagtaactgtgttgtctggtcaaatactttttaattgcattattgcttttgctgctgttgcggtgtgtttcttatttacaaagtttaagcgcatgttcggtgatatgtctgttggcgttttcactgtcggtgcttgtactttgttgaacaatgtttcctacattgtaacacagaacacacttggcatgttgggctatgcaactttgtactttttgtgcactaaaggtgttagatatatgtggatttggcatttgggatttttgatctcatatatacttattgcaccatggtgggttttgatggtttatgccttttcagccatttttgagtttatgcctaacctttttaagcttaaggtttcaacacaactttttgagggtgacaagttcgtaggctcttttgaaaatgctgcagcaggtacatttgtgcttgatatgcatgcctatgagagacttgccaactctatctcaactgaaaaactgcgtcagtatgctagtacttacaataagtacaagtattattcaggcagtgcttcagaggctgattacaggcttgcttgttttgcccatttggccaaggctatgatggattatgcttctaatcacaacgacacgttatacacaccacccactgtgagttacaattcaactctacaggctggcttgcgtaagatggcacaaccatctggtgttgttgagaagtgcatagttcgtgtttgctatggtaatatggctcttaatggcctatggcttggtgatactgttatctgcccacgccatgttatagcgtctagtactactagcactatagattatgactatgccctttctgttttacgcctccacaacttctccatttcatctggtaatgttttcctaggtgttgtgggtgtaaccatgcgaggtgctttgttgcagataaaggttaatcaaaacaatgtccacacgcctaagtacacctatcgcacagttagaccgggtgaatcttttaatatcttggcgtgctatgatggttctgcagctggtgtttacggcgttaacatgcgctctaattacactattagaggctcgttcattaatggcgcttgtggttcacctggttataacattaacaatggtaccgttgagttttgctatttacaccagcttgaacttggttcaggctgtcatgttggtagcgacttagatggtgttatgtatggtggttatgaggaccaacctactttgcaagttgaaggcgctagtagtctgtttacagagaatgtgttggcatttctttatgcagcactcattaatggttctacctggtggcttagttcttctaggattgctgtagacaggtttaatgagtgggctgttcataatggtatgacaacagtagttaatactgattgcttttctattcttgctgctaagactggtgttgatgtacaacgtttgttggcctcaatccagtctctgcataagaattttggtggaaagcaaattcttggctatacctcgttgacagatgagtttactacaggtgaagttatacgtcaaatgtatggcgttaatcttcagagtggttatgtttcacgcgcctgtagaaatgtcttgctggttggttcttttctgactttcttttggtcagaattagtttcctacactaagttcttttgggtaaatcctggttatgtcacacctatgtttgcgtgtttgtcattgctgtcctcacttttgatgttcacactcaagcataagacattgtttttccaggtctttctaatacctgctctgattgttacatcttgcattaatttggcatttgatgttgaagtctacaactatttggcagagcattttgattaccatgtttctctcatgggttttaatgcacaaggtcttgttaacatctttgtctgctttgttgttaccattttacacggcacatacacatggcgcttttttaacacacctgtgagttctgtcacttatgtggtagctttgctgactgcggcatataactatttttacgctagtgacattcttagttgtgctatgacactatttgctagtgtgactggcaactggttcgttggtgctgtttgttataaagctgctgtttatatggccttgagatttcctacttttgtggctatttttggtgatattaagagtgttatgttctgttaccttgtgttgggttattttacctgttgcttctacggtattctctactggttcaacaggttttttaaggttagtgtaggtgtctatgactatactgttagtgctgctgagtttaagtatatggttgctaacggcctacgtgcaccaactggaacacttgattcactacttctgtctgccaaattgattggtattggtggtgagcggaatattaagatttcttccgttcagtctaaactgactgatattaagtgtagtaacgttgtgcttttaggctgtctctctagcatgaatgtctcagcaaattcaacagaatgggcctattgtgttgacttgcataacaagatcaacttgtgtaatgacccagaaaaagcgcaggaaatgctacttgctttgttggcatttttccttagtaagaatagtgcttttggtttagatgacttattggaatcctattttaatgacaatagtatgttgcagagtgttgcatctacttatgtcggtttgccttcttatgtcatttatgaaaatgcacgccaacagtatgaagatgctgttaataatggttctccacctcagttggttaagcaattgcgccatgccatgaatgtagcaaagagcgaatttgaccgtgaggcttctactcagcgtaagcttgatagaatggcggaacaggctgcagcacagatgtacaaagaggcaagagcagttaataggaagtccaaagttgtaagtgctatgcattcactgctttttggtatgttgagacgtttggacatgtcttctgtagacaccattctcaacttggcaaaggatggggttgtacctctgtctgtcataccggcagtcagtgctactaagcttaacattgttacttctgatatcgattcttataatcgtatccagcgtgagggatgtgtccactacgctggtaccatttggaatataattgatatcaaggacaatgatggcaaggtggtacacgttaaggaggtaaccgcacagaatgctgagtccctgtcatggcccctggtccttgggtgtgagcgtattgtcaagctccagaataatgaaattattcctggtaagctgaagcagcgctccattaaggcagaaggagatggcatagttggagaaggtaaggcactttacaataatgagggtggacgtacttttatgtatgctttcatctcggacaaaccggacctgcgtgtagtcaagtgggagttcgatggtggttgtaacactattgagctagaaccaccacgtaagttcttggtggattctcctaatggtgcacagatcaagtatctctactttgttcgtaaccttaacacgttacgtaggggtgctgttctcggctacataggtgccactgtacgcttgcaggctggtaaacaaacagaacaggctattaactcttcattgttgacactttgcgctttcgctgtggatcctgctaagacctacatcgatgctgtcaaaagtggtcacaaaccagtaggtaactgtgttaagatgttggccaatggttctggtaatggacaagctgttactaatggtgtggaggctagtactaaccaggattcatacggtggtgcgtccgtgtgtctatattgtagagcacatgttgagcatccatctatggatggtttttgcagactgaaaggcaagtacgtacaggttccactaggtacagtggatcctatacgttttgtacttgagaatgacgtttgcaaggtttgtggttgttggctggctaatggctgcacttgtgacagatccattatgcaaagcactgatatggcttatttaaacgagtacggggctctagtgcagctcgactagagccctgtaacggtactgatacacaacatgtgtatcgtgcttttgacatctacaacaaggatgttgcttgtctaggtaaattcctcaaggtgaactgtgttcgcctgaagaatttggataagcatgatgcattctatgttgtcaaaagatgtaccaagtctgcgatggaacacgagcaatccatctatagcagacttgaaaagtgtggagccgtagccgaacacgatttcttcacttggaaggatggtcgtgccatctatggtaacgtttgtagaaaggatcttaccgagtatactatgatggatttgtgttacgctttacgtaactttgatgaaaacaattgcgatgttcttaagagcattttaattaaggtaggcgcttgtgaggagtcctacttcaataataaagtctggtttgaccctgttgaaaatgaagacattcatcgtgtctatgcattgttaggtaccattgtttcacgtgctatgcttaaatgcgttaagttctgtgatgcaatggttgaacaaggtatagttggtgttgtcactttagataatcaggatcttaatggtgatttttatgattttggtgattttacttgtagcatcaagggaatgggtatacccatttgcacatcatattactcttatatgatgcctgttatgggtatgactaattgccttgctagtgagtgttttgttaagagtgatatatttggtgaggatttcaagtcatatgacctgctggaatatgatttcacggagcataagacagcactcttcaacaagtatttcaagtattggggactgcaataccaccctaactgtgtggactgcagtgatgagcagtgcatagttcactgtgccaacttcaatacgttgttttccactactatacctattacggcatttggacctttgtgtcgcaagtgttggattgatggtgttccactggtaactacagctggttatcattttaaacagttaggtatagtttggaacaatgacctcaacttacactctagcaggctctctattaacgaattactccagttttgtagtgatcctgcattgcttatagcatcatcaccagcccttgttgatcagcgtactgtttgcttttcagttgcagcgctaggtacaggtatgactaaccagactgttaaacctggccatttcaataaggagttttatgacttcttacttgagcaaggtttcttttctgagggctctgagcttactttaaagcacttcttctttgcacagaagggtgatgcagctgttaaggattttgactactataggtataatagacctactgttctggacatttgccaagctcgcgtcgtgtatcaaatagtgcaacgctattttgatatttacgaaggtggttgtatcactgctaaagaggtggttgttacaaaccttaacaagagcgcaggttatcctttgaacaagtttggtaaagctggtctttactatgagtctttatcctatgaggaacaggatgaactttatgcttatactaagcgtaacatcctgcccactatgacacagctcaaccttaaatatgctataagtggcaaagaacgtgcacgcacagtgggtggtgtttcgcttttgtcaaccatgactactcggcagtatcatcagaaacaccttaagtccatagttaatactaggggcgcttcggttgttattggtactactaagttttatggtggttgggacaatatgcttaagaaccttattgatggtgttgaaaatccgtgtcttatgggttgggactacccaaagtgcgacagagcactgcccaatatgatacgtatgatttcagccatgattttaggctctaagcacaccacatgctgcagttccactgaccgctttttcaggttgtgcaatgaattggctcaagtccttactgaggttgtttattctaatggaggtttttatttgaagccaggtggtactacctctggtgatgcaaccaccgcatatgcaaactcagtttttaatatcttccaagcagtaagtgccaatgttaacaaacttcttagtgttgacagcaatgtctgtcataatttagaagttaagcaattgcagcgtaagctttatgagtgctgttatagatcaactaccgtcgatgaccagttcgtcgttgagtattatggttacttgcgtaaacatttttcaatgatgattctttctgatgatggcgttgtttgttataacaatgactatgcatcacttggttatgtcgctgatcttaacgcattcaaggctgttttgtattaccagaacaatgtcttcatgagcgcctctaaatgttggatcgagcctgacattaataaaggtcctcatgaattttgctcgcagcatactatacagattgtcgataaagatggtacttattaccttccttaccctgatccttcaagaatcctctctgcaggtgtgtttgttgatgacgttgttaaaactgatgcacttgtattgcttgaacgttatgtgtcattggctatagatgcctacccgttatctaagcatgaaaaccctgaatataagaaggtgttttatgtgcttttggattgggttaagcatctgtacaaaactcttaatgctggtgtgttagagtctttttctgtcacacttttggaagattctactgctaaattctgggatgagagcttttatgccaacatgtatgagaaatctgcagttttacaatctgcagggctttgtgttgtttgtggctctcaaactgttttacgttgtggtgattgtctacggcgtcctatgctttgtactaagtgtgcttatgatcatgtcattggaacaactcacaagttcattttggccatcactccatatgtgtgttgtgcttcagattgtggtgtcaatgatgtaactaagctctacttaggtggtcttagttattggtgtcatgaccacaagccacgtcttgcattcccgttgtgctctgctggtaatgtttttggcttgtacaaaaattctgctaccggctcacccgatgttgaagactttaatcgcattgctacatccgattggactgatgtttctgactacaggttggcaaatgatgtcaaggactcattgcgtctgtttgcagcggaaactatcaaggccaaggaggagagcgttaagtcatcctatgcttgtgcaacactacatgatgttgtaggacctaaagagttgttgctcaaatgggaagtcggcagacccaaaccaccccttaatagaaattcggttttcacttgttatcatataacgaagaacaccaaatttcaaatcggtgagtttgtgtttgagaaggcagaatatgataatgatgctgtaacatataaaactaccgccacaacaaaacttgttcctggcatggtttttgtgcttacctcacataatgttcagccattgcgcgcaccgaccattgctaatcaagaacgttattccactatacataagttgcatcctgcttttaacatacctgaagcttattctagcttagtgccctattaccaattgattggtaagcagaagattacaactattcagggacctcccggtagtggtaaatctcactgtgttatagggctaggtttgtactatccaggtgcacgtatagtgtttacagcttgttctcatgcagcggtcgattcactttgtgtgaaagcctccactgcttatagcaatgacaaatgttcacgcatcataccacagcgcgctcgtgttgagtgttatgatggtttcaagtctaataatactagtgctcagtaccttttctctactgtcaatgctttgccagagtgcaatgcggacattgttgtggtggatgaggtctctatgtgcactaattatgacttgtctgtcataaatcagcgcatcagctataggcatgtagtctatgttggtgaccctcaacagctgcctgcaccacgtgttatgatttcacgtggtactttggaaccaaaggactacaacgttgtcactcaacgcatgtgtgcccttaagcctgatgttttcttgcacaagtgttatcgctgtcctgctgagatagtgcgtactgtgtctgagatggtctatgaaaaccaattcattcctgtgcacccagatagcaagcagtgttttaaaatcttttgcaagggtaatgttcaggttgataatggttcaagcattaatcgcaggcaattggatgttgtgcgtatgtttttggctaaaaatcctaggtggtcaaaggctgtttttatttctccttataacagccagaattatgttgccagccgcatgctaggtctacaaattcagacagttgactcatcccagggtagtgagtatgactatgtcatttacacacaaacttcagatactgcccatgcctgtaatgttaacaggtttaatgttgccatcacaagggccaagaaaggcatattatgtataatgtgcgataggtccctttttgatgtgcttaaattctttgagcttaaattgtctgatttgcaggctaatgagggttgtggtctttttaaagactgtagcagaggtgatgatctgttgccaccatctcacgctaacaccttcatgtctttagcggacaattttaagactgatcaagatcttgctgttcaaataggtgttaatggacccattaaatatgagcatgttatctcgtttatgggtttccgttttgatatcaacatacccaaccatcatactctcttttgcacacgcgactttgccatgcgcaatgttagaggttggttaggctttgacgttgaaggagcacatgttgttggctctaacgtcggtacaaatgtcccattgcaattagggttttctaacggtgttgattttgttgtcagacctgaaggttgcgttgtaacagagtctggtgactacattaaacccgtcagagctcgtgctccaccaggggaacaattcgcacaccttttgcctttacttaaacgcggccaaccatgggatgttgtccgcaaacgtatagtgcagatgtgtagtgactacctggccaacctatcagacatactaatttttgtgttgtgggctggtggtttggagttgacaactatgcgttattttgtcaagattggaccaagtaagagttgtgattgtggtaaggttgctacttgttacaatagtgcgctgcatacgtactgttgtttcaaacatgcccttggttgtgattatctgtataacccatactgtattgatatacagcagtggggatacaagggatcacttagccttaaccaccatgagcattgtaatgtacatagaaacgagcatgtggcttctggtgatgccataatgactcgctgtctggccatacatgattgctttgtcaagaacgttgactggtccatcacatacccatttattggtaatgaggctgttattaataagagcggccgaattgtgcaatcacacactatgcggtcagttcttaagttatacaatccgaaagccatatatgatattggcaatcctaagggcattagatgtgccgtaacggatgctaagtggttttgctttgacaagaatcctactaattctaatgtcaagacattggagtatgactatataacacatggccaatttgatgggttgtgcttgttttggaattgcaatgtagacatgtatccagaattttctgtggtctgtcgttttgatactcgctgtaggtcaccactcaacttggagggttgtaatggtggttcactgtatgttaataatcatgcattccatacaccggcttttgacaagcgtgcttttgctaagttgaagccaatgccatttttcttttatgatgatactgagtgtgacaagttacaggactccataaactatgttcctcttagggctagtaactgcattactaaatgtaatgttggtggtgctgtctgtagtaagcattgtgctatgtatcatagctatgttaatgcttacaacacttttacgtcggcgggctttactatttgggtgcctacttcgtttgacacctataatctgtggcagacatttagtaacaatttgcaaggtcttgagaacattgctttcaatgtcgtaaagaaaggatcttttgttggtgccgaaggtgaacttcctgtagctgtggttaatgacaaagtgctcgttagagatggtactgttgatactcttgtttttacaaacaagacatcactacccactaacgtagcttttgagttgtatgccaagcgtaaggtaggactcaccccacccattacgatcctacgtaacttgggtgtagtttgtacatctaagtgtgtcatttgggactatgaagccgaacgtccacttactacttttacaaaggatgtttgtaaatataccgactttgagggtgacgtctgtacactctttgataacagcattgttggttcattagagcgattctccatgacccaaaatgctgtgcttatgtcacttacagctgttaaaaagcttactggcataaagttaacttatggttatcttaatggtgtcccagttaacacacatgaagataaaccttttacttggtatatttacactaggaagaacggcaagttcgaggaccatcctgatggctattttacccaaggtagaacaaccgctgattttagccctcgtagcgacatggaaaaggacttcctaagtatggatatgggtctgtttattaacaagtacggacttgaagattacggctttgagcacgttgtgtatggtgatgtttcaaaaaccacccttggtggtttgcatctactaatttcgcaggtgcgtctggcctgtatgggtgtgctcaaaatagacgagtttgtgtctagtaatgatagcacgttaaagtcttgtactgttacatatgctgataaccctagtagtaagatggtttgtacgtatatggatctcctgcttgacgattttgtcagcattcttaaatctttggatttgggcgttgtatctaaagttcatgaagttatggtcgattgtaaaatgtggaggtggatgttgtggtgtaaggatcataaactccagacattttatccgcaacttcaggccagtgaatggaagtgtggttattccatgccttctatttacaagatacaacgtatgtgtttagaaccttgcaatctctacaactatggtgctggtattaagttacctgatggcattatgtttaacgtagttaaatacacacagctttgtcaatatctcaatagcaccacaatgtgtgtaccccatcacatgcgtgtgctacatcttggtgctggctccgacaagggtgttgcacctggcacggctgtcttacgacgttggttgccactggatgccattatagttgacaatgatagtgtggattacgttagcgatgctgattatagtgttacaggagattgctctaccttatacctgtcagataagtttgatttagttatatctgatatgtatgatggtaagattaaaagttgtgatggggagaacgtgtctaaagaaggcttctttccctatattaatggtgtcatcaccgacaaagttggcacttggtggtactgtagctattaaggtgacggagcttagttggaataagaagttgtatgaactcattcagaagtttgagtattggacaatgttctgtaccagtgttaacacgtcatcgtcagaggcattcttaattggtgttcactatttaggtgattttgcaagtggcgctgtgattgacggcaacactatgcatgccaattatatcttctggcgtaattccacaattatgactatgtcttacaatagtgtacttgatttaagcaagttcaattgtaagcataaggctacagttgtcattaatttaaaagattcatccattagtgatgttgtgttaggtttgttgaagaatggtaagttgctagtgcgtaataatgacgccatttgtggtttttctaatcatttggtcaacgtaaacaaatgaagtctttaacctacttctggttgttcttaccagtactttcaacacttagcctaccacaagatgtcaccaggtgctcagctaacactaattttaggcggttcttttcaaaatttaatgttcaggcgcctgcagttgttgtactgggcggttatctacctattggtgaaaaccagggtgtcaattcaacttggtactgtgctggccaacatccaactgctagtggcgttcatggtatctttgttagccatattagaggtggtcatggctttgagattggcatttcgcaagagccttttgaccctagtggttaccagctttatttacataaggctactaacggtaacactaatgctactgcgcgactgcgcatttgccagtttcctagcattaaaacattgggccccactgctaataatgatgttacaacaggtcgtaattgcctatttaacaaagccatcccagctcatatgagtgaacatagtgttgtcggcataacatgggataatgatcgtgtcactgtcttttctgacaagatctattatttttattttaaaaatgattggtcccgtgttgcgacaaagtgttacaacagtggaggttgtgctatgcaatatgtttacgaacccacctattacatgcttaatgttactagtgctggtgaggatggtatttcttatcaaccctgtacagctaattgcattggttatgctgccaatgtatttgctactgagcccaatggccacataccagaaggttttagttttaataattggtttcttttgtccaatgattccactttggtgcatggtaaggtggtttccaaccaaccattgttggtcaattgtcttttggccattcctaagatttatggactaggccaatttttctcctttaatcaaacgatcgatggtgtttgtaatggagctgctgtgcagcgtgcaccagaggctctgaggtttaatattaatgacacctctgtcattcttgctgaaggctcaattgtacttcatactgctttaggaacaaatttttcttttgtttgcagtaattcctcaaatcctcacttagccaccttcgccatacctttgggtgctacccaagtaccctattattgttttcttaaagtggatacttacaactccactgtttataaattcttggctgttttacctccaaccgtcagggaaattgtcatcaccaagtatggtgatgtttatgtcaatgggtttggctatttgcatctcggtttgttggacgctgtcacaattaatttcactggtcatggcactgacgatgacgtttcaggtttctggaccatagcatcgactaattttgttgatgcacttatcgaagttcaaggaactgccattcagcgtattctttattgtgatgatcctgttagccaactcaagtgttctcaggttgcttttgaccttgacgatggtttctaccctatttcttctagaaacctcttgagtcatgaacagccaatttcttttgttactttgccatcatttaatgatcattcttttgttaacattactgtctctgcgtcctttggtggtcatagtggtgccaaccttattgcatctgacactactatcaatgggtttagttctttctgtgttgacactagacaatttaccatttcactgttttataacgttacaaacagttatggttatgtgtctaactcacaggacagtaattgccctttcaccttgcaatctgttaatgattacctgtcttttagtaaattttgtgtttccaccagccttttggctagtgcctgtaccatagatctttttggttaccctgattttggtagtggtgttaagtttacgtccctttactttcaattcacaaagggtgagttgattactggcacgcctaaaccacttgaaggtgtcacggacgtttcttttatgactctggatgtgtgtaccaagtatactatctatggctttaaaggtgagggtatcattacccttacaaattctagctttttggcaggtgtttattacacatctgattctggacagttgttagcctttaagaatgtcactagtggtgctgtttattctgttacgccatgttctttttcagagcaggctgcatatgttgatgatgatatagtgggtgttatttctagtttgtctaattccacttttaacagtactagggagttgcctggtttcttctaccattctaatgatggctctaattgtacagagcctgtgttggtgtatagtaacataggtgtttgtaaatctggcagtattggctacgtcccatctcagtctggccaagtcaagattgcacccacggttactgggaatattagtattcccaccaactttagtatgagtattaggacagaatatttacagctttacaacacgcctgttagtgttgattgtgccacatatgtttgtaatggtaactctcgttgtaaacaattactcacccagtacactgcagcatgtaagaccatagagtcagcattacaactcagcgctaggcttgagtctgttgaagttaactctatgcttactatttctgaagaggctctacagttagctaccatcagttcgtttaatggtgatggatataattttactaatgtgctgggtgtttctgtgtatgatcctgcaagtggcagggtggtacaaaaaaggtcttttattgaagacctgctttttaataaagtggttactaatggccttggtactgttgatgaagactataagcgctgttctaatggtcgctctgtggcagatctagtctgtgcacagtattactctggtgtcatggtactacctggtgttgttgacgctgagaagcttcacatgtatagtgcgtctctcatcggtggtatggtgctaggaggttttacttctgcagcggcattgccttttagctatgctgttcaagctagactcaattatcttgctctacagacggatgttctacagcggaaccagcaattgcttgctgagtcttttaactctgctattggtaatataacttcagcctttgagagtgttaaagaggctattagtcaaacttccaagggtttgaacactgtggctcatgcgcttactaaggttcaagaggttgttaactcgcagggtgcagctttgactcaacttaccgtacagctgcaacacaacttccaagccatttctagttctattgatgacatttacacccgactggacattctttcagccgatgttcaggttgaccgtctcatcaccggcagattatcagcacttaatgcttttgttgctcaaaccctcactaagtatactgaggttcaggctagcaggaagctagcacagcaaaaggttaatgagtgcgttaaatcgcaatctcagcgttatggtttttgtggtggtgatggcgatcacattttctctctggtacaggcagcacctcagggcctgctgtttttacatacagtacttgtaccgggtgattttgtagatgttattgccatcgctggcttatgcgttaacgatgaaattgccttgactctacgtgagcctggcttagtcttgtttacgcatgaacttcaaaatcatactgcgacggaatattttgtttcatcgcgacgtatgtttgaacctagaaaacctaccgttagtgattttgttcaaattgagagttgtgtggtcacctatgtcaatttgactagagaccaactaccagatgtaatcccagattacatcgatgttaacaaaacacttgatgagattttagcttctctgcccaatagaactggtccaagtcttcctttagatgtttttaatgccacttatctcaatctcactggtgaaattgcaaatttagagcagcgttcagagtctctccgtaatactacagaggagctccaaagtcttatacataatatcaacaacacactagttgaccttgagtggctcaaccgagttgagacatatatcaagtggccgtggtgggtttggttggttatttttattgttctcatctttgttgtgtcattactagtgttctgctgcatttccacgggttgttgtggatgctgcggctgctgctgtgcttgtttttcaggttgttgtaggggtcctagacttcaaccttacgaagtttttgaaaaggtccacgtgcagtgatgtttcttggactttttcaatacacgattgacacagttgtcaaagatgtctcaaagtctgctaacttgtctttggatgctgtccaagagttggagctcaatgtagttccaattagacaagcttcaaatgtgacgggttttcttttcaccagtgtttttatctacttctttgcactgtttaaagcgtcttctttgaggcgcaattatattatgttggcagcgcgttttgctgtcattgttctttattgcccacttttatattattgtggtgcatttttagatgcaactattatttgttgcacacttattggcaggctttgtttagtctgcttttactcctggcgctataaaaatgcgctctttattatctttaatactacgacactttctttcctcaatggtaaagcagcttactatgacggcaaatccattgtgattctagaaggtggtgactattacatcacttttgggaactcttttgttgctttcgttagtagcattgacttgtatctagctatacgtgggcggcaagaagccgacctacagctgttgcgaactgttgagcttcttgatggcaagaagctttatgtcttttcgcaacatcaaattgtaggcattactaatgctgcatttgactcaattcaactagacgagtatgctacaattagtgaatgataatggtctagtagttaatgttatactttggcttttcgtactctttttcctgcttattataagcattactttcgtccaactggttaatctgtgcttcacttgtcaccggttgtgtaatagcgcagtttacacacctatagggcgtttgtatagagtttataagtcttacatgcaaatagaccccctccccagtactgttattgacgtataaacgaaatatgtctaacggttctattcccgttgatgaggtgattcaacaccttagaaactggaatttcacatggaatatcatactgacgatactactcgtagtgcttcagtatggccattacaagtactctgcgttcttgtatggtgtcaagatggctattctatggatactttggcctcttgtgttagcactgtcactttttgacgcatgggctagctttcaggtcaattgggtcttttttgctttcagcatccttatggcttgcatcactcttatgctgtggataatgtactttgtcaatagcattcggttgtggcgcaggacacattcttggtggtctttcaatcctgaaacagacgcgcttctcactacttctgtgatgggccgacaggtctgcattccagtgcttggagcaccaactggtgtaacgctaacactccttagtggtacattgcttgtagagggctataaggttgctactggcgtacaggtaagtcaattacctaatttcgtcacagtcgccaaggccactacaacaattgtctacggacgtgttggtcgttcagtcaatgcttcatctggcactggttgggctttctatgtccggtccaaacacggcgactactcagctgtgagtaatccgagttcggttctcacagatagtgagaaagtgcttcatttagtctaaacagaaactttatggcttctgtcagttttcaggatcgtggccgcaaacgggtgccattatccctctatgcccctcttagggttactaatgacaaacccctttctaaggtacttgcaaataatgctgtacccactaataaaggaaataaggaccagcaaattggatactggaatgagcaaattcgctggcgcatgcgccgtggtgagcgaattgaacaaccttccaattggcatttctactacctcggaacaggacctcacgccgacctccgctataggactcgtactgagggtgttttctgggttgctaaagaaggcgcaaagactgaacccactaacctgggtgtcagaaaggcgtctgaaaagcctatcattccaaatttctcccaacagcttcccagcgtagttgagattgttgaacctaacacacctcccacttcacgttcaaattcacgtagcaggagtcgtggtaatggcaacaacaggtccagatctccaagtaacaacagaggcaataaccagtcccgcggtaattcacagaatcgtggaaataaccaggatcgtggagcttctcagaacagaggaggcaataataataacaataacaagtctcgtaaccagtccaagaacagaaaccagtcaaatgaccgtggtggtgtaacatcacgcgatgatctggtggctgctgtcaaggatgcccttaaatctttgggtattggcgaaaaccctgacaagcttaagcaacagcagaagcccaaacaggaaaggtctgacagcagcggcaaaaatacacctaagaagaacaaatccagagccacttcgaaagaacgtgacctcaaagacatcccagagtggaggagaattcccaagggcgaaaatagcgtagcagcttgcttcggacccaggggaggcttcaaaaattttggagatgcggaatttgtcgaaaaaggtgttgatgcctcaggctatgctcagatcgccagtttagcaccaaatgttgcagcattgctctttggtggtaatgtggctgttcgtgagctagcggactcttacgagattacatataattataaaatgactgtgccaaagtctgatccaaatgtagagcttcttgtttcacaggtggatgcatttaaaactgggaatgcaaaaccccagagaaagaaggaaaagaagaacaagcgtgaaaccacgcagcagctgaatgaagaggccatctacgatgatgtgggtgtgccatctgatgtgactcatgccaatttggaatgggacacagctgttgatggtggtgacacggccgttgaaattatcaacgagatcttcgacacaggaaactaaacaatgtttgactggcttatcctggctatgtcccagggtggtgccattacactgttattactgagtgtttttctagtgacttggctgctgggctatggctttgccctctaactagcggtcttggtcttgcacacaacggtaagccagtggtaatgtcagtgcaagaaggatattaccatagcactgtcatgaggggaacgcagtaccttttcaactaaacctttgcacgagtaatcaaagatccgcttgacgagcctatatggaagagcgtgccaggtatttgactcaaggactgttagtaactgaagacctgacggtgttgatatggatacac

SEQ ID NO: 26 - DNA, 15447 bp, Porcine reproductive and respiratory syndrome virus
atgacgtataggtgttggctctacgccacgacatttgtattgtcaggagctgtgaccattggcacagcccaaaacttgctgcacgggaacaccctctcgtgacagccctcttcagggggattaggggtctgtccctaacaccttgcttccggagttgcactgctttacggtctctccacccttttaaccatgtctgggatactagatcggtgcacgtgtacccccaatgccagggtgtttgtggcggagggccaggtctactgcacacgatgtctcagtgcacggtctctccttcctctgaatctccaagttcctgagcttggggtgctgggcctattttataggcccgaagagccactccggtggacgttgccacgtgcattccccactgtcgagtgttcccccaccggggcctgctggctttctgcgatctttccgattgcacgaatgaccagtggtaacctgaactttcaacaaagaatggtgcgggtcgcaggtgaaatctacagagccggccaactcacccctacagttctgaagactatacaagtttatgaacggggttgtcgctggtaccccattgtcgggcccgtccctggggtgggcgtctacgccaactccctacatgtgagtgacaaacctttcccgggagcaactcatgtgttaaccaacttaccgctcccgcagaggcccaagcctgaggacttttgcccttttgagtgtgctatggctgacgtctatgacattggtcgtggcgccgtcatgtatgtggccggaggaaaagtctcctgggcccctcgtggtggggatgaagtgaaatttgaacctgtccccaaggagttgaagttggttgcgaaccgactccacacctccttcccgccccatcacgtagtggacatgtctaagtttaccttcatgacccctgggagtggtgtctccatgagggtcgagtatcaatacggctgcctccccgctgacactgtccctgaaggaaactgctggtggcgcttgtttgacttgctcccaccggaagttcagaataaagaaattcgtcatgctaaccaatttggctatcaaaccaagcatggtgtccctggtaagtacctacagcggaggctgcaagttaacggtcttcgagcagtgaccgacacacatggacctatcgtcatacagtacttctctgttaaggagagttggatccgccacctgaagccggtggaagaacccagcctccccgggtttgaggatctcctcagaatcagggttgagcccaatacgtctccactggctggaaagaatgagaagattttccggtttggcagtcataagtggtacggtgctggaaagagagcaaggaaagcacgctctggtgcgactaccatggtcgctcatcgcgcttcgtccgctcatgaaacccggcaggccacgaagcacgagggtgccggtgctaacaaggctgagcatctcaagctctactctccgcctgccgaagggaactgtggttggcactgcatttccgccatcgtcaaccggatggtgaattccaactttgagaccacccttcctgaaagagtaaggcctccagatgactgggccaccgacgaggatcttgtgaacaccatccaaatcctcaggctccctgcggccttggacaggaacggcgcttgcggtggcgccaagtacgtgcttaaactggagggtgagcattggactgtctctgtgaaccctgggatgtccccttctttgctcccccttgaatgtgttcagggctgttgtgagcataagggcggtcttggttccccggatgcggtcgaagtttccggatttgatcctgcctgtcttgaccgactgttacaggtaatgcacttgcctagcagtaccatcccagccgctctggccgaattgtccgacgactccaatcgtccggtttccccggccgctgctacgtggactgtttcgcaatcctatgctcgtcatagaggagggaatcatcatgaccaggtgtgcttagggaaaatcatcagcctttgtcaagttattgaggattgctgctgccatcagaataaaactaaccgggccactccggaagaggtcgcggcaaaaattgatcagtacctccgtggcgcaacaagtcttgaagaatgcttggccaaacttgagagagtttccccgccgggcgctgcggacacctcctttgattggaatgttgtgcttcctggggttgaggcggcgcatcagacaaccgaacaacttcacgtcaacccgtgccgcaccctggttcctcccgtgactcaagagcctttgggcaaagactcggtccctctgaccgccttctcgctgtccaattgctattaccctgcacaaggtaacgaggttcgtcaccgtgagaggttaaattccgtactctctaagttggaggaggttgtcctagaagaatatgggctcatgtccactggacttggcccgcgacccgtgctgccgagcggactcgacgagcttaaagatcagatggaggaggatctgctaaaactagccaacacccaggcgacttcagaaatgatggcctgggcggctgagcaggtcgatttaaaagcttgggtcaaaagctacccacggtggacaccaccaccccctccaccaagggttcaacctcgaaaaacaaagtctgtcaagagcttgccagaggacaagcctgtccccgctccgcgcaggaaggtcagatccggttgcggcagcccggttttaatgggcgacaatgtccctaacggttcggaagatttgactgtcggtggtcccctcaattttccgacaccatccgagccgatgacacctatgagtgagcccgtacttacgcccgcgctgcaacgtgtccccaagttgatgacacctttggatgggtcggccccggttcctgcaccgcgtagaactgtgtcccgaccgatgacgcccttgagtgagccaatttttttgtctgcaccgcgacacaaatttcagcaggtggaagaagcgaatccggcgacaacaacgctgacgcaccagaacgagcctctggatttgtctgcgtcttcacaaacggaatatgaggcttcccccctagcatcatcgcagaacatgagcatcctggaggcgggggggcaagaagctgaggaagttctgagtgaaatctcggatatactaaatgacaccagccctgcacctgtgtcatcaagcagctccctgtcaagtgttaagattacacgcccaaaatactcagctcaagccatcatcgactctggcgggccttgcagtgggcacctccaaaaggaaaaagaagcatgcctcagcatcatgcgtgaggcttgtgatgcgtccaagcttagtgatcctgctacgcaggaatggctttctcgcatgtgggatagggttgacatgctgacttggcgcaacacgtctgcttaccaggcgtttcgcaccttaaatggcaggtttgagtttctcccaaagatgattctcgagacaccgccgccccacccgtgcgggtttgtgatgttacctcacacgcctgcaccttccgtgagcgcagagagtgatctcaccattggttcagtagccactgaggatgttccacgcatcctcgggaaaataggagacaccggcgagctgcttaaccagggtccctcggcacccttcaagggaggaccggtctgtgaccaacctgccaaaaattcccggatgtcgccgcgggagtctgacgagagcataatagctccgcccgcagatacaggtggcgccggctcattcactgatttgccgtcttcggatagtgtggatgcgaacggaggggggccgttaagaacggtaaaaacaaaagcaggaaggctcttggaccaactgagctgtcaggtttttagcctcgtttcccatctccctgttttcttctcacacctcttcaaatctgacagtggttattctccgggtgattggggttttgcagcttttactctattttgcctctttctgtgttacagctacccattcttcggctttgctcccctcttgggtgtattttctgggtcttctcggcgtgtgcgaatgggggtttttggctgctggttggctttcgctgttggtctgttcaagcctgtgtccgacccagtcggcactgcttgtgagtttgactcgccagagtgtaggaacgtccttcattcttttgagcttctcaaaccttgggaccctgtccgcagccttgttgtgggccccgtcggtctcggccttgccattcttggcaggttactgggcggggcacgctacgtctggcactttttgcttaggtttggtattgttgcagattgtatcttggctggagcttatgtgctttctcaaggtaggtgtaaaaagtgctggggatcttgtgtaagaactgctcctaatgagatcgccttcaacgtgttccctttcacacgtgcgaccaggtcgtcactcatcgacctgtgcgatcggttttgtgcgccaaaaggcatggaccccatttttctcgccactgtgtggcgtgggtgctggaccggccggagtcccattgagcaaccctctgaaaaacccatcgcgttcgcccagctggatgaaaagaggattacggctagaactgtggtcgctcagccttatgatcctaaccaagccgtaaagtgcttgcgggtattacaggcgggtggggcgatggtggccgaggcagtcccaaaagtggtcaaggtttccgctattccattccgagctcctttttttcccgctggagtgaaagttgatcctgagtgcagaatcgtggttgaccccgatacttttactacagccctccggtctggctattccaccacgaacctcgtccttggtatgggggactttgcccagctgaatggactaaagatcaggcaaatttccaagccttcaggaggaggctcacacctcgttgctgccttgcatgttgcctgctcgatggcgttgcacatgcttgctggtgtttatgtaactgcagtggggtcttgcggtaccggtaccaacgatccgtggtgcactaacccgtttgccgcccctggctacggacctggctctctttgcacgtccagattgtgcatctcccaacacggtctcaccttgcccttgacagcacttgtggcgggattcggccttcaagagattgccttggtcgttttgatttttgtctccatggggggcatggctcataggttgagttgtaaggctgacatgctgtgcatcttactcgcaatagccagctatgtttgggtacctcttacctggttgctttgtgtgtttccttgttggttgcgctggttctctttgcaccccctcaccatcctatggttggtgtttttcttgatttctgtaaatataccctcgggaatcttggccgtggtgttattggtttctctctggcttttaggtcgttatactaacattgctggtctcgtcaccccctatgatattcatcattacaccagtggcccccgcggtgtcgccgccttggctaccgcaccagacggaacctacttggctgccgtccgccgcgctgcgttgactggtcgtaccatgctgtttaccccgtctcagctcgggtccctccttgagggcgctttcagaactcaaaagccctcactgaacaccgtcaatgtggtcgggtcctccatgggctctggcggagtgttcactattgacgggaaaatcaagtgcgtaactgccgcacatgtccttacgggtaactcagctagggtttccggggtcggcttcaatcaaatgcttgactttgatgtaaaaggggacttcgccatagctgattgcccgaattggcaaggggctgctcccaaggcccagttctgcgaggatgggtggactggtcgcgcctattggctgacatcctctggcgtcgaacccggtgtcattgggaatgggtttgccttctgcttcaccgcgtgtggcgattctggatccccagtgattaccgaagccggtgagcttgtcggcgttcacacaggatcaaacaaacaaggaggaggcattgtcacgcgcccctcaggccagttttgtaatgtgacgcccatcaagctgagcgagttgagtgaattcttcgctggacctaaggtaccgctcggtgatgtgaagattggcagtcacataattaaagacacatgcgaggtgccttcagatctttgtgccctgcttgctgccaaacctgaactggaaggaggcctttccaccgttcaacttctgtgtgtgtttttcctcctgtggagaatgatggggcatgcttggacgcccttggttgctgtggggttttttatcctgaatgaaattctcccagctgtcctggtccggagtgttttctcctttgggatgtttgtgctatcttggctcacaccatggtctgcgcaagtcctgatgatcaggcttctgacagcagcccttaacaggaacagattgtctcttggtttttacagtcttggtgcagtaaccagttttgtcgcagatcttgcggtaactcaagggcatccgttacaggtagtaatgaacttaagcacctatgccttcctgcctcggatgatggttgtgacctcgccagtcccagtgatcgcgtgtggtgttgtgcacctccttgccataattttgtacttgtttaagtaccgctgccttcactatgtccttgttggcgatggggtgttctcttcggctttcttcttgcgatactttgctgagggaaagttgagggaaggggtgtcgcaatcctgcgggatgagtcatgagtcgctgactggtgccctcgccatgagactcactgacgaggacttggatttccttacgaaatggactgattttaagtgctttgtttctgcgtccaacatgaggaatgcagcgggccaatttatcgaggctgcttatgcaaaagcactaagaattgaacttgctcagttggtacaggttgacaaggtccgaggcaccttggccaaacttgaggcttttgccgataccgtggcaccccaactctcgcccggtgacattgttgttgcccttggccacacgcctgttggcagcatcttcgacctaaaggttggtagcaccaagcacactctccaagccattgaaactagagtccttgccgggtccaaaatgactgtagcgcgtgtcgttgacccaacccctgcacccccacccgtacctgtgcccatccctctcccaccgaaagttctggagaacggtcccaacgcctggggggatgaggaccgtttgaacaagaagaagaggcgcaggatggaagccgtcggcatctttgtcatggacgggaaaaagtaccagaaattttgggacaagaattccggtgatgtgttttatgaggaggtccacaatagcacagacgagtgggagtgccttagagctggcgaccctgccgactttgaccctgagacaggggttcagtgtgggcatatcaccattgaagatagggtttacaatgtcttcacctccccatctggtaggaaattcttggtccccgccaaccccgagaatagaagagcccaatgggaagccgccaagctttccgtagagcaagcccttggtatgatgaacgtcgacggcgaactgactgccaaagaactggagaaactgaaaggaataattgacaaactccagggcctgactaaggagcagtgtttaaactgctagccgccagcggcttgacccgctgtggtcgcggcggcttagttgttactgagacagcggtaaaaatagtcaaatttcacaaccggaccttcaccctaggacctgtgaacttaaaagtggccagtgaggttgagctaaaagacgcggttgagcacaaccaacatccggttgccagaccagttgatggtggtgttgtgctcctgcgctctgcagttccttcgcttatagacgtcttgatctctggcgccgatgcatctcctaagttactcgcccgccacgggccgggaaacactgggattgatggcacgctttgggattttgaggccgaggctactaaagaggaagttgcactcagtgcgcaaataatacaggcttgtgatattaggcgcggcgacgcgcctgaaattggtctcccttataagttgtaccctgttaggggcaaccctgagcgggtaaaaggagttttacagaacacaaggtttggagacataccttacaaaacccccagtgacactggaagcccggttcacgcggctgcctgcctcacgcctaatgctaccccggtgactgatgggcgctccgtcttggctacaaccatgccctccggctttgagttgtatgtgccgaccattccagcgtccgtccttgattatcttgattctaggcctgactgccctaaacagttaacagagcacggttgtgaggatgctgcattaagagacctctccaagtatgatttggtcacccaaggctttgttttgcctggagttcttcgccttgtgcggaagtacctgttcgcccacgtgggtaagtgcccgcccgttcatcggccttccacttaccctgctaagaattctatggctggaataaatgggaacaggtttccaaccaaggacattcagagcgtccctgaaatcgacgttctgtgcgcacaggctgtgcgagaaaactggcaaactgttaccccttgcacccttaagaaacagtactgtgggaagaagaagactaggacaatacttggcaccaataacttcattgcgttggcccatcgggcagcgttgagtggtgttacccagggcttcatgaaaaaagcgttcaactcgcccatcgccctcgggaaaaacaaatttaaagagctacaaaccccggtcctaggcaggtgtcttgaagctgatcttgcatcctgcgatcgatccacacctgcaattgtccgctggtttgccgccaatcttctttatgaacttgcctgtgctgaagagcatttaccgtcgtacgtgctgaactgctgccacgacttactggtcacgcagtccggcgcggtgactaagagaggtggcctgtcgtctggcgacccgattacctctgtgtcaaacaccatttacagcttagtgatatatgcacagcacatggtgctcagttacttcaaaagtggtcaccctcatggccttctgtttctgcaagaccagctaaagtttgaggacatgctcaaggttcaacccctgatcgtctattcggacgaccttgtgctgtatgccgagtctccctccatgccaaactaccactggtgggttgaacatctgaatcttatgctgggtttccagacggacccaaagaagacagccataacagactcgccaacattcctaggctgcaggataataaatgggcgccagctagtccctaaccgtgacaggatcctcgcggccctcgcctaccacatgaaggcaagtaacgtttctgaatactacgcctcggcggctgcaatactcatggacagctgtgcttgtttagagtatgatcctgaatggtttgaagagctcgtggttgggatagcgcagtgtgcccgcaaggacggctacagctttcctggcccaccgttcttcttgtccatgtgggaaaaactcaggtccaatcatgaggggaagaagtccagaatgtgcgggtactgcatggccccggctccgtacgccactgcctgtggtctcgacgtctgtgtttaccacacccacttccaccagcattgtccagttataatctggtgtggccacccggcgggttctggttcttgtggtgagtgcgaaccccccctaggaaaaggcacaagccctctagatgaggtgttagaacaagttccgtataagcctccgcggactgtgatcatgcatgtggagcagggtctcacccctcttgacccaggcagataccagactcgccgcggattagtctccgttaggcgtggcatcaggggaaatgaagtcgacctaccagacggtgattacgctagtaccgccttgctccctacttgtaaagagatcaacatggtcgctgtcgcccctaacgtgttgcgcagcaggtttatcatcggcccacccggtgctgggaaaacacactggctccttcaacaagtccaggatggtgatgtcatttacacgccaactcaccagaccatgctcgacatgattagagctttggggacgtgccggttcaacgtcccagcaggtacaacgctgcaattccctgccccctcccgtaccggcccatgggtccgcatcttagccggcggttggtgtcctggtaagaattccttcctggatgaagcagcgtattgcaatcaccttgatgtcttaaggcttcttagtaaaacaactctcacttgcctaggagacttcaaacaactccatcctgtgggtttcgactctcattgctatgtttttgacatcatgcctcagacccaattaaagaccatctggagattcggacagaatatctgtgatgccatccaaccagattacagggacaaacttgtgtccatggtcaacacgacccgtgtgacctacgtggaaaaacctgtcaggtatgggcaagtcctcaccccctaccacagggaccgagaggacggcgccattactatcgactctagtcaaggcgccacatttgatgtggttacactgcatttgcccactaaagattcactcaacaggcaaagagcccttgtagctatcaccagggcaagacatgctatcttcgtgtatgacccacacaggcaattacagagcatgtttgatcttcccgcgaaaggcacacccgtcaatctcgcagtgcaccgtgacgagcagctgatcgtattagatagaaacaacaaagaaatcacggttgctcaggctctaggcaatggagataaattcagggccacagataagcgcgttgtagattctctccgcgctatttgcgcagatctggaagggtcgagctccccgctccccaaggtcgcgcataacttgggattttatttctcacctgatttgacacagtttgctaaactcccggcagaacttgcaccccactggcccgtggtgacaacccagaacaatgaaaggtggccagatcggctggtagccagccttcgccctatccataaatatagccgcgcgtgcattggtgccggctatatggtgggcccctcggtgtttctaggcacccctggggttgtgtcatactatctcacaaaatttgttaggggcgaggctcaagtgcttccggagacagtcttcagcaccggccgaattgaggtagattgtcgagagtaccttgatgatcgggagcgagaagttgctgagtccctcccacatgccttcatcggcgatgtcaaaggcactaccgttgggggatgtcatcatgttacctccaaataccttccgcgcttccttcccaaggaatcagttgcggtggtcggggtttcgagccccggggaagccgcgaaagcattttgcacattgacggacgtgtacctcccagaccttgaagcgtacctccacccagagacccagtccaagtgctggaaagtgatgttggactttaaggaagttcggctgatggtctggaaaggcaagacggcctattttcaacttgaaggccgccattttacctggtatcaacttgcaagttacacctcatacatccgagttcctgttaattctactgtgtacttggacccctgcatgggccctgctctttgcaacagaagggttgtcgggtccacccattggggagctgacctcgcagtcaccccttatgactacggtgccaaaattattctgtctagtgcatatcatggtgaaatgcctccaggttacaaaattctggcgtgcgcggagttctcgcttgatgatccagtaaggtacaaacacacctggggatttgaatcggatacagcgtatctgtacgagtttactgggaatggtgaggactgggaggattacaatggtgcgtttcgggcgcgccagaaagggaaaatttataaagctactgccaccagcatgaagtttcattttcccccgggccctgtcattgaaccaactttaggcctgaattgaaatgaaatggggtctatgcaaagcctctttgacaaaattggccaactttttgtggatgctttcacggaatttctggtgtccattgttgatatcatcatatttttggccattttgcttggcttcaccatcgccggttggctggtggtcttctgcatcagactggtttgctccgcggtactccgtgcgcgccctaccgttcaccctgagcaattacagaagatctcatgaggcctttctttctcagtgccaggtggacattccaacctggggcgtcaaacaccctttgggggtgctttggcaccataaggtgtcaaccctgattgatgaaatggtgtcgcgtcgaatgtaccgcatcatggaaaaagcagggcaggctgcctggaaacaggtggtgagcgaggctacactgtctcgcattagtagtttggatgtggtggctcattttcaacatcttgccgccattgaagccgagacctgtaaatatttggcttcccggctgcccatgctacacaacctgcgcatgacagggtcaaatgtaaccatagtgtataatagtacttcgaatcaggtgtttgccatttttccaacccctggttcccggccaaagcttcatgattttcagcaatggctaatagctgtacattcctccatattttcctccgttgcggcttcttgtactctttttgttgtgctgtggttgcgaattccaatgctacgttctgtttttggtttccgctggttaggggcaatttttcttttgaactcacggtgaattacacggtgtgtccaccttgcctcacccggcaggcagccgctgaggtctacgaacccggcaggtctctttggtgcaggatagggcatgaccgatgtggtgaggacgatcatgacgaactagggttcatggttccgcctggcctctccagcgaaggccacttgaccagtgtttacgcctggttggcgttcctgtccttcagctacacggcccagttccatcccgagatatttgggatagggaatgtgagtcaagtttatgttgacatcaagcaccaattcatctgcgccgttcacgacggggagaacgccaccttgcctcgccatgacaatatttcagccgtatttcagacctactaccagcatcaggtcgacggcggcaattggtttcacctagaatggctgcgccccttcttttcctcttggttggttttaaatgtttcgtggtctctcaggcgttcgcctgcaagccatgtttcagttcgagtctttcggacatcaagaccaacactaccgcagcatcaggctttgttgtcctccaggacatcagctgccttaggcatggcgactcgtcctctccgacgattcgcaaaagctctcagtgccgcacggcgatagggacgcccgtgtacatcaccatcacagccaatgtcacagatgagaattatttacattcttctgatctcctcatgctttcttcttgccttttctatgcttctgagatgagtgaaaagggattcaaagtggtgtttggcaatgtgtcaggcatcgtggctgtgtgtatcaactttaccagctacgtccaacatgtcaaggagtttacccaacgctccttggtggtcgatcatgtgcgactgcttcatttcatgacacctgagaccatgaggtgggcaaccgttttagcctgtctttttgccatcctactggcaatttgaatgttcaagtatgttggggaaatgcttgaccgcgggctgttgctcgcgattgctttctttgtggtgtatcgtgccgttctatcttgctgtgctcgtcaacgccagcaacaacagcagctctcatattcagttgatttataacttgacgctatgtgagctgaatggcacagattggctggcaaaaaattttaaccgggcagtggagacttttgtcatcttccccgtgttgactcacattgtttcctatggggcactcaccaccagccatttccttgacacagttggtctggtcactgtgtccaccgccggatattatcacaggcggtatgtcttgagtagcatttacgcagtctgtgctttggctgcgctgatttgttttgtcattaggcttgcgaagaactgcatgtcctggcgctactcttgcaccagatataccaacttccttctggacactaagggcaaactctatcgttggcggtcgcccgtcattgtggagaaagggggtaaggtagaggtcgaaggtcacctgatcgacctcaagagagttgtgcttgatggttccgtggcaacccctttaaccagagtttcagcggaacaatggggtcgtctttagacgacttctgcaatgatagcacagctccacaaaaggtgcttttggcgttttccattacctacacgccagtgatgatatatgctctaaaggtaagtcgcggccgactgctagggcttttgcaccttttgatctttctgaattgtgcttttaccttcgggtacatgacattcgtgcactttcagagcacaaatagggtcgcgctcactatgggagcagtagttgcacttctttggggagtgtactcagccatagaaacctggaaattcatcacctccagatgccgtttgtgcttgctaggccgcaagtacattctggcccctgcccaccacgtcgaaagtgccgcgggctttcatccgattgcggcaaatgataaccacgcatttgtcgtccggcgtcccggctccactacggttaacggcacattggtgcccgggttgaaaagcctcgtgttgggtggcagaaaagctgttaagcagggagtggtaaaccttgttaaatatgccaaataacgacggcaagcagcaaaagagaaagaaggggaatggccagccagtcaatcagctgtgccaaatgctgggtaagatcatcgcccaacaaaaccagtccagaggcaagggaccggggaagaaaaataagaagaaaaacccggagaagccccattttcctctagcgactgaagatgacgtcaggcatcactttacccctagtgagcggcaattgtgcctgtcgtcgatccagactgcctttaatcagggcgctggaacttgtgccctgtcagattcagggaggataagttacactgtggagtttagtttgccgacgcatcatactgtgcgtctgatccgcgccacagcatcaccctcagcatgatgggctggcattctttggtacctcagtgttagaatcgggagaatgtgtggtgaatggcactgattgacactgtgcctttaagtcacctattcaattagggcgaccgtgtgggggtaaagtttaattggcgagaaccatgcggccgccatttaaaaaaaaaaaaaaaaaaaaaaaaaaaaaaaaaaaa

SEQ ID NO: 27 - DNA, 15146 bp, Porcine reproductive and respiratory syndrome virus
atgatgtgtagggtattccccctacatacacgacacttctagtgtttgtgtaccttggaggcgtgggtacagccccgccccaccccttggcccctgttctagcccaacaggtatccttctctctcggggcgagtgcgccgcctgctgctcccttgcagcgggaaggacctcccgagtatttccggagagcacctgctttacgggatctccaccctttaaccatgtctgggacgttctcccggtgcatgtgcaccccggctgcccgggtattttggaacgccggccaagtcttttgcacacggtgtctcagtgcgcggtctcttctctctccagagcttcaggacactgacctcggtgcagttggcttgttttacaagcctagggacaagcttcactggaaagtccctatcggcatccctcaggtggaatgtactccatccgggtgctgttggctctcagctgttttccctttggcgcgtatgacctccggcaatcacaacttcctccaacgacttgtgaaggttgctgatgttttgtaccgtgacggttgcttggcacctcgacaccttcgtgaactccaagtttacgagcgcggctgcaactggtacccgatcacggggcccgtgcccgggatgggtttgtttgcgaactccatgcacgtatccgaccagccgttccctggtgccacccatgtgttgactaactcgcctttgcctcaacaggcttgtcggcagccgttctgtccatttgaggaggctcattctagcgtgtacaggtggaagaaatttgtggttttcacggactcctccctcaacggtcgatctcgcatgatgtggacgccggaatccgatgattcagccgccctggaggtactaccgcctgagttagaacgtcaggtcgaaatcctcattcggagttttcctgctcatcaccctgtcgacctggccgactgggagctcactgagtcccctgagaacggtttttccttcaacacgtctcattcttgcggtcaccttgtccagaaccccgacgtgtttgatggcaagtgctggctctcctgctttttgggccagtcggtcgaagtgcgctgccatgaggaacatctagctgacgccttcggttaccaaaccaagtggggcgtgcatggtaagtacctccagcgcaggcttcaagttcgcggcattcgtgctgtagtcgatcctgatggtcccattcacgttgaagcgctgtcttgcccccagtcttggatcaggcacctgactctggatgatgatgtcaccccaggattcgttcgcctgacatcccttcgcattgtgccgaacacagagcctaccacttcccggatctttcggtttggagcgcataagtggtatggcgctgccggcaaacgggctcgtgctaagcgtgccgctaaaagtgagaaggattcggctcccacccccaaggttgccctgccggtccccacctgtggaattaccacctactctccaccgacagacgggtcttgtggttggcatgtccttgccgccataatgaaccggatgataaatggtgacttcacgtcccctctgactcagtacaacagaccagaggatgattgggcttctgattatgatcttgttcaggcgattcaatgtctacgactgcctgctaccgtggttcggaatcgcgcctgtcctaacgccaagtaccttataaaacttaacggagttcactgggaggtagaggtgaggtctggaatggctcctcgctccctttctcgtgaatgtgtggttggcgtttgctctgaaggctgtgtcgcaccgccttatccagcagacgggctacctaaacgtgcactcgaggccttggcgtctgcttacagactaccctccgattgtgttagctctggtattgctgactttcttgctaatccacctcctcaggaattctggaccctcgacaaaatgttgacctccccgtcaccagagcggtccggcttctctagtttgtataaattactattagaggttgttccgcaaaaatgcggtgccacggaaggggctttcatctatgctgttgagaggatgttgaaggattgtccgagctccaaacaggccatggcccttctggcaaaaattaaagttccatcctcaaaggccccgtctgtgtccctggacgagtgtttccctacggatgttttagccgacttcgagccagcatctcagaaaaggccccaaagttccggcgctgctgttgtcctgtgttcaccggatgcaaaagagttcgaggaagcagccccagaagaagttcaagagagtggccacaaggccgtccactctgcactccttgccgagggtcctaacaatgagcaggtacaggtggttgccggtgagcaactgaagctcggcggttgtggtttggcagtcgggaatgctcatgaaggtgctctggtctcagctggtctaattaacctggtaggcgggaatttgtccccctcagaccccatgaaagaaaacatgctcaatagccgggaagacgaaccactggatttgtcccaaccagcaccagcttccacaacgacccttgtgagagagcaaacacccgacaacccaggttctgatgccggtgccctccccgtcaccgttcgagaatttgtcccgacggggcctatactctgtcatgttgagcactgcggcacggagtcgggcgacagcagttcgcctttggatctgtctgatgcgcaaaccctggaccagcctttaaatctatccctggccgcttggccagtgagggccaccgcgtctgaccctggctgggtccacggtaggcgcgagcctgtctttgtaaagcctcgaaatgctttctctgatggcgattcagcccttcagttcggggagctttctgaatccagctctgtcatcgagtttgaccggacaaaagatgctccggtggttgacgcccctgtcgacttgacgacttcgaacgaggccctctctgtagtcgatcctttcgaatttgccgaactcaagcgcccgcgtttctccgcacaagccttaattgaccgaggcggtccacttgccgatgtccatgcaaaaataaagaaccgggtatatgaacagtgcctccaagcttgtgagcccggtagtcgtgcaaccccagccaccagggagtggctcgacaaaatgtgggatagggtggacatgaaaacttggcgctgcacctcgcagttccaagctggtcgcattcttgcgtccctcaaattcctccctgacatgattcaagacacaccgcctcctgttcccaggaagaaccgagctagtgacaatgccggcctgaagcaactggtggcacagtgggataggaaattgagtgtgaccccccccccaaaaccggttgggccagtgcttgaccagatcgtccctccgcctacggatatccagcaagaagatgtcaccccctccgatgggccaccccatgcgccggattttcttagtcgagtgagcacgggcgggagttggaaaggccttatgctttccggcacccgtctcgcggggtctatcagccagcgccttatgacatgggtttttgaagttttctcccacctcccagcttttatgctcacacttttctcgccgcggggctctatggctccaggtgattggttgtttgcaggtgtcgttttacttgctctcttgctctgtcgttcttacccgatactcggatgccttcccttattgggtgtcttttctggttctttgcggcgtgttcgtctgggtgtttttggttcttggatggcttttgctgtatttttattctcgactccatccaacccagtcggttcttcttgtgaccacgattcgccggagtgtcatgctgagcttttggctcttgagcagcgccaactttgggaacctgtgcgcggccttgtggtcggcccctcaggcctcttatgtgtcattcttggcaagttactcggtgggtcacgttacctctggcatgttctcctacgtttatgcatgcttgcagatttggccctttctcttgtctatgtggtgtcccaggggcgttgtcacaagtgttggggaaagtgtataaggacagctcctgcggaggtggctcttaatgtatttcctttctcgcgcgccacccgtgtctctcttgtatccttgtgtgatcgattccaaacgccaaaaggggttgatcctgtgcacttggcaacgggttggcgcgggtgctggcgtggtgagagccccatccatcaaccacaccaaaagcccatagcttatgccaatttggatgaaaagaaaatgtctgcccaaacggtggttgctgtcccatacgatcccagtcaggctatcaaatgcctgaaagttctgcaggcgggaggggccatcgtggaccagcctacacctgaggtcgttcgtgtgtccgagatccccttctcagccccatttttcccaaaagttccagtcaacccagattgcagggttgtggtagattcggacacttttgtggctgcggttcgctgcggttactcgacagcacaactggtcctgggccgaggcaactttgccaagttaaatcagaccccccccaggaactctatctccaccaaaacgactggtggggcctcttacacccttgctgtggctcaagtgtctgcgtggactcttgttcatttcatcctcggtctttggttcacatcacctcaagtgtgtggccgaggaaccgctgacccatggtgttcaaatcctttttcatatcctacctatggccccggagttgtgtgctcctctcgactttgtgtgtctgccgacggggtcaccctgccattgttctcagccgtggcacaactctccggtagagaggtggggatttttattttggtgctcgtctccttgactgctttggcccaccgcatggctcttaaggcagacatgttagtggtcttttcggctttttgtgcttacgcctggcccatgagctcctggttaatctgcttctttcctatactcttgaagtgggttacccttcaccctcttactatgctttgggtgcactcattcttggtgttttgtctgccagcagccggcatcctctcactagggataactggccttctttgggcaattggccgctttacccaggttgccggaattattacaccttatgacatccaccagtacacctctgggccacgtggtgcagctgctgtagccacagccccagaaggcacttatatggccgccgtccggagagctgctttaactgggcgaactttaatcttcaccccgtctgcagttggatcccttctcgaaggtgctttcaggactcataaaccctgccttaacaccgtgaatgttgtaggctcttcccttggttccggaggggttttcaccattgatggcagaagaactgtcgtcactgctgcccatgtgttgaacggcgacacagctagagtcaccggcgactcctacaaccgcatgcacactttcaagaccaatggtgattatgcctggtcccatgctgatgactggcagggcgttgcccctgtggtcaaggttgcgaaggggtaccgcggtcgtgcctactggcaaacatcaactggtgtcgaacccggtatcattggggaagggttcgccttctgttttactaactgcggcgattcggggtcacccgtcatctcagaatctggtgatcttattggaatccacaccggttcaaacaaacttggttctggtcttgtgacaacccctgaaggggagacctgcaccatcaaagaaaccaagctctctgacctttccagacattttgcaggcccaagcgttcctcttggggacattaaattgagtccggccatcatccctgatgtaacatccattccgagtgacctggcatcgctcctagcctccgtccctgtagtggaaggcggcctctcgaccgttcaacttttgtgtgtctttttccttctctggcgcatgatgggccatgcctggacacccattgttgccgtgggcttctttttgctgaatgaaattcttccagcagttttggtccgagccgtgttttcttttgcactctttgtgcttgcatgggccaccccctggtctgcacaggtgttgatgattagactcctcacggcatctctcaaccgcaacaagctttctctggcgttctacgcactcgggggtgtcgtcggtttggccgctgaaatcgggacttttgctggcagattgtctgaattgtctcaagctctttcgacatactgcttcttacctagggtccttgctatgaccagttgtgttcccaccatcatcattggtggactccataccctcggtgtgattctgtggttattcaaataccggtgcctccacaacatgctggttggtgatgggagtttttcaagcgccttcttcctacggtattttgcagagggtaatctcagaaaaggtgtttcacagtcctgtggcatgaataacgagtccctaacggctgctttagcttgcaagttgtcacaggctgaccttgattttttgtccagcttaacgaacttcaagtgctttgtatctgcttcaaacatgaaaaatgctgccggccagtacattgaagcagcgtatgccaaggccctgcgccaagagttggcctctctagttcagattgacaaaatgaaaggagttttgtccaagctcgaggcctttgctgaaacagccaccccgtcccttgacataggtgacgtgattgttctgcttgggcaacatcctcacggatccatcctcgatattaatgtggggactgaaaggaaaactgtgtccgtgcaagagacccggagcctaggcggctccaaattcagtgtttgtactgtcgtgtccaacacacccgtggacgccttaaccggcatcccactccagacaccaacccctctttttgagaatggtccgcgtcatcgcagcgaggaagacgatcttaaagtcgagaggatgaagaaacactgtgtatccctcggcttccacaacatcaatggcaaagtttactgcaaaatttgggacaagtctaccggtgacaccttttacacggatgattcccggtacacccaagaccatgcttttcaggacaggtcagccgactacagagacagggactatgagggtgtgcaaaccaccccccaacagggatttgatccgaagtctgaaacccctgttggcactgttgtgatcggcggtattacgtataacaggtatctgatcaaaggtaaggaggttctggcccccaagcctgacaactgccttgaagctgccaagctgtcccttgagcaagctctcgctgggatgggccaaacttgcgaccttacagctgccgaggtggaaaagctaaagcgcatcattagtcaactccaaggtttgaccactgaacaggctttaaactgttagccgccagcggcttgacccgctgtggccgcggcggcctagttgtgactgaaacggcggtaaaaattataaaataccacagcagaactttcaccttaggccctttagacctaaaagtcacttccgaggtggaggtaaagaaatcaactgagcagggccacgctgttgtggcaaacttatgctccggtgtcatcttgatgagacctcacccaccgtcccttgtcgacgttcttctgaaacccggacttgacacaatacccggcattcaaccagggcatggggccgggaatatgggcgtggacggttctatttgggattttgaaaccgcacccacaaaggcagaactcgagttatccaagcaaataatccaagcatgtgaagttaggcgcggggacgccccgaacctccaactcccttacaagctctatcctgttaggggggatcctgagcggcataaaggccgccttatcaataccaggtttggagatttaccttacaaaactcctcaagacaccaagtccgcaatccacgcggcttgttgcctgcaccccaacggggcccccgtgtctgatggtaaatccacactaggtaccactcttcaacatggtttcgagctttatgtccctactgtgccctatagtgtcatggagtaccttgattcacgccctgacaccccttttatgtgtactaaacatggcacttccaaggctgctgcagaggacctccaaaaatacgacctatccacccaaggatttgtcctgcctggggtcctacgcctagtacgcagattcatctttggccatattggtaaggcgccgccattgttcctcccatcaacctatcccgccaagaactctatggcagggatcaatggccagaggttcccaacaaaggacgttcagagcatacctgaaattgatgaaatgtgtgcccgcgctgtcaaggagaattggcaaactgtgacaccttgcaccctcaagaaacagtactgttccaagcccaaaaccaggaccatcctgggcaccaacaactttattgccttggctcacagatcggcgctcagtggtgtcacccaggcattcatgaagaaggcttggaagtccccaattgccttggggaaaaacaaattcaaggagctgcattgcactgtcgccggcaggtgtcttgaggccgacttggcctcctgtgaccgcagcacccccgccattgtaagatggtttgttgctaacctcctgtatgaacttgcaggatgtgaagagtacttgcctagctatgtgcttaattgctgccatgacctcgtggcaacacaggatggtgccttcacaaaacgcggtggcctgtcgtccggggaccccgtcaccagtgtgtccaacaccgtatattcactggtaatttatgcccagcacatggtattgtcggccttgaaaatgggtcatgaaattggtcttaagttcctcgaggaacagctcaagttcgaggacctccttgaaattcagcctatgttggtatactctgatgatcttgtcttgtacgctgaaagacccacctttcccaattaccactggtgggtcgagcaccttgacctgatgctgggtttcagaacggacccaaagaaaaccgtcataactgataaacccagcttcctcggctgcagaattgaggcagggcgacagctagtccccaatcgcgaccgcatcctggctgctcttgcatatcacatgaaggcgcagaacgcctcagagtattatgcgtctgctgccgcaatcctgatggattcatgtgcttgcattgaccatgaccctgagtggtatgaggacctcatctgcggtattgcccggtgcgcccgccaggatggttatagcttcccaggtccggcatttttcatgtccatgtgggagaagctgagaagtcataatgaagggaagaaattccgccactgcggcatctgcgacgccaaagccgactatgcgtccgcttgtgggcttgatttgtgtttgttccattcgcactttcatcaacactgccctgtcactctgagctgcggtcaccatgccggttcaaaggaatgttcgcagtgtcagtcacctgttggggctggcagatcccctcttgatgccgtgctaaaacaaattccatacaaacctcctcgtactgtcatcatgaaggtgggtaataaaacaacggccctcgatccggggaggtaccagtcccgtcgaggtctcgttgcagtcaagaggggtattgcaggcaatgaagttgatctttctgatggagactaccaagtggtgcctcttttgccgacttgcaaagacataaacatggtgaaggtggcttgcaatgtactactcagcaagttcatagtagggccaccaggttccggaaagaccacctggctactgagtcaagtccaggacgatgatgtcatttacacacccacccatcagactatgtttgatatagtcagtgctctcaaagtttgcaggtattccattccaggagcctcaggactccctttcccaccacctgccaggtccgggccgtgggttaggcttattgccagcgggcacgtccctggccgagtatcatacctcgatgaggctggatattgtaatcatctggacattcttagactgctttccaaaacaccccttgtgtgtttgggtgaccttcagcaacttcaccctgtcggctttgattcctactgttatgtgttcgatcagatgcctcagaagcagctgaccactatttacagatttggccctaacatctgcgcagccatccagccttgttacagggagaaacttgaatctaaggctaggaacactagggtggtttttaccacccggcctgtggcctttggtcaggtgctgacaccataccataaagatcgcatcggctctgcgataaccatagattcatcccagggggccacctttgatattgtgacattgcatctaccatcgccaaagtccctaaataaatcccgagcacttgtagccatcactcgggcaagacacgggttgttcatttatgaccctcataaccagctccaggagtttttcaacttaacccctgagcgcactgattgtaaccttgtgttcagccgtggggatgagctggtagttctgaatgcggataatgcagtcacaactgtagcgaaggcccttgagacaggtccatctcgatttcgagtatcagacccgaggtgcaagtctctcttagccgcttgttcggccagtctggaagggagctgtatgccactaccgcaagtggcacataacctggggttttacttttccccggacagtccaacatttgcacctctgccaaaagagttggcgccacattggccagtggttacccaccagaataatcgggcgtggcctgatcgacttgtcgctagtatgcgcccaattgatgcccgctacagcaagccaatggtcggtgcagggtatgtggtcgggccgtccacctttcttggtactcctggtgtggtgtcatactatctcacactatacatcaggggtgagccccaggccttgccagaaacactcgtttcaacagggcgtattgccacagattgtcgggagtatctcgacgcggctgaggaagaggcagcaaaagaactcccccacgcattcattggcgatgtcaaaggtaccacggttggggggtgtcatcacattacatcaaaatacctacctaggtccctgcctaaggactctgttgccgtagttggagtaagttcgcccggcagggctgctaaagccgtgtgcactctcaccgatgtgtacctccccgaactccggccatatctgcaacctgagacggcatcaaaatgctggaaactcaaattagacttcagggacgtccgactaatggtctggaaaggagccaccgcctatttccagttggaagggcttacatggtcggcgctgcccgactatgccaggtttattcagctgcccaaggatgccgttgtatacattgatccgtgtataggaccggcaacagccaaccgtaaggtcgtgcgaaccacagactggcgggccgacctggcagtgacaccgtatgattacggtgcccagaacattttgacaacagcctggttcgaggacctcgggccgcagtggaagattttggggttgcagccctttaggcgagcatttggctttgaaaacactgaggattgggcaatccttgcacgccgtatgaatgacggcaaggactacactgactataactggaactgtgttcgagaacgcccacacgccatctacgggcgtgctcgtgaccatacgtatcattttgcccctggcacagaattgcaggtagagctaggtaaaccccggctgccgcctgggcaagtgccgtgaattcggggtgatgcaatggggtcactgtggagtaaaatcagccagctgttcgtggacgccttcactgagttccttgttagtgtggttgatattgtcattttccttgccatactgtttgggttcaccgtcgcaggatggttactggtctttcttctcagagtggtttgctccgcgcttctccgttcgcgctctgccattcactctcccgaactatcgaaggtcctatgaaggcttgttgcccaactgcagaccggatgtcccacaatttgcattcaagcacccattgggtatgctttggcacatgcgagtttcccacttgattgatgagatggtctctcgtcgcatttaccagaccatggaacattcaggtcaagcggcctggaagcaggtggttggtgaggccactctcacgaagctgtcagggctcgatatagtcactcatttccaacacctggccgcagtggaggcggattcttgccgctttctcagctcacgactcgtgatgctaaaaaatcttgccgttggcaatgtgagcctacagtacaacaccacgttggaccgcgttgagctcatcttccccacgccaggtacgaggcccaagttgaccgatttcagacaatggctcatcagtgtgcacgcttccattttttcctctgtggcttcatctgttaccttgttcatagtgctttggcttcgaattccagctctacgctatgtttttggtttccattggcccacggcaacacatcattcgagctgaccatcaactacaccatatgcatgccctgttctaccagtcaagcggctcgccaaaggctcgagcccggtcgtaacatgtggtgcaaaatagggcatgacaggtgtgaggagcgtgaccatgatgagttgttaatgtccatcccgtccgggtacgacaacctcaaacttgagggttattatgcttggctggcttttttgtccttttcctacgcggcccaattccatccggagttgttcgggatagggaatgtgtcgcgcgtcttcgtggacaagcgacaccagttcatttgtgccgagcatgatggacacaattcaaccgtatctaccggacacaacatctccgcattatatgcggcatattaccaccaccaaatagacgggggcaattggttccatttggaatggctgcggccactcttttcttcctggctggtgctcaacatatcatggtttctgaggcgttcgcctgtaagccctgtttctcgacgcatctatcagatattgagaccaacacgaccgcggctgccggtttcatggtccttcaggacatcaattgtttccgacctcacggggtctcagcagcgcaagagaaaatttccttcggaaagtcgtcccaatgtcgtgaagccgtcggtactccccagtacatcacgataacggctaacgtgaccgacgaatcatacttgtacaacgcggacctgctgatgctttctgcgtgccttttctacgcctcagaaatgagcgagaaaggcttcaaagtcatctttgggaatgtctctggcgttgtttctgcttgtgtcaatttcacagattatgtggcccatgtgacccaacatacccagcagcatcatctggtaattgatcacattcggttgctgcatttcctgacaccatctgcaatgaggtgggctacaaccattgcttgtttgttcgccattctcttggcaatatgagatgttctcacaaattggggcgtttcttgactccgcactcttgcttctggtggctttttttgctgtgtaccggcttgtcctggtcctttgccgatggcaacggcgacagctcgacataccaatacatatataacttgacgatatgcgagctgaatgggaccgactggttgtccagccattttggttgggcagtcgagacctttgtgctttacccggttgccactcatatcctctcactgggttttctcacaacaagccatttttttgacgcgctcggtctcggcgctgtatccactgcaggatttgttggcgggcggtacgtactctgcagcgtctacggcgcttgtgctttcgcagcgttcgtatgttttgtcatccgtgctgctaaaaattgcatggcctaccgctatgcccgtacccggtttaccaacttcattgtggacgaccgggggagagttcatcgatggaagtctccaatagtggtagaaaaattgggcaaagccgaagtcgatggcaacctcgtcaccatcaaacatgtcgtcctcgaaggggttaaagctcaacccttgacgaggacttcggctgagcaatgggaggcctagacgatttttgcaacgatcctatcgccgcacaaaagctcgtgctagcctttagcatcacatacacacctataatgatatacgcccttaaggtgtcacgcggccgactcctggggctgttgcacatcctaatatttctgaactgttcctttacattcggatacatgacatatgtgcattttcaatccactaaccgtgtcgcacttaccctgggggctgttgtcgcccttctgtggggtgtttacagcttcacagagtcatggaagtttatcacttccagatgcagattgtgttgccttggccggcgatacattctggcccctgcccatcacgtagaaagtgctgcaggtctccattcaatctcagcgtctggtaaccgagcatacgctgtgagaaagcccggactaacatcagtgaacggcactctagtaccaggacttcggagcctcgtgctgggcggcaaacgagctgttaaacgaggagtggttaacctcgtcaagtatggccggtaaaaaccagagccagaagaaaaagaaaagtacagctccgatggggaatggccagccagtcaatcaactgtgccagttgctgggtgcaatgataaagtcccagcgccagcaacctaggggaggacaggccaaaaagaaaaagcctgagaagccacattttcccctggctgctgaagatgacatccggcaccacctcacccagactgaacgctccctctgcttgcaatcgatccagacggctttcaatcaaggcgcaggaactgcgtcgctttcatccagcgggaaggtcagttttcaggttgagtttatgctgccggttgctcatacagtgcgcctgattcgcgtgacttctacatccgccagtcagggtgcaagttaatttgacagtcaggtgaatggccgcgattggcgtgtggcctctgagtcacctattcaattagggcgatcacatgggggtcatacttaatcaggcaggaaccatgtgaccgaaattaaaaaaaaaaaaaaaaaaaaaaaaaaaaaaaaaaaaaaaaaaaaaaaa

SEQ ID NO: 28 - DNA, 15398 bp, Porcine reproductive and respiratory syndrome virus
atgacgtataggtgttggctccataccacgacatttgtattgtcaggagctgtgaccattggcacagcccaaaacttgctgcgcggaaacacccttccgtgacagccctcttcaggggagattaggggtctgtccctagcaccttgcttccggagttgcactgctttacggtctctccacccctttaaccatgtctgggatacttgatcggtgcacgtgtacccccaatgccagggtgtttatggcggagggccaagtctattgcacacgatgtctcagcgcacggtccctccttcctctaaatctccaagttcctgagcttggggtgctgggcttattttataggcctgaagagccactccggtggacgttgccacgtgcattccccactgtcgagtgctccccagccggggcctgctggctttctgcgatctttccaatcgcacgaatgaccagtggaaacctgaactttcaacaaagaatggtgcgggtcgccgctgagatctacagggccggccaactcacccctgcagttctgaaggttctacaagtttatgaacggggttgtcgctggtaccccattgtcggacctgtccctggagtgggcgtttacgctaactccttacatgtgagtgacaaacctttcccgggggccactcatgtgttgactaacttaccgctcccgcagaggcccaagcctgaggacttttgccctttcgagtgtgctatggctgacgtctatgacatcggtcatggcgccgtcatgtttgtggccggaggaaaagtctcctgggcccctcgtggcggggatgaagtgagatttgaaactgtccccgaagagttgaagttgattgcgaatcgactccacatctctttcccgccccaccacttagtggacatgtccaagtttgctttcatagtccctgggagtggtgtttctttgcgggtcgagcaccaacacggctgcctccccgctgatattgtccctaaaggaaactgctggtggtgcttgtttgatttgctcccaccaggagttcagaatagagaaatccgctatgctaaccaatttggctatcaaaccaagcatggtgtctctggcaagtacctacagcggaggctgcaaatcaatggtcttcgagcggtgaccgacacacatggacctatcgtcgtacagtacttctccgttaaggagagttggatccgccactttaggttggcaggagaacccagcctccctggttttgaggaccttctcagaatcagggttgagtccaatacgtcaccactggctgacaaggatgagaagatcttccggtttggcagtcacaagtggtacggtgctggaaagagagcaaggaaagcacgctctggtgcgactaccacggttgctcatcgcgcttcgtccgctcgtgaaacccggcaggccaagaagcacgaaggtgttgacgctaacaatgcggctcatctcgagcactactctccgcctgccgaagggaactgtggttggcactgcatctccgccatcgtcaaccggatggtgaattccaactttgaaactacccttcccgaaagagtaaggccttcagatgattgggctactgatgaggattttgtgaacaccatccaaatcctcaggctccctgcggccttggataggaacggtgcttgcaaaagcgccaagtacgtgcttaagctagagggtgagcattggaccgtctctgtggcccctgggatgtccccttctttgctcccccttgaatgtgttcagggttgttgtgagcataagggcggtcttggttccccagatgcggtcgaagtttccgggtttgatcctacctgccttgaccgcctagctgaggtaatgcacttgcctagcagtgtcatcccagccgctctggccgaaatgtccaacaattctgatcgtccagcttccctggtcaatactgcgtggactgtttcgcaattctatgcccgtcacacaggaggaaatcatcgtgaccaggtgcgcttagggaaaatcatcagcctttgtcaagttattgaggaatgctgctgtcatcagaataaaaccaaccgggctactccggaagaggtggcggcaaagattgatcagtacctccgtggtgcaacgagtcttgaagaatgcttgatcaagcttgagagagtttccccgccgagcgctgcggacacctcctttgactggaatgttgtgcttcctggggttgaggcggcgggcccgacaactgagcaaccccacgccaaccagtgctgcgccccggttcctgtcgtgactcaagagcctttagacaaagactcggttcctctgaccgccttctcgctgtccaattgttactaccctgcacaaggtgatgaggttcgtcaccgcgagaggttaaattccgtactctctaagttggaggaggttgttctagaagaatatgggctcatgcccactgggctcggcccgcgacccgtgctgccgagcgggctcgacgagcttaaagaccagatggaggaggatctgctaaaactagccaacgcccaggcgacttcagaaatgatggccttggcagccgagcaggttgatttaaaagcttgggtcaaaagctacccgcggtggataccaccaccccctccaccaaaagttcaacctcgaagaatgaagcctgttaagagcctgccagagaacaagcctgtccccgctccacgcaggaaggtcagatccgacccaggtaaatcgattttggctgtcggtggtccccttaatttttcgacaccatcagagctggtgacacctctgggtgagcctgtgcttatgcctgcgtcgcaacatgtttctaggccagtgacacctttgagtgagccggccccagttcctgcaccgcgtaggattgtgtcccgaccgatgacgcccttgagtgagccaacttttgtgtttgcaccgtggcgcaaatctcagcaggtggaagaagcgaacccggcggcagcaacgctgacgtgccaagatgaacctctagatttgtctgcgtcctcacagactgaatatgaggcttatcccctagcaccgttggagaacataggtgttctggaagcgggggggcaagaagccgaggaagttctgagtggaatttcggatatactggacaacaccaaccctgcacctgtgtcatcaagcagttccttgtcaagtgtcaaaatcacacgcccaaaatactcagctcaagccattatcgactcgggcgggccctgcagtgggcatctccaaaaggaaaaagaagcgtgcctccgcatcatgcgcgaggcttgtgatgcggctaggcttggtgaccctgccacgcaggaatggctttctcacatgtgggatagggttgacgtgctaacttggcgcaacacgtctgtttaccaggcgttccgcaccttggatggcaggtttgggtttctcccaaagatgattctcgagacaccgccgccctacccgtgtgggtttgtgatgttacctcacacgcctacaccttccgtgagcgcagagagcgacctcaccatcggttcagtggccactgaagatgttccacgcatcctcgggaaaacagaaaataccggcaatgtgctcaaccagaagcccttggcactcttcgaagaagaaccggtctgcgaccaacctgccaaagactcccggacattgtcacgggagtctggcgatagtacaacggctccgcccgtgggcacaggtggcgccggcttgcccactgatctgccgcctctagatggtgtggatgcggacgggggggggttgttgagaacggcaaaaggaaaagctgaaaggttctttgaccaattgagccgtcaggttttcaacatcgtctcccatctccctgttttcttctcacacctcttcaaatctgacagtggttattctccgggtgattggggttttgcagctttcactctattttgcctctttctgtgttacagctacccattcttcggttttgctcccctcttgggtgtattttctgggtcttctcggcgcgtgcgaatgggggtttttggctgctggttggcttttgctgttggtctgttcaagcctgtgtccgacccagtcggtgctgcttgtgaatttgactcgccagagtgtagaaacatccttcattcttttgagcttctcaaaccttgggaccctgttcgcagccttgttgtgggccccgtcggtctcggtcttgccattcttggcaggttactgggtggggcacgctacatctggcactttttgcttaggcttggcattgttgcagattgcatcttggctggagcttatgtgctttctcaaggtaggtgtaaaaagtgctggggatcttgtataagaactgctcctaatgagattgcattcaatgtgttcccttttacacgtgcgactaggtcgtcactcatcgacctgtgcgatcggttttgtgcgccaaaaggcatggaccccattttcctcgccactgggtggcgcgggtgctggaccggccaaagtcccatcgagcaaccctcagaaaagcccatcgcgttcgcccagttggatgaaaagaggattacggccagaactgtggtctctcagccttatgaccccaaccaagccgtaaagtgcttgcgggtgttacaagcgggcggggcgatggtggccgaggcagtcccaaaagtggtcaaggtttccgccatcccattccgagctccttttttcccaaccggagtgaaagttgatcctgagtgcaggatcgtggttgaccccgatacttttactacagccctccggtctggctattccaccacgaacctcgtccttggtgtgggggactttgcccagctgaatgggctaaagatcaggcaaatttccaagccctcgggaggaggcccacatctcattgctgccctgcatgttgcctgctcgatggtgttgcacatgcttgctggtgtttatgtgaccgcagtggggtcttgcggtaccggtaccagcgatccgtggtgcgctaacccgttcgccgtccctggctacggacctggctctctttgtacgtccagattatgcatctcccaacatggccttaccctgcccttgacagcacttgtggcgggatttggtcttcaggagattgccttggtcgttttgattttcgtctccatcggaggcatggctcacaggttgagttgcaaggctgatatgctgtgcatcttacttgcaatagccagctatgtttgggtgccccttacttggttgctttgtgtgtttccttgttggttgcgctggttctctttgcacccccttaccatcctatggttggtatttttcttgatttctgtaaatatgccttcgggaatcttggccgtggtgttgttggtttctctttggcttttaggtcgttatactaacattgctggtcttgtcaccccctatgatattcatcattacactagtggcccccgcggtgttgccgctttggctaccgcaccagatggaacctacttggctgctgtccgccgcgctgcgttgactggtcgcaccatgctgtttaccccgtctcagctcgggtccctccttgagggcgcttttagaactcgaaagccctcactgaacaccgtcaatgtggtcgggtcctccatgggctctggcggtgtgttcaccatcgacgggagaattaagtgcgtgactgccgcacacgtccttacgggcaattcagctagggtttccggggtcggcttcaatcaaatgcttgactttgatgtaaaaggggacttcgccatagctgattgcccgaattggcaaggggttgctcccaaaacccaattctgcggggatggatggactggccgcgcctattggctgacatcttctggcgtcgaacccggtgtcattggggatggatttgccttctgcttcaccgcgtgcggcgattctggatccccagtgattaccgaagccggtgagcttgtcggcgtccacacaggatcaaacaaacaaggaggaggcattgtcacgcgcccctcaggtcagttttgtaatgtgacacccatcaagctgagcgagttgagtgaattcttcgctgggcctaaggtcccgctcggtgatgtgaaggttggcagtcacataattaaggacacaagcgaggtgccttcagatctttgcgccttgcttgctgccaaacccgaactggaagggggcctttccaccgtccaacttttatgcgtgttttttctcctgtggagaatgatggggcatgcctggacgcccttggttgctgtgggtttttttatcttgaatgaggttctcccagctgtccttgtccggagtgtcttctcctttgggatgtttgcgctatcttggctcacaccgtggtctgcgcaagttctgatgatcaggcttctaacagcagctctcaacaggaacagagtgtcacttatcttttacagccttggtgcagtgaccggttttgttgcagatcttgcgacaactcaagggcacccgctacaggcagtaatgaacttaagcacctatgccttcctgcctcggatgatggttgtgacttcaccagtcccagcgatcgcgtgtggtgtcgtgcacctccttgccataattttgtacttgtttaagtaccgctgcctgcaccatgtccttgttggcgacggagcgttctccgcggctttcttcttgcgatactttgccgagggaaagctgagagaaggggtgtcgcaatcctgtgggatgagtcatgagtcgctaactggtgcccttgccataaaactcagtgatgaagacttggatttcctcacgaaatggactgatttcaagtgctttgtttctgcgtccaacatgaggaatgcagcgggccaatttatcgaggctgcctatgcaaaagcactcagaattgaacttgctcagttggtgcaggttgataaggtccgaggcaccttggctaaacttgaagcttttgccgataccgtggcaccccaactctcgcctggcgacattgttgttgcccttggccatacgcctgttggcagtatcttcgacctaaaggttggtagcaccaagcatactctccaagccattgaaactagagtccttgccgggtccaaaatgactgtggcgcgtgtcgttgatccaactccggcacccccacccgcacctgtacccatccctctcccaccgaaagttctagaaaatggccccaacgcctgggggggtgaggaccgtttgaacaagaggaagaggcgcaggatggaagccgtcggcatctttgttatggacggaaaaaaataccagaaattttgggacaagaattccggtgacgtgttttatgaggaggtccacaatagcacagatgagtgggagtgcctcagagccggcgaccctgccgattttgaccctgagacaggaattcagtgtgggcatgtcaccattgaagataaggtttacaatgtcttcacctcaccatctggtaggaggttccttgtccctgccaatcctgagaatagaagaatccaatgggaagctgccaggctttccgtagagcaagcccttggtatgatgaacgtcgacggcgaactgactgccaaagaactggagaaattgaaaagaataatcgacaaactccagggcctgaccaaagagcagtgtttaaactgctagccgccagtggcttgacccgctgtggtcgcggcggcttggttgttactgagacagcggtaaaaatagtaaaatttcacaaccggaccttcaccctaggacctgtgaacttaaaagtggccagtgaggttgagctaaaggacgcggtcgagcacaaccaatatccggttgccaaaccggttgatggtggtgttgtgctcctgcgctccgctgttccttcgcttatagatgtcttgatctccggcgctgatgcatctcctaagttacttgcccgccacgggccgggaaacactgggattgatggcacgctttgggattttgaggccgaggccaccaaagaggaagtcgcacttagtgcgcaaataatacaggcttgtgacattaggcgcggtgacgcacctgaaattggtctcccttataagctgtaccctgttaggggcaaccctgagcgggtgaaaggagttttacagaatacaaggtttggagacataccttaccgaacccccagtgacactggaagcccagtgcatgcggctgcctgcctcacgcccaatgctactccggtgactgatgggcgttccgtcttggccacaaccatgccctccggttttgagttgtatgtaccgaccattccagcgtccgtccttgattatcttgattctaggcctgactgccctaaacagttgacagagcacggttgtgaggatgctgctttaagggacctctccaaatacgatttgtccacccaaggctttgttttgcctggagttcttcgccttgtgcggaagtacctgtttgcccatgtgggtaagtgcccgcccgttcatcggccttccacttaccctgccaagaattctatggctggaataaatgggaacagatttccaaccaaggatattcagagcgtccctgaaatcgacgttctgtgcgcacaggctgtgcgagaaaactggcaaactgttactccttgtaccctcaagaagcagtattgtgggaagaagaagactaggacaatacttggcactaataactttatagcgttggcccaccgggcagcgttgagtggtgttacccagggcttcatgaaaaaggcattcaactcgcccatcgccctcggaaaaaacaaatttaaggaactacatactccagttttaggcaggtgccttgaagctgatcttgcatcctgcgatcgatccacacctgcaattgtccgctggttcgctgccaatcttctttatgaactcgcctgtgctgaagagcatctaccgtcgtacgtgcttaactgctgtcacgacctactggttacgcagtccggcgcggtgactaagagaggcggcctgtcgtctggcgacccgattacctccgtgtcaaacaccatttacagcttagtaatatatgcacagcacatggtgctcagttactttaaaagtggtcaccctcatggccttctgtttctgcaagaccagctaaagtttgaggacatgctcaaggttcaacccctgatcgtctattcagacgacctcgtgctgtatgccgagtctcccaccatgccaaattaccactggtgggttgaacatctgaaccttatgctaggtttccaaacggacccaaagaagacagccataacagactcgccatcatttctaggttgcaggttaataaatgggcgtcagctagtccctaaccgtgacaggattcttgcggccctcgcctaccatatgaaggcaagcaatgtctctgaatactacgcctcggcggctgcaatacttatggacagctgtgcttgtttagagtatgatcctgagtggtttgaagagctcgtggttggtatagcgcagtgcgcccgcaaggacggttacagcttcccaggcccgccgttcttcttgtccatgtgggaaaaactcaggtccaatcatgaagggaagaagtccagaatgtgcgggtactgcggagccccggctccgtacgccactgcctgtggcctcgacgtctgtacttaccacacccatttccaccagcattgtcctgtcataatctggtgtggccacccggcgggttctggctcttgtagtgagtgtaaatctcccctgggaaaaggcacaagtcctctggatgaggtgctagaacaagtcccgtataagcctccgcggactgtaatcatgcatgtggagcagggtctcacccctcttgacccaggtagataccaaactcgccgcggattagtctccgttaggcgtggcatcaggggaaacgaagttgacctgccagacggtgattatgccagtaccgccttgctccccacttgtaaagagatcaacatggtcgctgtcgcctccaacgtgttgcgcagcaggttcatcatcggtccccccggcgctgggaaaacacactggctcctccaacaggtccaggatggtgatgtcatttacacgccaactcaccagaccatgcttgacatgattagggctttgggggtgtgccggttcaacgtcccagcgggtacgacgctgcaattccctgccccctctcgtaccggcccgtgggttcgcatcttggccggcggttggtgtcctggtaagaattcctttttggacgaagcagcgtattgcaatcaccttgatgtcttgaggcttcttagcaaaaccacccttacctgcctaggagatttcaaacaactccacccggtgggttttgactctcattgctatgtttttgacatcatgcctcagacccaactgaagaccatctggagattcggacagaatatctgtgatgccatccaaccagattacagggacaaacttatgtccatggtcaacacaacccgtgtaacccaggtggacaaacctgtcaggtatgggcaagtcctcaccccctaccacagggaccgagaggacggcgccatcactatcgactccagtcaaggtgccacatttgatgtggttacactgcatttgcccgctaaagattcactcaacaggcaacgagcccttgttgctatcaccagggcaagacatgcagtcttcgtgtatgacccacacaggcaattgcagagcatgtttgatcttcctgcgaaaggcacacccgtcaacctcgcagtgctccgtgacgagcagctgatcgtactagatagaaataacaaagaatgcacggttgctcaggctttaggcaatggagataaattcagggctacagacaagcgcgttgtagattctctccgcgccatttgtgcagatctggaagggtcgagctccccgctccccaaagttgcacataacttggggttctatttctcacctgatttgacacagtttgctaaactcccagcagaactcgcaccccactggcccgtggtaacaacccagaacaatgaaaagtggcctgatcggctggttgccagccttcgccccatccataaacatagccgcgcgtgcattggtgcaggctatatggtgggcccctcggtgtttctaggcaccccaggggttgtgtcatactacctcacaaaatttgttaggggcgaggctcaagtgcttcctgagacagtcttcagcaccggccgaattgaggtagattgccgggagtacctcgatgatcgggagcgagaagttgctgagtccctcccacatgccttcattggcgacgtcaaaggcactaccggtgggggatgtcatcacgtcacctccagataccttccgcgcttcctttctaaggaatcagttgcggtagtcggggtttctagccccggaaaagctgcaaaggcagtttgcacattaacagatgtgtacctcccagatcttgaagcgtacctccacccagagacccagtccaagtgctggaaagtgatgttggattttagagaagtccgactgatggtctggaaagacaagacggcctattttcaacttgaaggccgccatttcacctggtatcaacttgcaagctacgcctcatacatccgagttcctgttaattctacagtgtatttggacccctgcatgggccctgccctttgcaacaggagggttgttgggtccgcccattggggagctgacctcgcggtcaccccttatgattacggttccaaaatcattctgtctagtgcataccatggtgaaatgcctccagggtacaaaattctggcgtgcgcggagttctcgcttgacgacccagtgaggtacaaacacacttggggatttgaatcggatacagcgtatctgtacgagtttactgggaatggtgaggactgggaggattataatgaagcgtttcgggcgcgccagaaagggaaaatttataaggctactgccaccagcatgaagtttcattttcccccgggccctgtcattgaaccaactttaggcctgaactgaaatgaaatggggtctatgcagagcctctttgacaaaattggtcaactttttgtggatgctttcacggaatttttggtgtccattgttgatatcatcatatttttggccattttgtttggcttcaccatcgccggctggctggtggtcttttgcatcagactggtttgctccgcgatattccgtgcgcgccctaccgttcaccctgagcaattacagaagatcctatgaggcctttctttctcaatgccaggtggacattcccacctggggcgttaaacaccctttgggaatactttggcaccataaggtgtcaaccctgattgatgaaatggtgtcgcgtcgaatgtaccgcatcatggaaaaagcagggcaggctgcctggaaacaggtggtgagcgaggctacactgtctcgcattagtaatttggatgtggtggctcattttcaacaccttgccgccattgaggccgagacctacaaatacttggcttcccggctgcccatgcttcacaacctgcgcatgacagggtcaaatgtaaccatagtgtataatagtaccttgaatcaggtatttgctattttcccaacctctggttcccgaccaaggctccatgattctcagcaatggctaatagctgtacattcctccatattttcctctgttgtggcttcttgtactctttttgttgtgctgtggttgcgaattccaatgctacgttctgtttttggtttccgctggttaggggcaatttttcttttgaactcacggtgaattacacggtgtgtccgccttgcctcacccggcaggccgctgctgaggtctatgaacccggtaggtctctttggtgcaggatagggcatgaccgatgcggtgaggacgaccatgacgaactagggttcatggttccgcctggcctcagcgaaggccacttgaccagtgtttacgcctggttggcgttcctgtcattcagctacacggcccagttccatcccgagatatttgggatagggaacgtgagtcaagtttatgttgacatcaagaaccaattcatttgcgccgtccacgacggggagaacgccaccctgcctcgccatgacaacatttcagccgtatttcagacctactaccaacatcaggtcgacggcggtaattggtttcacctagaatggctgcgccccttcttttcctcttggttggttttgaatgtttcgtggtttctcaggcgttcgcctgcaagccatgtttcagttcaagtctttcagacatcaagaccaacactaccgcagcatcaggctttgttgtcctccaggacatcagctgccttaggtatggcgactcgccccctccgacggttcgcaagagctctcagtgccgcacggcgatagggacacccgtgtacatcaccatcacagccaatgtcacagatgagaattatttacattcttctgatctcctcatgctttcctcttgccttttctatgcttctgagatgagtgaaaagggattcaaagtggtatttggcaatgtgtcaggcatcgtggctgtgtgtgttaactttaccagctacgtccaacatgtcaaggagttcacccaacgctccttggtagtcgatcatgtgcgactgcttcatttcatgacacctgagaccatgaggtgggcaaccgttttagcctgtctttttgccatcctactggcaatttgaatgttcaagtatgttggggaaatgcttgaccgcgggctgttactcgcaattgctttctttgtggtgtatcgtgccgttctgttttgctgtgctcgtcaacgccagcagcaacagcagccctcattttcagttgatttataacttgacgctatgtgagctgaatggcacagattggctggcagaaagatttgactgggcagtggagacttttgtcatttttcctgtgctgactcacattgtttcctatggagcactcaccaccagccattttcttgacacggttggtctaatcactgtgtccaccgccgggttctatcacaggcggtatgtcttgagtagtatctatgcggtctgtgctttggctgcgttgatttgcttcgtcattaggcttgcgaagaactgcatgtcctggcgctactcttgtactagatacaccaacttccttctggacactaagggcagactctatcgttggcggccgcccgttattgtagagaaagggggtaaggttgaagtcgagggtcacctgatcgacctcaaaagagttgtgcttgatggttccgtggcaacccctttaaccagagtttcagcggaacaatggggtcgtctctagacgacttttgccatgatagcacggctccacaaaaggtgcttttggcgttttccattacctatacgccagtgatgatatatgctctaaaggtaagtcgcggccgactgctagggcttctgcaccttttgatcttcctgaactgtgcttttaccttcgggtacatgacattcgtgcactttcagagcacaaatagggtcgcgctcactatgggggcagtagttgcacttctctggggggtgtactcagccatagaaacctggaaattcatcacctccagatgccgtttgtgcttgctaggccgcaagtacattctggcccctgcccaccacgtcgaaagtgccgcgggctttcatccgattgcggcaaatgataaccacgcatttgtcgtccggcgtcccggctccactacggttaacggcatattggtgcccgggttgaaaagcctcgtgttgggtggcagaaaagctgttaaacagggagtggtaaaccttgtcaaatatgccaaataacaacggcaagcagcaaaagagaaagaagggggacggccagccagtcaatcagctgtgccagatgttgggtaagatcatcgcccaacaaaaccagtccagaggcaagggaccggggaagaaaaataataagagaagcccggagaagccccattttcctctagcgactgaagaagatgtcaggcaccacttcacccctagtgagcggcaattgtgtctgtcgtcgatccagactgcctttaaccagggcgccgggacatgttccctgtcagattcagggaggataagttacgctgtggagtttagtttgccgacgcatcatactgtgcgcctgatccgcgtcacagcatcaccctcagcatgatgagctggcattctttgggcacctcggtgttatgattgggagaatgtgtggtgaatggcactgattgacactgtgcctctaagtcacctattcaattagggcgaccgtgtgggggtaaagtttaattggcgagaaccatgcggccgcaattaaaaaaaaaaaaaaaaaaaaaaaaa

SEQ ID NO: 29 - DNA, 15033 bp, Porcine reproductive and respiratory syndrome virus
atgatgtgtagggtattccccctacatacacgacactcatagtgtttgtgtgccttggaggcgagggtacagccccgccccacctcttggcccctgttctaacccaacaggcaccctcctcccttggggcgagtgcgccgcctgctgctctcttgcagcgggaaggaccccccgagtacttccggagagcacctgctttacgggatctccaccctttaaccatgtctgggacgttctcccggtgcatgtgcaccccggctgctcgggtgttttggaacgccggccaagtctattgcacacggtgtctcagtgcacggtctcttctccctctcgagcttcaagatgatgatcttggtgcaattggcttgttccacaagcccaaagacaagcttcgctggagggtccccgtcggcatccccctggtggagtgctccccgtccgggtgttgttggctctccgccattttccctctggcgcgcatgacctctggcaatcataacttccttcaacgacttgtaaaggttgctgaagtgttgtatcgtgatggttgcttgacccctaggcatcttcgtgaactccaagtttacgagcgtggctgcgactggtacccgatcacggggcccgtgcccggaatgggtatgtacgcaaactccatgcacgtttccgaccgcccatttcccggtgccacccatgtgttaacgaactcacccctgcctcaacaggcttgccggcaaccgttttgtccatttgaggaggctcattctgacgtgtataagtggaagaaatttgtaattttcacggactcctcccccaacggtcgatctcgtatgatgtggatgccggaatccggtgattcagccaacctggaggaattgccgcttgagttggaacgccaagtcgaaattcttgttcggagttttcccgcccaccaccctgttgacctcgctgactgggaacttaccgaatcccctgagcatggtttttccttcggcacgtcccatcattgtggttatcttgctcaacacccttacggttttgatggcaagtgttggctctcctgcttcctggacctgtcgactaaagtgttgcgccatgaggagtatctagctagcgctttcggttatcagaccaggtggggcgtgcctggcaagtacctccagcgcaggcttcaaatcaacggtgtccgtgctgtggtcgatcctgatggtcccatccacgtcgaagcgctatcttgccctcagtcttggattaggcacctgactttggacgatgacgccaccccaggattcgttcgcctgatgtctctccgcattataccgaacacagagcccaccacccttcagatctttcggtttggaacgcataagtggtatggcgctgccagtagacgagctcgcgccaagcgcgccgccaagagtgggaagacctcggctgccactcccgaggccgtccggtcaactttcggcagtggggccaccacctactctccgccggcagacggatcttgtggttggcacgttcttgctgccataatgaaccggatgatgaatggtgacttcacgtcccctctggctcagtacagcagaccagaggatgattgggcttctgattacgatctcgcccaggcgattcaatgtttacaactacccgctaccatagttcggaatcgtgcctgtcccaacgccaagtacctcataaggcttaatggagtccactgggaggttgaggtgaggcctggagtggctccccgctccctttcccgcgagtgtgtggttggcgtttgctccgagggctgtgtcgcattgccctatccagaaaacgggttgcctaaacgagcacttgaggccttggcgtctgcttatagactaccttccgactgtgtcagttctggcatctctgactttcttgctgacccccctcaggagttctggactcttgacaaaatgttaacctccccgtcaccagagcgatctggtttttctagcctatacaaattgctgtcagaggttgttccacagaaatgtggggccacggagggggcttttgtttatgctgttgagaggatgttgaaggattgcccgagttccaaacaagccatggccctcctggcaaagattaaagtcccgtcttcaagggccgcgtctgtgtccttggacgattgtttccccacagatgtttcggctgaccccgagtcagtatctcaggaaaagcctcaaaatcctggcgccgttgcagccctgtgcccaccgggtgtaaaagaacacggagaatcggcccccgagacggttccggagagcgaccacaaggccttccactctgtggtcataactgggggacttagtgggcaacaagtgcaagcagttgaggatgagccggtcttttcgacctcaactagtccggtcaacacggtgggcgacggtttgtcttcctcaggctccatggacggaccgctggatttaaccctgccatccctagctgctacaacaaccctagctggggggcaagcaaccaatgactcaggctccgggtgtggtgcccactctgctactggtcaggaacccgctatggcgaagcctataccccgacttgttgaacgctgcagaacaaagttggacaatagtggttcgctcctggatttgtctaatgcgcaggcaccggaccagcccttagatttgtctctggctgcttggccggtaaaagccaccgcatctgaccccggttgggtccacggtaggcgcgaacttgtttttgtaaagcctcggggtgctctctccgatggcgattcagtcatccagttcggtgagttttctgaatccagttctgtcgtcgagtttgaccgagcaaaagatgctccggtggtagacgcccccatcgacttgacgtcttcgaacgaggccctctccatagtcgaccctttcgaattcaccgagcccaggcgcccacgtttctctgcgcaagccttaattgaccgaggtggcccacttgccgatgtccatgcaaaaataaagaaccgggtatatgaacagtgtcttcaggcttgtgagcctggtagtcgcgcaaccccagccaccagaaagtggctcgacaaaatgtgggatagggtggacatgaagacctggcgctgcacctcacaattccaagccggccgtattcttgcgtctctcaacttcctccctgacatgattcaagaaacaccgccccctgttcctaggaagaaccgggctggtgacaatgccggcctgaggcaattggtggcacagtgggataggaagttgagtgcgacccccaccccagagtcggttgggccagcgcttgaccagaccacccctttgcctgcggatactcagcacgaaaacatccatcttcctgacggactacctcatgtgccagactctcccggtcaagtgcgcgtagacggaagttggaagagcctcatgctctccgccacccgccgcgccgggtccgtcagtcagcactttatgacacgggtttttgaagttgtctcccatctcccggcttttgcactcacacttttctcgccgcggggctctatggctacaggtgattggttgtttgcaggtgttgttctacttgctctcttgctatgtcgttcttacccagcactcgggtgtcttcccttactgggtgtcttttctggttctatgcggcgtgttcgtttgggtgtttttggctcttggatggcttttgctgtatttttattctcgactccacccaacccagtcggctcttcttgtgaccacgattcgccggagtgtcacgctgagcttctggctcttgagcagtgccaactttgggaacctgtgcgcggtcttgtggtcgggccctccggtctcttatgtgtcattcttggcaagctactcggtgggtcacgtcatctctggcatgttttcctacgtttatgcatgcttgcggatctggccctttctcttgtttatgtggtgtcccaagggcgttgtcacaagtgttggggaaagtgtataaggacggctcctacggaggtagcccttaatgtgttccctttctcgcgcgccacccgcttctctcttgtatccctgtgtgaccggtttcaagcaccaaaaggagttgatcccgtacacttggcaacgggctggcgcgggtgttggcgtggtgagagccccatccaccaaccccaccagaagcccattgcttatgccaatttggacgaaaaaaagatatctgctcagacggtagtcgctgtcccatacgatcccagtcaggccatcaaatgtttgaaagttttgcaagcaggtggagccatcgtggaccagcccacacctgaagtagtccgtgtgtccgagatccccttctcagccccatttttcccaaaagtcccagttaacccagattgtagagtcgtggtagattcggacactttcgtggctgcggttcgttgtggttattcaacagcacaactggtcctgggtcagggaaactttgccaagttaaatcaaacccccctcaggaactctgtctccactaaagcaactggtggggcctcttacactcttgctgtggcacaagtgtctgtatggacccttgttcattttatcctcggcctttggttgatgtcacctcaagtgtgcggtcgaggaacctccgacccatggtgctcaaatcctttttcttaccctgcttacggtccaggagtcgtgtgttcctcccgactttgcgtgtctgccgacggagtgaccctaccgttgttttcagccgtggcccagctttccgggagagaggtggggattttcgtcttggtgcttgtctcccttgccgctttggccaaccgtctggctcttaaggcagatatgttggtggtcttcttggctttttgcgcttacgcctggcctttgagctcttggttgatctgtttctttcccgtgctcttgaggtgggtcacccttcacccccttaccatgctttgggtacattcatttttagtgttctgcctgccagcggccggtgtcctttcgctggggataaccggtctcctctgggctgttggccgcttcacccaggttgccgggatcatcacaccttacgacatccaccaatacacctctggaccgcgtggtgcggctgctgtggcaacagccccagaaggcacttacatggcagccgtccggagagctgccttgactgggcggaccctgattttcacaccatctgcagtggggtctcttcttgaaggtgccttcaggactcacaaaccctgcttgaacactgtgagtgttgtaggctcttcccttgggtccggaggggttttcaccatcgatggcaggaagactgttgtcactgctgcccacgtgctgaacggtgacacagctaggatcacaggtgactcttacaatcgcatgcacactttcaagaccaatggtgattatgcctggtcccatgctgatgactggcagggcatcgctcctgtggtcaagatcgctaaagggtaccgcggtcgggcctattggcaaacatcaacaggtgtcgaacccggtgtcgttgggaatgggttcgccttctgttttaccaactgtggcgattcagggtcgcccgtcatctcagaatctggtgatcttattgggatccacaccggttcaaacaaacttggctctggtcttgtgacgacccctgaaggagagacgtgcaccatcagggaaaccaagctctctgacctctccaaacacttcgcaggcccaagtgtccctctcggggacattaaattgagccctgccatcatccccgatgtaacatccattccgagtgacttggcatcgctcctatcctctgttcctgcaatggagggcggcctttcgaccgttcaactcctgtgcgtttttttccttctatggcgtatgatgggtcatgcctggacacccattgttgccgtgagcttctttttgctgaatgaaatccttccggcagttttggtccgagccgtgttctcttttgcgctttttgtgctcgcatgggccaccccctggtccgcacaagtgttaatgatcagacttctcacggcatctctcaaccgcaacaagctgtctcttgcgttctacgcactcgggggtgtcgttggtttggcctctgaaatcgggacttttgcaggcagattgtctgaattgtctcaagccctttcgacatattgcttcttacccagggttcttgctatgaccagttgtgtccccatcatcattattggcgggcttcacgccctcggtgtgattctgtggttgttcaaataccgatgcctccacaacatgctggttggtgacggaagtttttcaagcgccttcttcttacggtattttgcagagggcaatctcagaaaaggcgtttcacagtcttgtggtatgaacaatgagtccttaacggctgctttagcttgcaaattgtcacaggccgacctagatttcttgtccagcttaacgaacttcaagtgctttgtgtctgcttcaaacatgaagaacgcggctggccagtatattgaggcagcgtatgccaaggccctgcgccgagaattggcctccttggttcaggtagacaagatgaaaggagttttgtccaaacttgaggcctttgccgagacagccaccccgtcccttgacacaggtgacgtgattgttctgcttgggcaacatccccacggttctattctcgacatcaatgtggggactgaaaagaaaactgtgtctgtgcaagaaaccaggagcctgggtggctccaagttcagtgtttgcactgttgtgtccaacacccctgtggatgccttgaccgacatcccgctccagacaccaacccctctttttgagaatggtcctcgtcatcgcggcgaggaagacgacctcaaagtcgagaggatgaagaagcactgtgtgtctctcggcttccacaatatcaatggcaaagtttactgcaaagtctgggacaagtctaccggtgacaccttctacactgatgactcccggtacacccaggattatgcttttcaggacaggtcggccgactatagagacagagactacgagggtgtgcaagctgcccctcaacagggatttgatccaaagtctgaaacccccgttggcaccgtcgtgatcggtggcattacgtacaacaggtacctggccaaaggcagagaggttctggttccaaagcccgacaactgtcttgaagctgccaaactgtcccttgagcaagctctcgctggcatgggccaaacctgcgaccttacagctgctgaggtggaaaagttgaagcgcatcattaatcaacttcaaggcttgaccactgaacaggctttaaactgctagccgccagcggcttgacccgctgtggccgcggcggcttggttgtaaccgagacagcggtaaaaattgtaaaataccatagcagaaccttcactttaggccctttagacctgaaagtcacttccgaagtggaggtgaagaaatcaactgagcagggccacgctgttgtagcaaatctatgctccggtgtcgttctaatgagacctcacccaccgtcccttgtcgacgtcatcctaaaacccgggcttgacacaacacccggtattcaaccggggcacggggccgggaacatgggcgtggacggtaccatttgggactttgagactgcacccacaagggcagagctcgagttgtctaagcaaataatccaagcatgtgaaatcaggcgcggggacgccccgaatctccaactcccttacaagctctaccctgttaggggggatcctgagcggaaagagggtcgcctcattaataccaggtttggagacctaccttataaaacccctcaagacactgggtctgcgatccacgcggcttgttgcctgaaccccaatggggctcccgtgtctgacggcaaatctgtactgggtaccactcttcaacacggtttcgaactctatgtccctaccgtgccttatagtgtcatggagtatcttgattcacgccctgacacccctctcatgtgcaccaaacatggtacttccagggctgcgaccgaggacctccaaaaatacgacctatccacccaaggatttgttctgcctggggttctacgattggtgcgcagattcatctttggccatatcggtaaggcgccgccattgtttcttccatcaacctatcccgccaagaattctatggcagggatcaatggccagaggtttccaacaaaggacgttcagagcatacctgaaattgatgagatgtgtgcccgcgccgtcaaggagaattggcaaactgtgacaccttgcactctcaagaaacagtactgttccaaacctaaaaccaggactatcctgggcactaacaactttattgctttggctcacagatcagcgctcagtggtgtcactcaggcatttatgaagaaagcctggaggtccccgattgccttggggaaaaacaaattcaaggagctgcactgcactgtcgctggcagatgcctcgaggccgacttggcttcctgcgaccgcagcacccctgccattgtgaggtggttcactgcccatctcctatatgagcttgcaggttgtgaagagtatttgcctagctatgcgctcaactgttgtcatgacctcgtggctacgcaggacggcgccttcacaaaacgtggtggcttgtcgtctggggaccccgttaccagtgtgtccaacaccgtgtattcactgataatttacgctcagcacatggtgttgtcggccctgaaaatgggtcatgagattggccttaagttcctcgaagaccagctcaagttcgaggaccttcttgaaatccaacccatgttggtgtactctgatgaccttgtgctgtatgctgaacaaccaactttccccaactaccattggtgggtcgaacacctcgacttgatgttgggttttaaaacggatcccaaaaagactgtcataactgacaagcccagtttccttggctgcaaaatcgaagcagggcgacagctggtccccaatcgagaccgcattcttgctgctcttgcatatcatatgaaggcgcagaatgcatcagagtattacgcgtctgctgctgcaatcttgatggattcgtgtgcttgcattgattatgaccctgagtggtacgaagacctaatctgtggcattgcccggtgcgcccgtcaggatggctatagttttccgggcccgccgtttttcatgtccatgtgggagaggctgaaaagtcataatgaaggaaaaaaatttcgccactgcggcatatgtgatgccaaagccgaccacgcgtcagcctgtgggcttgatctgtgtttgtttcactcgcattttcatcagcactgccctgtcaccttgaactgcggtcaccatgccggttcgaaagaatgttcacagtgtgaatcaccaattggggccggtaagtctcctcttgatgttgtgctggaacaaataccatacaaacctcctcgtactgtcatcatgaaggtggataacaaaacaacaacccttgacccggggagataccagtctcgccggggtctcgttgcagttaagaggggtgttgcaggcaatgaagttgatcttgctgacggggactaccaggtgatgcctcttttaccgacctgcagagatataaatatggtgaaggtggccagcaatgtgttactcagcaagttcatagttgggccaccaggttctgggaaaaccacctggctgttgaatcaagttcaggatgatgatgtcatttacacacccacccatcagaccatgtttgacatagtcagtgctctcaaagtttgtaggtactctatcccaggagcctcaggactccctttcccgccgcccgccaggtccgggccgtgggtcagacttattgccagtgggcatgcccctggccgagtgtcatacctcgacgaggctgggtactgcaatcatctggacatacttaggctgctctccaaaacaccccttgtgtgtttgggcgaccttcagcaacttcaccctgtcggctttgactcttactgctatgtgttcgatcagatgcctcagaagcagctgaccaccatttacagattcggccctaacatctgcgcagccattcagccttgttacagagaaaaacttgaatctaaggccaggaataccagggtggtctttaccacccggcctgtggcctatggccaagtgctgacaccataccataaagatcgcgtcgactccgcgataaccatagactcatcccaaggggctaccttcgatgtcgtaacactgcacctaccatcgccaaagtccctaaacagatcccgtgcgcttgtggccatcactcgagcacgacatgggttgttcatttacgacccccacgaccaactccgggagtttttcaacttaacccctgagcgcactgattgtaatcttgtgtttaaccgcggggatgagctggtggttctggatacagacaatgcagtcacgaccgtggcgaaggccttagaaacaggtccatcacgatttcgagtatctgacccaagatgcaaatccctcttggccgcttgctcggccagcctggaaggaagctgcatgccattgccgcaagtggcacacaacttgggattttacttttccccagacagtcctgcatttgcacccctgccaaaagaactagcaccgcattggccggtggtcacctatcagaacaaccgagcatggcctgatcgactcgtttccagcatgcgcccaattgacgttcgttatagcaagcctatggttggtgcggggtacatggttgggccgtctaccttccttggtactcctggcgtggtgtcgtactatctcacgctgtacatcaagggcgaacctcagaccttaccagaaacactcgtctcaacaggacgtatagccacagattgtcgagagtatcttgacacagctgaggaagaggcagccaaagaactcccccacgcattcatcggtgacgtcagaggcaccacggttggagggtgtcatcatgtcacatcaaaatacctgcctaggttcttgcctaaggactctgttgccatagttggggtaagttcgcctggcagggctgctaaagccgtatgcactctcaccgatgtgtacctccctgaactccgaccgtatctgcaacctgagacggcatcaaagtgttggaaactcaaactagatttcagagatgttcgactaatggtttggaagggagccaccgcctatttccaactggaagggcttacttggtcggctttgcccgactatgccaggttcattcagttgcccaaggatgccgtcgtttacattgatccgtgtataggaccggcaacagcaaaccgcaaggtcgtgcgaaccacagattggcgggccgacctggcagtgacaccgtatgattacggcgcccaagtcattctgacaacagcctggttcgaagacctcggaccacaatggaaaattttggggttgcagcccttcaggcgagcatttggctttgaaaatactgaggattgggcaatccttgcgcgccgtatgtgtgacggcaaggactacactgactataactgggattgtgtcagaaaccgcccacatgctattcatggacgtgctcgcgaccatacctaccatttcgctcctggctcgaaattgcaagtggagttaggtaaacctcggctgctgtctgagcaagacccgtgaacctggagtgatgcaatgggttcgttgtggagtaaaatcagccaactgtttgtggacgccttcactgagttccttgttagcattgttgatatcatcatcttccttgccatattgttcgggttcaccgtcgccgggtggttactggtctttcttctcagagtggtttgctccgcgcttctccgttcgcgctctgccattcactcttccgaattatcgaaggtcctatgagggcttgctacctaattgcagaccggatgtcccacaatttgcatttaagcaccccttgggtatgttttggcacttgcgggtttcccacttgattgatcaaatggtctcccgccgcgtttatcaaaccatggaacattcaggccaagcggcctggaagcaggtggtggctgaggccactctcacaaagttgtcagagctcgacatagtcctccatttccaacacctggccgcggtggaggcggattcttgccgcttcctcagctcacgacttgtgatgctgaaaaatttagccgttggcaacgtgagtatactttataacaccacgttggaccgcgttgagctcgtcttccctacgccaggcacgaggcccaaattgaccgacttcagacaatggcttatcagcgtgcacgcttccattttctcttctgtggcttcgtcagtcaccttgttcgtggtgctttggcttcgggtcccaactctacgctatgtttttggtttccattggcccatggcaacacgtcattcgagctgaccattaattacactgtatgcaagccctgtctcactagtcaagcggctcaacaaaggctcgaacccggccgtaacatgtggtgcaaaataggaagctctacgtgtgaggaacgtgaccataatgaactgtctatgaccattccgcccggatatgacaacctcaaacttgagggctattatgcttggctggccttcttgtctttttcctacgctgctcaatttcatccggagttgttcggaataggaaacgtgtcgcgcgtctttgtggacaagcatcaccagttcatctgcgctgagcatgacgggcagaattcaaccgtacccattgggtataatgtctctgcattgtatgcagcctattaccaccatcaagtagacgggggcaattggtttcatttagaatggctgcgaccattcttttcctcctggctggtgctcaacatttcatggtttctgaggcgttcgcctgcaagccctgtttctcgacgcatctatcagatattaagaccaacacgaccgcggctgccggtttcatggtccttcaaaacatcaactgcccccaatttcacagggcctcaacaacgtcgtcaagccctctcagaaagtcgccccaatgtcgtgaagccgtcggcactcctcagtacatcacgatagtagccaatgtgaccgacgagtcgtatttgtacaatgccgatttgctaatgctttctgcgtgtcttttctacgcttcagaaatgagtgagaagggcttcaaagtcatcttcgggaatgtctctggtgttgtttccgcatgcgttaactttacggattatgtgacccatgtaacccagcatatacagcaacaccatttggtaatcgatcatgttcggttgctgcacttcctgacaccgtctgtaatgaggtggactacaaccatcgcttgcttgtttgctattctcctggcgatatgagatgttcgcacaagttggggcgttacttgactccacattcttgcttctggtggctttttttgctgtgtaccggcttgtcttggtcctttgccgatggcaacggcaacagctcgacataccaatacatatataatctgacgatatgcgagctgaatgggaccgcctggctgtccgataaattttattgggcagtcgagacctttgttttttacccggtggtgactcacattctctcactgggatttttaacaacaagccatttctttgacgcactcggccttggggccgtgtccgttactggctactatggtgggcggtatgtgctcagcagcgtgtacggcacttgtgcgctcgcagcgctcgtgtgtttcgccatccgtgccgccaaaaattgcatggcctgtcgctatgcccgtacccggttcacaaatttcattgtggacgaccgggggggagtccatcggtggaagtcgccaatagtggtggagaaactaggaaaagctgaagttggtgacgccctcgttaccatcaagcatgtcgtcattgaaggggttaaagctcaacccttgacaaggaccacagccgagcaatggcaggcctagatgatttttgttacgattccaccgccgtacaaaagcttgtgctggcctttagtatcacatacacacccatcatgatatatgcccttaaggtgtctcgcggccgactcttggggctgttgcacatcttgatatttctgaactgttcttttacattcggatacatgacatatgtgcattttgaatcctccaaccgtgtcgcatttaccatgggagctgttgtcacccttttgtggggcatttatagttttatagagtcctggaagtttgttacttccaggtgcagattgtgttgcctaggccggcgatacattttggcccctgcccaccacgtagaaagtgctgcaggcctccatccgatcccagcgtccggtaaccaagcgtacgctgtgagaaagcccggactaacatcagtgaacggcactctggtaccaggacttcggggcctcgtgttgggcggcaaacgagctgttaaacgaggaatggttaacctcgtcaagtatggccggtaaaacccagcgccagaatagaaataaaaatccagctccaatggggaatggccagtcagtcaatcaactgtgccagttgttgggttcaatgctgaaatcccagcgccagcaatctaggggaggacaggtcaaaaagaagaagcctgagaagcctcatttccccctagctgctgaagatgacgtccggcaccatctcacccaagccgagcgctccctttgcttgcaatcgatccagacagctttcaatcaaggcgcagggactgcgtcgctttcatccagcgggaaggtcggttttcaggttgagttcatgttgccggttgctcatacagtgcgcctgattcgcgtgacttctacatccgccagtcagggtgtaaattaatttgttagttaggtgaatggccgcgattggcgtgtggcctctgagtcacctattcaattagggcgatcacatgggggttagacttaattaggcgagaaccatgtgaccgaaattaaaaaaaaaaaaa

SEQ ID NO: 30 - DNA, 15446 bp, Porcine respiratory and reproductive syndrome virus
tatgacgtataggtgttggctctatgccttggcatttgtattgtcaggagctgtgaccattggcacagcccaaaacttgctgcacagaaacacccttctgtgatagcctccttcaggggagcttagggtttgtccctagcaccttgcttccggagttgcactgctttacggtctctccacccctttaaccatgtctgggatacttgatcggtgcacgtgtacccccaatgccagggtgtttatggcggagggccaagtctactgcacacgatgcctcagtgcacggtctctccttcccctgaacctccaagtttctgagctcggggtgctaggcctattctacaggcccgaagagccactccggtggacgttgccacgtgcattccccactgttgagtgctcccccgccggggcctgctggctttctgcaatctttccaatcgcacgaatgaccagtggaaacctgaacttccaacaaagaatggtacgggtcgcagctgagctttacagagccggccagctcacccctgcagtcttgaaggctctacaagtttatgaacggggttgccgctggtaccccattgttggacctgtccctggagtggccgttttcgccaattccctacatgtgagtgataaacctttcccgggagcaactcacgtgttgaccaacctgccgctcccgcagagacccaagcctgaagacttttgcccctttgagtgtgctatggctactgtctatgacattggtcatgacgccgtcatgtatgtggccgaaaggaaaatctcctgggcccctcgtggcggggatgaagtgaaatttgaagctgtccccggggagttgaagttgattgcgaaccggctccgcacctccttcccgccccaccacacagtggacatgtctaagttcgccttcacagcccctgggtgtggtgtttctatgcgggtcgaacgccaacacggctgccttcccgctgacactgtccctgaaggcaactgctggtggagcttgtttgacttgcttccactggaagttcagaacaaagaaattcgccatgctaaccaatttggctaccagaccaagcatggtgtctctggcaagtacctacagcggaggctgcaagttaatggtctccgagcagtaactgacctaaacggacctatcgtcgtacagtacttcttcgttaaggagagttggatccgccacttgaaactggcgggagaacccagctactctgggtttgaggacctcctcagaataagggttgagcctaacacgtcgccattggctgacaaggaagaaaaaattttccggtttggcagtcacaagtggtacggcgctggaaagagagcaagaaaagcacgctcttgtgcgactgctacagtcgctggccgcgctttgtccgttcgtgaaacccggcaggccagggagcacgaggttgccggcgccaacaaggctgagcacctcaaacactactccccgcctgccgaagggaattgtggttggcactgcatttccgccatcgccaaccggatggtgaattccaaatttgaaaccacccttcccgaaagagtgagacctccagatgactgggctactgacgaggatcttgtgaatgccatccaaatcctcagactccctgcggccttagacaggaacggtgcttgtactagcgccaagtacgtacttaagctggaaggtgagcattggactgtcactgtgacccctgggatgtccccttctttgctccctcttgaatgtgttcagggctgttgtgggcacaagggcggtcttggttccccagatgcagtcgaggtctccggatttgaccctgcctgccttgaccggctggctgaggtgatgcacctgcctagcagtgctatcccagccgctctggccgaaatgtctggcgattccgatcgttcggcttctccggtcaccaccgtgtggactgtttcgcagttctttgcccgtcacagcggagggaatcaccctgaccaagtgcgcttagggaaaattatcagcctttgtcaggtgattgaggactgctgctgttcccagaacaaaaccaaccgggtcaccccggaggaggtcgcagcaaagattgacctgtacctccgtggtgcaacaaatcttgaagaatgcttggccaggcttgagaaagcgcgcccgccacgcgtaatcgacaccttctttgattgggatgttgtgctccctggggttgaggcggcaacccagacgatcaagctgccccaggtcaaccagtgtcgtgctctggtccctgttgtgactcaaaagtccttggacaacaactcggtccccctgaccgccttttcactggctaactactactaccgtgcgcaaggtgacgaagttcgtcaccgtgaaagactaaccgccgtgctctccaagttggaaaaggttgttcgagaagaatatgggctcatgccaaccgagcctggtccacggcccacactgccacgcgggctcgacgaactcaaagaccagatggaggaggacttgctgaaactggctaacgcccagacgacttcggacatgatggcctgggcagtcgagcaggttgacctaaaaacttgggtcaagaactacccgcggtggacaccaccaccccctccgccaaaagttcagcctcgaaaaacgaagcctgtcaagagcttgccggagagaaagcctgtccccgccccgcgcaggaaggttgggtccgattgtggcagcccggtttcattaggcggcgatgtccctaacagttgggaagatttggctgttagtagcgttaaccaatgcatcttcaggccggcgacacccttgagtgagccggctccaattcccgcacctcgcggaactgtgtctcgaccggtgacacccttgagtgagccgatccctgtgcccgcaccgcggcgtaagtttcagcaggtgaaaagattgagttcggcggcggcaatcccaccgtaccagaacgagcccctggatttgtctgcttcctcacagactgaatatgaggcctctcccccagcaccgccgcagagcgggggcgttctgggagtagaggggcatgaagctgaggaaaccctgagtgaaatctcggacatgtcgggtaacattaaacctgcgtccgtgtcatcaagcagctccttgtccagcgtgagaatcacacgcccaaaatactcagctcaagccatcatcgactcgggcgggccctgcagtgggcatctccaagaggtaaaggaaacatgccttagtgtcatgcgcgaggcatgtgatgcgactaagcttgatgaccctgctacgcaggaatggctttctcgcatgtgggatcgggtggacatgctgacttgcaacacgtctgtttaccaggcgatttgcaccttagatggcaggttaaagttcctcccaaaaatgatactcgagacaccgccgccctatccgtgtgagtttgtgatgatgcctcacacgcctgcaccttccgtaggtgcggagagcgaccttaccattggctcagttgctactgaagatgttccacgcatcctcgagaaaatagaaaatgtcggcgagatggccaaccagggacccttggccttctccgaggataaaccggtagatgaccaacttgtcaacgacccccggatatcgtcgcggaggcctgacgagagcacatcagctccgtccgcaggcacaggtggcgccggctcttttaccgatttgccgccttcagatggcgcggatgcggacgggggggggccgtttcggacggtaaaaagaaaagctgaaaggctctttgaccaactgagccgtcaggtttttgacctcgtctcccatctccctgttttcttctcacgccttttctaccctggcggtggttattctccgggtgattggggttttgcagcttttactctattgtgcctctttttatgttacagttacccagcctttggtattgctcccctcttgggtgtgttttctgggtcttctcggcgcgttcgaatgggggtttttggctgctggttggcttttgctgttggtctgttcaagcctgtgtccgacccagtcggcgctgcttgtgagtttgactcgccagagtgtagaaacatccttcattcttttgagcttctcaaaccttgggaccctgttcgcagccttgttgtgggccccgtcggtctcggtcttgccattcttggcaggttactgggcggggcacgctgcatctggcactttttgcttaggcttggcattgttgcagactgtatcttggctggagcttacgtgctttctcaaggtaggtgtaaaaagtgctggggatcttgtataagaactgctcctaatgaggtcgcttttaacgtgtttcctttcacacgtgcgaccaggtcgtcacttatcgacctgtgcgatcggttttgtgcgccaaaaggaatggaccccatttttctcgccactgggtggcgcgggtgctgggccggccgaagccccattgagcaaccctctgaaaaacccatcgcgtttgcccaattggatgaaaagaagattacggctaggactgtggtcgcccagccttatgaccccaaccaagccgtaaagtgcttgcgggtattgcaggcgggtggggcgatggtggctaaggcggtcccaaaagtggtcaaggtttccgctgttccattccgagcccccttctttcccactggagtgaaagttgaccctgattgcagggtcgtggttgaccctgacactttcactgcagctctccggtctggctactccaccacaaacctcgtccttggtgtaggggactttgcccagttgaatggattaaaaatcaggcaaatttccaagccttcagggggaggcccacatctcatggctgccctgcatgttgcctgctcgatggctctgcacatgcttgctgggatttatgtgactgcggtgggttcttgcggcaccggcaccaacgacccgtggtgcgctaacccgtttgccgtccctggctacggacctggctctctctgcacgtccagattgtgcatttcccaacacggccttaccctgcccttgacagcacttgtggcgggattcggtattcaagaaattgccttggtcgttttgatttttgtttccatcggaggcatggctcataggttgagctgtaaggctgacatgctgtgtgttttgcttgcaattgccagctatgtttgggtacctcttacctggttgctttgtgtgtttccttgctggttgcgctgtttttctttgcaccccctcaccatcctatggttggtgtttttcttgatttctgtgaatatgccttcaggaatcttggccatggtgttgttggtttctctttggcttcttggtcgttatactaatgttgctggccttgtcaccccctacgacattcatcattacaccagtggcccccgcggtgttgccgccttggctaccgcaccagatgggacctacttggccgctgtccgccgcgctgcgttgactggccgcaccatgctgtttaccccgtcccagcttgggtctcttcttgagggtgctttcagaactcgaaagccctcactgaacaccgtcaatgtgatcgggtcctccatgggctctggcggggtgtttaccatcgacgggaaagtcaagtgcgtaactgccgcacatgtccttacgggcaattcagctcgggtttccggggtcggcttcaatcaaatgcttgactttgacgtaaagggagatttcgctatagctgattgcccgaattggcaaggggctgcccccaagacccaattctgcacggatggatggactggccgtgcctattggctaacatcctctggcgtcgaacccggcgtcattggaaaaggattcgccttctgcttcaccgcatgtggcgattccgggtccccagtgatcaccgaggccggtgagcttgtcggcgttcacacgggatcgaataaacaaggggggggcattgttacgcgcccctcaggccagttttgtaatgtggcacccatcaagctaagcgaattaagtgaattctttgctgggcctaaggtcccgctcggtgatgtgaaggtcggcagccacataattaaagacataagcgaggtgccttcagatctttgtgccttgcttgctgccaaacctgaactggaaggaggcctctccaccgtccaacttctttgtgtgttttttctcctgtggagaatgatgggacatgcctggacgcccttggttgctgtgagtttctttattttgaatgaggttctccctgccgtcctggtccggagtgttttctcctttggaatgtttgtgctatcctggctcacgccatggtctgcgcaagttctgatgatcaggcttctgacagcagctcttaacaggaacagatggtcacttgcctttttcagcctcggtgcagtgaccggttttgtcgcagatcttgcggccactcaggggcatccgttgcaggcagtgatgaatttgagcacctatgcattcctgcctcggatgatggttgtgacctcaccagtcccagtgatcacgtgtggtgtcgtgcacctacttgccatcattttgtacttgtttaagtaccgtggcctgcaccatatccttgttggcgatggagtgttctctgcggctttcttcttgagatactttgccgagggaaagttgagggaaggggtgtcgcaatcctgcggaatgaatcatgagtctctgactggtgccctcgctatgagactcaatgacgaggacttggatttccttatgaaatggactgattttaagtgctttgtttctgcgtccaacatgaggaatgcagcgggtcaatttatcgaggctgcctatgctaaagcacttagagtagaactggcccagttggtgcaggttgataaagttcgaggtactttggccaaacttgaagcttttgctgataccgtggcacctcaactctcgcccggtgacattgttgtcgctctcggccacacgcctgttggcagtatcttcgacctaaaggttggtagcaccaagcataccctccaagccattgagaccagagtccttgctgggtccaaaatgaccgtggcgcgcgtcgtcgacccgacccccacgcccccacccgcacccgtgcccatccccctcccaccgaaagttctggagaatggccccaacgcttggggggatgaggaccgtttgaataagaagaagaggcgcaggatggaagccctcggcatctatgttatgggcgggaaaaagtaccagaaattttgggacaagaattccggtgatgtgttttatgaggaggtccataataacacagatgagtgggagtgtctcagagttggcgaccctgccgactttgaccctgagaagggaactctgtgtggacatgtcaccattgaaaacaaggcttaccatgtttacacctccccatctggtaagaagttcttggtccccgtcaacccagagaatggaagagttcaatgggaagctgcaaagctttccgtggagcaggccctaggtatgatgaatgtcgacggcgaactgactgccaaagaactggagaaactgaaaagaataattgacaaactccagggcctgactaaggagcagtgtttaaactgctagccgccagcgacttgacccgctgtggtcgcggcggcttggttgttactgaaacagcggtaaaaatagtcaaatttcacaaccggaccttcaccctgggacctgtgaatttaaaagtggccagtgaggttgagctaaaagacgcggttgagcacaaccaacacccggttgcgagaccgatcgatggtggagttgtgctcctgcgttccgcggttccttcgcttatagacgtcttgatctccggtgctgatgcatctcccaagttactcgcccatcacgggccgggaaacactgggatcgatggcacgctctgggattttgagtccgaagccactaaagaggaagtcgcactcagtgcgcaaataatacaggcttgtgacattaggcgcggcgacgctcctgaaattggtctcccttacaagctgtaccctgttaggggtaaccctgagcgggtgaaaggagttctgcagaatacaaggtttggagacataccttacaaaacccccagtgacactggaagcccagtgcacgcggctgcctgccttacgcccaacgccactccggtgactgatgggcgctccgtcttggccacgaccatgccccccgggtttgagttatatgtaccgaccataccagcgtctgtccttgattaccttgactctaggcctgactgccctaaacagctgacagagcacggctgcgaagatgccgcactgaaagacctctctaaatatgacttgtccacccaaggctttgttttacctggagttcttcgccttgtgcggaaatacctgtttgcccatgtaggtaagtgcccacccgttcatcggccttctacttaccctgctaagaattctatggctggaataaatgggaacaggttcccaaccaaggacattcagagcgtccctgaaatcgacgttctgtgcgcacaggctgtgcgagaaaactggcaaactgtcaccccttgtactcttaagaaacagtattgcgggaagaagaagactaggaccatactcggcaccaataacttcatcgcactagcccaccgagcagtgttgagtggtgttacccagggcttcatgaaaaaggcgtttaactcgcccatcgccctcggaaagaacaagtttaaggagctacagactccggtcctgggcaggtgccttgaagctgatctcgcatcctgcgatcgatccacgcctgcaattgtccgctggtttgccgccaaccttctttatgaacttgcctgtgctgaagagcatctaccgtcgtacgtgctgaactgctgccacgacttactggtcacgcagtccggcgcagtgactaagagaggtggcctgtcgtctggcgacccgatcacctctgtgtctaacaccatttatagtttggtgatctatgcacagcatatggtgcttagttacttcaaaagtggtcacccccatggccttctgttcttacaagaccagctaaagtttgaggacatgctcaaggttcaacccctgatcgtctattcggacgacctcgtgctgtatgccgagtctcccaccatgccaaactatcactggtgggttgaacatctgaatttgatgctggggtttcagacggacccaaagaagacagcaataacagactcgccatcatttctaggctgtagaataattaatgggcgccagctagtccccaaccgtgacaggatcctcgcggccctcgcctatcacatgaaggcgagtaatgtttctgaatactatgcctcagcggctgcaatactcatggacagctgtgcttgtttggagtatgatcctgaatggtttgaagaacttgtagttggaatagcgcagtgcgcccgcaaggacggctacagctttcccggcacgccgttcttcatgtccatgtgggaaaaactcaggtccaattatgaggggaagaagtcgagagtgtgcgggtactgcggggccccggccccgtacgctactgcctgtggcctcgacgtctgcatttaccacacccacttccaccagcattgtccagtcacaatctggtgtggccatccagcgggttctggttcttgtagtgagtgcaaatcccctgtagggaaaggcacaagccctttagacgaggtgctggaacaagtcccgtataagcccccacggaccgttatcatgcatgtggagcagggtctcaccccccttgatccaggtagataccaaactcgccgcggactagtctctgtcaggcgtggaattaggggaaatgaagttgaactaccagacggtgattatgctagcaccgccttgctccctacctgcaaagagatcaacatggtcgctgtcgcttccaatgtattgcgcagcaggttcatcatcggcccacccggtgctgggaaaacatactggctccttcaacaggtccaggatggtgatgttatttacacaccaactcaccagaccatgcttgacatgattagggctttggggacgtgccggttcaacgtcccggcaggcacaacgctgcaattccccgtcccctcccgcaccggtccgtgggttcgcatcctagccggcggttggtgtcctggcaagaattccttcctagatgaagcagcgtattgcaatcaccttgatgttttgaggcttcttagtaaaactaccctcacctgtctaggagacttcaagcaactccacccagtgggttttgattctcattgctatgtttttgacatcatgcctcaaactcaactgaagaccatctggaggtttggacagaatatctgtgatgccattcagccagattacagggacaaactcatgtccatggtcaacacaacccgtgtgacccacgtggaaaaacctgtcaggtatgggcaggtcctcaccccctaccacagggaccgagaggacgacgccatcactattgactccagtcaaggcgccacattcgatgtggttacattgcatttgcccactaaagattcactcaacaggcaaagagcccttgttgccatcaccagggcaagacacgctatctttgtgtatgacccacacaggcagctgcagggcttgtttgatcttcctgcaaaaggcacacccgtcaacctcgcagtgcaccgcgacgggcagctgatcgtgctggatagaaataacaaagaatgcacggttgctcaggctctaggcaacggggataaatttagggccacagataagcgtgttgtagattctctccgcgccatttgtgctgatctagaagggtcgagctctccgctccccaaggtcgcacacaacttgggattttatttctcacctgatttaacacagtttgctaaactcccagtagaacttgcacctcactggcccgtggtgacaacccagaacaatgaaaagtggccagatcggctggttgccagccttcgccctatccataaatacagccgcgcgtgcatcggtgccggctatatggtgggcccttcggtgtttctaggcactcctggggtcgtgtcatactatctcacaaaatttgttaagggcgaggctcaattgcttccggagacggttttcagcaccggccgaattgaggtagactgccgggaatatcttgatgatcgggagcgagaagttgctgcgtccctcccacacgctttcattggcgacgtcaaaggcactaccgttggaggatgtcatcatgtcacctccagatacctcccgcgcgtccttcccaaggaatcagttgcggtagtcggggtttcaagccccggaaaagccgcgaaagcattgtgcacactgacagatgtgtacctcccagatcttgaagcctatctccacccggagacccagtccaagtgctggaaaatgatgttggacttcaaagaagttcgactaatggtctggaaagacaaaacagcctatttccaacttgaaggtcgctatttcacctggtatcagcttgccagctatgcctcgtacatccgtgttcctgtcaactctacggtgtacttggacccctgcatgggccccgccctttgcaacaggagagtcgtcgggtccacccactggggggctgacctcgcggtcaccccttatgattacggcgctaaaattatcctgtctagcgcgtaccatggtgaaatgccccccggatacaaaattctggcgtgcgcggagttctcgttggatgacccagttaagtacaaacatacctgggggtttgaatcggatacagcgtatctgtatgagttcaccggaaacggtgaggactgggaggattacaatgatgcgtttcgtgcgcgccaggaagggaaaatttacaaggccactgccaccagcttgaagttttattttcccccgggccctgtcattgaaccaactttaggcctgaattgaaatgaaatggggtccatgcaaagccttttttacaaaattggccaactttttgtggatgctttcacggagttcttggtgtccattgttgatatcattatatttttggccattttgtttggcttcaccatcgccggttggctggtggtcttttgcatcagattggtttgctccgcgatactccgtacgcgccctgccattcactctgagcaattacagaagatcttatgaggcctttctttcccagtgccaagtggacattcccacctggggaactaaacatcctttggggatgctttggcaccataaggtgtcaaccctgattgatgaaatggtgtcgcgtcgaatgtaccgcatcatggaaaaatcagggcaggctgcctggaaacaggtggtgagcgaggctacgctgtctcgcattagtagtttggatgtggtggctcattttcagcatctagccgccattgaagccgagacctgtaaatatttggcctcccggctgcccatgctacacaacctgcgcatgacaggttcaaatgtaaccatagtgtataatagcactttgaatcaggtgtttgctatttttccaacccctggttcccggccaaagcttcatgattttcagcaatggttaatagctgtacattcctccatattttcctctgttgcagcttcttgtactctttttgttgtgctgtggttgcgggttccaatactacgtactgtttttggtttccgctggttaggggcaatttttctttcgaactcacagtgaattacacggtgtgtccaccttgcctcacccggcaagcagccacagagatctacgaacccggtaggtctctttggtgcaggatagggtatgaccgatgtgaggaggatgatcatgacgagctagggtttatggtaccgcctggcctctccagcgaaggccacttgactagtgtttacgcctggttggcgttcttgtccttcagctacacggcccagttccatcccgagatattcgggatagggaatgtgagtcgagtttatgttgacatcaaacatcaactcatctgcgccgaacatgacgggcagaacaccaccttgcctcgtcatgacaacatttcagccgtgtttcagacctattaccaacatcaagtcgacggcggcaattggtttcacctagaatggcttcgtcccttcttttcctcgtggttggttttaaatgtctcttggtttctcaggcgttcgcctgcaaaccatgtttcagttcgagtcttgcagatattaagaccaacaccaccgcagcggcaggctttgctgtcctccaagacatcagttgccttaggcatcgcgactcggcctctgaggcgattcgcaaaatccctcagtgccgtacggcgatagggacacccgtgtacgttaccatcacagccaatgtgacagatgagaattatttacattcttctgatctcctcatgctttcttcttgccttttctatgcttctgagatgagtgaaaagggatttaaggtggtatttggcaatgtgtcaggcatcgtggctgtgtgtgtcaattttaccagctacgtccaacatgtcaaggagtttacccaacgctccctggtggtcgaccatgtgcggttgctccatttcatgacacctgagaccatgaggtgggcaactgttttagcctgtctttttgccattctgttggcaatttgaatgtttaagtatgttggagaaatgcttgaccgcgggctgttgctcgcaattgctttctttgtggtgtatcgtgccgttctgttttgctgcgctcgccaacgccagcaacgacagcagctcccatctacagctgatttacaacttgacgctatgtgagctgaatggcacagattggctagctaacaaatttgattgggcagtggagagttttgtcatctttcccgttttgactcacattgtctcctatggtgccctcactaccagccatttccttgacacagtcgctttagtcactgtgtctaccgccgggtttgttcacgggcggtatgtcctaagtagcatctacgcggtctgtgccctggctgcgttgacttgcttcgtcattaggtttgcaaagaattgcatgtcctggcgctacgcgtgtaccagatataccaactttcttctggacactaagggcggactctatcgttggcggtcgcctgtcatcatagagaaaaggggcaaagttgaggtcgaaggtcatctgatcgacctcaaaagagttgtgcttgatggttccgtggcaacccctataaccagagtttcagcggaacaatggggtcgtccttagatgacttctgtcatgatagcacggctccagaaaaggtgcttttggcgttttctattacctacacgccagtgatgatatatgccctaaaggtgagtcgcggccgactgctagggcttctgcaccttttgatcttcctgaattgtgctttcaccttcgggtacatgactttcgcgcactttcagagtacaaataaggtcgcgctcactatgggagcagtagttgcactcctttggggggtgtactcagccatagaaacctggaaattcatcacctccagatgccgtttgtgcttgctaggccgcaagtacattctggcccctgcccaccacgttgaaagtgccgcaggctttcatccgattgcggcaaatgataaccacgcatttgtcgtccggcgtcccggctccactacggtcaacggcacattggtgcccgggttaaaaagcctcgtgttgggtggcagaaaagctgttaaacagggagtggtaaaccttgtcaaatatgccaaataacaacggcaagcagcagaagagaaagaagggggatggccagccagtcaatcagctgtgccagatgctgggtaagatcatcgctcagcaaaaccagtccagaggcaagggaccgggaaagaaaaataagaagaaaaacccggagaagccccattttcctctagcgactgaagatgatgtcagacatcactttacccctagtgagcggcaattgtgtctgtcgtcaatccagaccgcctttaatcaaggcgctgggacttgcaccctgtcagattcagggaggataagttacactgtggagtttagtttgcctacgcatcatactgtgcgcctgatccgcgtcacagcatcaccctcagcatgatgggctggcattcttgaggcatctcagtgtttgaattggaagaatgtgtggtgaatggcactgattgacattgtgcctctaagtcacctattcaattagggcgaccgtgtgggggtgagatttaattggcgagaaccatgcggccgaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa
